United States Patent 11,001,841 (CCCTC-BINDING FACTOR (CTCF) RNA INTERACTOME) - sequence listing, part 39

SEQ ID NO: 93347 - DNA, 1074 bp, Homo sapiens
gaggacagctgagaggcctgggcccgtgagctcttgcagaggagttgacacgcagaggggctgctgtccaataaacgaaagtgtcggggaaaaactttgcagggcgatctgcattactccaaagtgaacacactgcatgtctcagggtggctggaggcggcgagaatccccttatgggagtatatgagcttttccatgtgttatctctttaaaacctctcagcggctccgagacaaaactcccagtgtcgcagaggtttcttcatcaataggagtagtgctggagaatcttgggcactgccctcattttgcctgcgaaggaaaaattaggaagggataaaaagtcacaaaaattaggaaggtgggggggataagcaaattccaagggcatctatctctgatgaagggttggtgtctcctgtggtgccctactgtggattagttatttgtgtcctcggtccagaagtttctctggagcccattggctacagctttcctgtattagaattctactgttatttcctactgtagtctggctgggaattttatttagttgttcagattttagatgcattcagtgaatgcagctgctcaaggaagtaactaatagtgtcttaccattttcttagctacttttcagaagaaggaacatgatctctaacagaagttttctggtagattactaaaacaggcagatagtagctttcctggctggctgagttaaatccctctccagcgatcctcccacttcagcctcctaagtagctgggattacaggcatgagccagcgcgcctggcaaatctctctagaataagtcaggatctagaaaataacatagggaaagaatatcttgccagatttcctctgtactgcctattgctctttggtatttactagactgtcttctaataaaaatctcctgagttgagttaaacgtagtgtagattgggggcagagatgggcacaaatgggcatcagagagttctaaaaataaatgtgggcttttcaaaagattggtgtgttgactggagacttctgaacttagaggagcacatttagtttccagggtatcag

SEQ ID NO: 93348 - DNA, 2013 bp, Homo sapiens
cttgcctcggcttctcaaagtgctgggattacagaggtgagccactgtgctcagctggattactaaatttttttttgagatggggtcttgctctgtcacccaggctggagtgcagtggcgtgatctcagctcactgcaacctccacctccctggttcaaaaaaattctcctgccttagtctcctgagtagctaggactacaggcacgcgtcaccacacccagctaattttgtatttttagtagagatggggtttcaccatgttgatcaggctggtcttgaactcctgacctcaggtgatctgcccacctcagcctcccaaagtgctgggattacaggcatgagccaccacgtccagcctggattactaaatctttacagatgtatcctgactttctctgccttttccctctgtatttgccccaaccagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtaaggttatggtacagttactcttgggtgagtgaattctggaaaggtgagaactggaagagcaaagtcttaaaagaggccaaccaaacttcaataggttgggggctaggaggagatgatcatatggagtgttaaaatggaggatttgtgagataagtttaattctctttcatatgaatttcttctcaggtgaatcaacggaatgtaccaggtattgacagtgcatacctggccatggatacagaggaaggtgtagaggttgtgtggaatgaggtacagttctctgaacgcaagaactacaagctgcaggaggtaggtgatgctgaaaaggtgaagcctggggaatgttggaacactgatgttagagaggaattggtgttgggaagctgcccgtgaggagagtatgttggggttagatcgtttctggggagggatagggaatggcttctcaggattattacagtgatttgtgactctgttattccactgtctcccttgctttcaggaaaaggttcgtgctgtgtttgataatctgattcaattggagcatcttaacattgttaagtttcacaaatattgggctgacattaaagagaacaaggccagggtaagaattttttccccatatttcctgaacttattgcaaagagactagctacatttattattgttccttttacactcagagattaaaacaaggtagttttgaaacagaactggaatcagctgcaatggcgataagagtagggcttcagttgtcacctatgccttttgtgtggctatagattgggcagaaaatgagtgaacttttgcttctttcttcccataactttcattgcttgttttcattgccctatttagtctaagtaagtaaagctaagaacaaaaggagagaaattttaacaaaccttcaaatttaaaatatgttaacaagggaagggatcatttctactataaggccttttagtaagtgctttgcctccccaggtcatttttatcacagaatacatgtcatctgggagtctgaagcaatttctgaagaagaccaaaaagaaccacaagacgatgaatgaaaaggtatagaaggagagcagacaaagtttgaggctggtttttgggggtggttttaaaaaggactctgttaataatgaagctgatcaggaagggacggaaggagctagtgggagagagttaagagagggaattactgctgacccttggatccaactttgttccaggcatggaagcgttggtgcacacaaatcctctctgccctaaggtaagtagtacctggttagtttcttacccatatttcctgatgtagttactccaaacagatttcagggcact

SEQ ID NO: 93349 - DNA, 2254 bp, Homo sapiens
agtgtggggattatctttatggtgaccagcaggagacctggcccttgctcctcttaacccttgggttccccctgcccttaatttcccagtggcccctctaacagcccagtgcccccacagctacctgcactcctgtgacccccccatcatccatgggaacctgacctgtgacaccatcttcatccagcacaacggactcatcaagattggctctggtgaggggagggagaggttctgggcaggggagcctcgggaatttgggaaccatgggggtaagatgaaaggaatgggggataacagagcaaaattctgaggtgtgggctggtgagaagagaaaggaccttgctaggagtaattaataggagaggccagttaattagtggagagggggtaggatatataatcttacacctttttgaagggaaaattggggttaatacagagatactgataagaggctgggaaagggcaagagataggtttgaggtttgatttgagtcctggggccagaccctgccagaggaggttccaggctgttcctgctgtgagtgctttcgtttgctgtgtattgtatgcagtgtacaacatttctgtgtgctgtgtctgtgtggtatttgtgtgtccatttgtctggggcttggctgctccatcgctcacaacttttctctgttttcctccctcccgcttacgggctgctctgttcccaacagtctttcataggatttttgctaatggtgagagctccctctgccccacttggggctctgtttgtgctccctctgctcccttggcggctgcccagtgcatgcagtcgtgggagcaaaccctcttcccctatcttccctgcctaattatgcctgcttagcttctgccctgccagccctccgcctgcttgccccttcataacctgcttgtttcctgtggattctgcctggctggccacttacctcctggattcatgttctccctcatcatcaggctagttcccagatcatactgtgctcccagattctctgtgacttgtagtcattgtttatgatctgagtgagtccaaattgggcctggtcctggttcctcgttcagctctgtggcagacagtgttgaggaataagggggtagaacaggagtctaaaatgttttggtggattaaaagtggaacagattcaagggtattagctcaattctgagctgttttgagtttcactcagcaaaggtgggtaagaaggaggctacctcctgagctgtatgttaatacttcttatccttatttatccaagttcctgaggtctccaattgtcccagattaggaagggctgcctgtgtttttatgttatttgcagggtggatgaaaaaactaaaaccaaatattttcatgtgagcagggattagaggtacctgggatttagggaaggtgaacgcagtacaagtgaaaatttttccttaaacttcattgcttctagaccagcctgaagcccctgtgtatctgttaatttagtctggtgcttttgttgctcctgatttagggacattagatgagaagcagtaggcctaagaaaggggaggtaggtggcatccatgtgtggtctgtagttcaggacaggaaagggaatatgtttgtgcctgttgagggtcatcagaaaggagacttcaggagagaatttggcttttggggcctctctctggagtgagactattcttcattgatgatggtcagattgtgggtgtctcccctactcccagtggctcctgacactatcaacaatcatgtgaagacttgtcgagaagagcagaagaatctacacttctttgcaccagagtatggaggtgagccttcctgctttctctgccctgtcctcatccccctgcttttgcaccttataacttgaggtacagaggcaatataactgaaacttctaggccttctctaccagcatacaaaatatttttcttttcttttttttttttcctaaggcattcctgccaaccctagcccccaatcctctgattaaccaaagccttctctgttttccctagaagtcactaatgtgacaacagcagtggacatctactcctttggcatgtgtgcactggaggtgaggggactggaggggaggggggaaaggggtcagatgagaagatggaattgggaatggagggaagacaagtaaggcgctggcttggagggagtgattgtgggagcactgaagttcttaggtgtctacttttttttttattcttcctcactgaagatggc

SEQ ID NO: 93350 - DNA, 1032 bp, Homo sapiens
tctttatttccaaagggattcttttttttttttttttttttttttttttttttttttgagacagagtctcactctctctcaggctggagtgcaatggcttgatctcagctcattgcaacctccagctcccaggctcaagcgattcttgtgccttagcctcccgaagagctgggattacaggcatgtgccaccatgcctgggtaatttttgtacttttagtagagatggggtttcgccatgttggccaggctggtcttgaactggcgtcaagtgatctgtccgcctcggcttcccaaagtgctgggattacaggcatgagccactgtgccaggcctccaaagggattctttacccctttgcctgcatgccttctttgacatttaatctgactatcccttcataatatcccactccatcatgccctccagacatgatcccagagaacgctctagaggagatcaccaaaaacatggatactagtgccgtactggctgaaatccctgcaggaccaggaagagaaccagttcagactttgtgagtaactgagagggtctgaaaggggcagattggtcacgaccactcttgaggctctgtaaactgtccattctctgggaatgcttgaatttgctattttgcttgtttctttccttccatctcctttctcttttctcgtccaggtactctcagtcaccagctctggaattagataaattccttgaagatgtcaggtgagagcagagtgagaagcaggctttcttgaggaagcaggcggggttgggtatcctaaggcgttcacagagcccatgtgacctgtcttcatctccctccaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtgggggctgtgtgggtgtggattgtctccatggttgtggtggaagggagagaggacatctcaaat

SEQ ID NO: 93351 - DNA, 1225 bp, Homo sapiens
gggacccgggacggaggcggggcccaggttggggcggggccgggcccaggtacagcggccctgcggctggcgcggcggacgggatgaggcgctgcagtctctgcgctttcggtaacttccgggccctggcgtctcgtctccttaccctggggctacccttgccccgtcctactgcccgcggttaacccgccgcgagccgcctctcccctccccgcccgactcaaccctgccctcccccgtgctttgcagacgccgcccgggggcccaggcggctgatgcgtgtgggcctcgcgctgatcttggtgggccacgtgaacctgctgctgggggccgtgctgcatggcaccgtcctgcggcacgtggccaatccccgcggcgctgtcacgccggagtacaccgtagccaatgtcatctctgtcggctcggggctgctggtgagcgcggcaggcgacccgggcgggggccgggctcccggagagcccagcaggccaaaggctttgtgtcttccacagagcgtttccgtgggacttgtggccctcctggcgtccaggaaccttcttcgccctccactggtgagagggacttccctggagcttttaacgagtaggcttgagtcagggaaatgggggctgactgagcttggtctttcaatagattggaggagcctcagagaaactgggtgtctagtcactgggagagttagccaggcccaggctgctcaccctgatctcctgtccctgccagcactgggtcctgctggcactagctctggtgaacctgctcttgtccgttgcctgctccctgggcctccttcttgctgtgtcactcactgtggccaacggtggccgccgccttattgctgactgccacccaggactgctggatcctctggtaccactggatgaggggccgggacatactgactgcccctttgaccccacaagaatctatgtgagcacattctcttccttcttgtggtctacaaagccttggtcctgcccttttaatttcccctatttgctgcacttgccctactccctcctactccccatccttcttgcttttcaggatacagccttggctctctggatcccttctttgctcatgtctgcaggggaggctgctctatctggttactgctgtgtggctgcactcactctacgtggagttgggccctgcaggaaggacggacttcaggggcaggtaaggaaggcaaacaggaagg

SEQ ID NO: 93352 - DNA, 1033 bp, Homo sapiens
cacacattatttagatattttccattctttttttatactaaatcttcaaaatccagtgtgtgtgaatgaagaaacaagttcataaaagcccaacacaaatagttacagaatgccctggactccttattttaggagtcctttctctgtactctgctacgaagattttacttatgacaaagaccttgaaaatgattttgtcaaaggcggaagtttcaaatgcagtgacctcaggcagcgcaggaagtatctgaaagagttaatgaactgagaggaaagataggtccactgatggctaatcaaaggatctaatggaccatgagccaggttttgcccaggagggtgcaaggttgaaggggagagtaagagaaaaagttggcatctggaggagaaaaatgtatgaaatggatgaggctgaggactcagcggtatttgtctctcctacccatttccatcttctgttcaaccactcaggcagctgaactctccatcaagtttctgcctccccaacgtaatatggaagtcgttctggctgtaggaccccagctgattggaattggaaagcacagtgcagtaagtaggatgctgagatggaacagaaatagatttcacagagatgggtgcaagggtgacatctacacccaggaaggtgtgtgaggtgggcctcctggtgggcatggcttgcagtcctggggaaacagatgggagagctcacagtgggaagactgggagcgaggagaaagtctccacgctgatttcccactgtgcaggctgcagagctctatctgaatctggaccttgtcaaggaagcaatcgatgctttcatcgagggtgaggagtggaacaaggcgaagcgtgtagctaaggagttagatcccaggtaagcttgtaaccccttcttactgcgaaattctcttttacttccttttgtaaagactgggagaaagtcttaccgggagggttggtattctggaacatgaagatggagctctctgaacatcttcacaggtatgaagactatgtggaccagcattat

SEQ ID NO: 93353 - DNA, 1022 bp, Homo sapiens
aggatattggtaatgaaggagtgatgagagaatctgtgcaaagtgctcgataaatgtcacctgctgccattttggctaggaatcatccttgatcccattttctccagacttcccacatgtagattatcagtaagtcctaaggactctgtcttcaaaacacatcctgatgtctccatccttgtgcagaccactgccgtctcccacctgcaatattgcacagcctcttaattagtcgcactgatactgtttcttgtacccctaccatctattcatcccagagcagctgaggtcatttttttaaacatagattgtgtcattttcatgactggaaccttccattagcttactgttttacttagtataaaacccaaactccttgtgtggccttagccctgaagttttttggcctctgcttccttctcatgccagcttcctgcttgcccattagtctccaaccacactggcatccttttggctctgtgagtgtgccaagctcatacctgctatagagccttaacactagctgttcgctctccaggaataacttttccccatcctgccatgactggctttttcttgtattcaggtctcagctcaaatgtcagttcatcagagagacctccaactaccaacttaagtggccccttcagtcactatctataacaggggtatccaatctttggcttccctgagccacatcggaagaagaattatcttgggccacacataaaatatactaacactaatgatagctgatgagcttaaaaaaaaaaaaaaaaaaagagaaaagaatcacaaaaaaatctcataatgttttaagaaagtttatgaatttgtgttgggccacattcaaagccatcttgggccatgggttgaacaagcttgatctgtaatattacattactttattttattttttattatctccaattttactaattatttgtctccaccagaatggaagttctctgagagcaaggccctcatcttccttggtctctatatgtctccagtgacaagac

SEQ ID NO: 93354 - DNA, 1010 bp, Homo sapiens
ccaacataccctaatagtgaacatggtgactctctcaggtgcctcaatgttgtaccatacacacagactgtttcggttctgagctaccagcacgtcacttcctgggacccactgcatataggagcagaagttgaggatcattgtcttagagcagctttcaatatcatacagatgcaactgaagaaagaaaaggcaggtaacacaattacaaggggatgtggggttgtctcctgcttttgaccattttcctaatggtgagatgtggtgagctaacccaccactcaggttcatgctgcatttcaaagcttactgacctgctttctgctgagctggtatatcctaactctggtcaagtaagagatgacccatagaacaaagatctacatcccaggaattttaagttaggtgaaggtcagactttccttcttgaaataactctgggccagagttaccagcttggattacaaatggcaggccactagaaaaattaaattatccagaaatttgtgatgtggctttcactgaaatgaaaagtcatcaggttgtctctttgatctgaggttgaagactctggtgctaccatattgggatgagaatcaatgagggacgaagaggctgtcctccagccagttcatgctatcagataagtgtggctgaaaagcactggacagcaggtctaggtgaaggtcagctaggcatgaggaggaggaatgcagggttaaggaagtttcctgagggcacagactgtgaatagtaagagacaccaacttccaaactcccttcttgactttgttgccataatacaatcacctctgaggtcatacaggattgctgggcgcatggctcaacacctgtaatcccagcactttgagaggcagaggcaggcagatcacctgaggccaggaggtcaggagttcgagaccagcctggccaacatggtgaaaacccatctctactaaaaatacaaaaattatctaggtgtggtggcacgtgcctgtagtcccagctac

SEQ ID NO: 93355 - DNA, 1109 bp, Homo sapiens
tggggcccattgttcattaataatggatatcactaaaacttataaataggctttgatcaagagaccccctgaaaccatcccagccaaccctaattggtctgctctaaatgtgatagtttctgataatgtctagaagattcaaaccaaactaaaatattcatcctctgcagtgaccagcctaactttagtcagaggtttgtctgttgccttccccaccatccacccttgcagtgctcttacacagtaggcattcaaatatacgggtgacttcttagagcatatgaccatcaaggtcattgattcatcagccttgtctcactgctgtattgtatcaggcttatctttaatgtgctcagtgctgccttcgaggggattctgtgagtaggagaagccacttgctcaatagttctagtctgctctgaggtaactccataagccccagagagtgatgacatttctgtgggtctggaccttttgagttaacaacatagttaaacaaaacctctacaattctaaaagagacctagcttcctaggcatcctagcaaaattatgtgtgttggccatactatgtatatgtgtggaatctctcttcttaaccctgtctcctttattctatagtggatctgattggtggctacaacattggcaccgtcagccatgagagccgtgtggattggctggaacttaatgagactggacacaagctcctcttcagggaccggaaacttcgtgtgagaagagctactaaggccttaggcattggctggcccacagagggtgtgagacaagctgccaccagggactgagggaggcaggatggagcacattgtctttgctgtgtcatcaacatggcagaaggcacagaagaatcaacattctctgtagctgataccaaaactgatagcaaaacccatcctttattacctctttttttttttttttggagacagtgtctcactctgtcacccaggctggagtgcagtggtacaatctgggctcactgcaacttctgcctcccgggttcaagtgattctcctgcctcagcctccccagtagctgggactacaggcacgtgccaccacacctagataatttttgtatttttag

SEQ ID NO: 93356 - DNA, 1072 bp, Homo sapiens
tccttgtattctcttctttcttcactgactcctaccatttatctccttgttccatatttttttgctcctagtagcttatttttctcacctgccctggtctttttgttttctctgctcccctcactcttattctgttttagttttgccttgattttcccagcttatttcctgtgcacctttatatcctcttctgctagactgcctagcttgtctgttctttttatttcctttcttttctgatatagcaagactaatttcctttggttatcagcccatttgcactctttagctcagcctcaatctcttctaaaagccacatactttatttcaggcttcgggtgttcaactggatccctcgaagaagcatctgggaagaggcaaagcccaaggagattaccaatttatacaccatcactgccttggcctggaagcgggatggctcacggctctgtgtggtgtgttactagtaatccctttctggattggtgactttcaccaaactagaaaaaaatcctgccttatcctaaagcactgttccctgacactatagaatctcctctttccttttgaccctgacctaaaattctggcattaaaggcaggaaagagaaattcatactttaccctaggtcacaaaagggacaaaaaattgtgtgtaggcagggctagtttttcccttttatcccattaatatgttgtgcccttgagtccaatgattgtagcctctttccttttggtaattccaaaaactgccagctctttcactgccaactcttctctagactctagagcttaggttttgaggatgtctctagatactctccccatgccagtgtactatgtgtgtgaccttttatgctgtcactttcccttctagggcacactatgtggtggggtggaacagtttgactgctgcctccgaaggagtatttacaagaacaagtttgagttgacgtatgtgggacctagccaggtaagcaggatggtagcctactgcactgagaacttgcgtggctcattcctccttataacatttccctgccttctggccacagccatagttcaaatttaat

SEQ ID NO: 93357 - DNA, 2225 bp, Homo sapiens
gatggctcctctccaagagactgtgacggctcctctccaagggactgtgacgtcttctctcagagggactgtgatggcttctctcagagggactgtgatggcttttctctgagggactgtgatgtcttctctcagagggactgcgatgtcttctctcagagggactgcaatggcttctctcagagggactgcaatggcttctctcagagggactgtgatgtcttctctcagagggactgtgatggcttctctcagagggactgtgatggcttctctctgagggactgcgatggctcctccgagcgggactgcgatggcttctcttagagggactgtgatgtcttctctcagagggaccacgatggctcctctgagagggactgcgatgtcttctctcagagggactgcaatggcttctctctgagggaccgcgatggctcctctgggagggactgcgatgtcttctctcagaggaactgcgatggcttctctctgagggactgcgatggcttctctctgagggactgtgatgtcttctctgagagggaccgcgatggctcctctgagagggactgtgaaggcccctttcagagagactgtgacagctcctctcggggggactgcagtgatttctctgagacggactgcgccagcttctctcagaaggactggaatggtttttcctagagggactgcagtggctcctctgagagggactgtgatgtcttctctccaaggaactgcgttggcttctctcagagggactgcgatggtttctccaagaggggttatgacgggttctctcagaaggaccgcgtggggttctctccctatagaagctggggtggttatgctccttgtgtgtgagtttgtctttaagatgtcggtgccaggttctcttcacaggggaaccaggtaggattcttcctcgggcctgaactctggttcctggtgtggacaagttcttagactcctggctggaggtttcatttctatagaagtttttctttgatctgctactactgtccttttgaacagttctcagaggctgccccactgaggcagtttggaaagcaataccactttgggaatctgtgggcttgggcagtcgaagaggtctgggttggaaagagtaagctcttcttggctgttgagctgatctgcactggaccgttcctccccacaatatgtcctcctgcttaatggttgagcctgctggcgttagcttgtcagctgacctcttgtctcttttgatactgcttggtaagcaatagtccctggcattttgttttggataatagtttttgcttgcccacaaattgtctggccttgtcccgtccacaggcttccgcccaacagaagctataactctgtgtgctgtttggaatgcccgctttaggctctgaaaaagcagttgcatgaacttgggttgggaaggtttcttaggttgtctttttaaagaggcagtacttgtctgagttgctccaatcctcttccttcttaaatgggctgctaattccctagaaggactctctattgtggttctactgtttgtgtagaactttctgtgttttctaagtcgcttggtgattctcttcattggatattttgaatcagaggtctttttggttctcactttagcccgtttttcattctgagtgctttcagagtcactctctggtaggttgtgaacttgagtgaattcatagtgcccaggtgctctagtttttgtcttttctactaagtcaggcctgctgcgttgtcctcgcctgatgtagacttgtacaggagcaggggactgggaaggcccagactgcaaatctattgtggaagtaggactcttggaagcttgagtatagattttagctttcctttgtgatggtgatatagggcttctccgtatgacgggtctatctctttcacgatactttgagatttgggatcttttcccaattctcagcctaaagccaagatgcaaccgaacctcaccatggccttcaggagtgcgtacaaggtggagctgtggatagataagaagataaggccccgaagtggtctgtaatttatgatggcaattaagtcctgaacatcggccacactgtaggcagatagggtattttaggactagacctgaagctagaggtggaggcacatcggggggtatttgactccttaagagttttgctgctatttttagctgcagatcttctagcaactggaactgt

SEQ ID NO: 93358 - DNA, 2992 bp, Homo sapiens
gggtctgtaatttctctaagatgaataaaggggcagtaaatgatcttcctgtgcatctggactgagaccactgggcgggtggatggggaaggcaggctggagggacacgaggagttgtgcaaagattcggaatgagagccaggggttttgaggcccagccgaggctccaagctccgccccttcactccagaccccacccataggttcccgggtcccgcgtcgcgatcccagtggggcggggtctcagaggaatcggagggtgactcatcacgtgactcgctccggccgcagccccctcggaagctgctaggcggaagtagaagttcagaagagggctaggcggagccgagcccacatccgggagaggagagcggaagtggcgttggtctggccggagcccttgggtgaaattgttaggcgtggagagggagtgatgtcttccagactcggtgctgtacccgccgtgagtttcttggtttgaccgttatgctttagaggtagcgctgtcgagcccggaacacgcggtccctcgcttttgtcccatgctgagttggttttatcagaggccatcgtaggccccacccttctagatcagatcacctgtccctttttctttacccacgttctgctgcctgttccccacctccttggatttaattcctcgccacattaccattagtttctattccttttacatccccaatgtctctcatatccgttgtcttttcttttggcctcccttttagagcctgggacagggctttgagaatgggggaagacgaaggctctggtattgttacccgcctttgcactgctggaagataggacagcatatttttcctaaaaggtgttgccttcttgtgtttgaggtggtttccccgggagaacttcatttcttctgggcataggggaattcgtctttttgtggtcgaggttcagaggtccctagcactcactcgtgtgcttgtgatttgctagacttcgggacccacaacctttaagcagcagaggagcacgaggatcgtgggagctaagaagtaagtgaggttttctaaggtccttttatgattgtgtcaccagcgctgaccagtagaacttcttcctgtgatgaaaatgttctgtatctgcattgtccagtatcatagccactaacccggtgtggattttgagcagttgaaatgtggctagtgcaactgagggactgaattttaaattttatttgccaagtgagtgaggtttttctaaggttcttttgtgattttgtggccagcgctgtccagtggaacttcttgtgacgaaaatgttctgtatctgcactgtctagtatcatagctactagccccgtacgccttttgagcgcttgaaatgtggctagtgcgactgagggattgaattttaaattttatttaattttaactaacgttaaatagccacctgtagctcgtggctatcggattggacagtgtaggtctaagtctagtgtgtgggagaaaaacctagcttgcaaaaaaaaagtacaaattgtaataaaaatggaaccaaagactcagtggtaattctgtatttctccagacatgaaattcgtgctcataaatacactgatgaacttgggatggatgataaaaatggccgtaagaaatccttgtatttttaaactacttgtctgtaagactggtttattatttagtacactgaaggtgcttagtttttccatggttaatacaaaagaaaacattcttgttaactagacattaaatggattcattcattcaggtgacatttactacatgtttgctgtgcgccagttctgtagtaggttaggaatacaggcatgaaaaacaactagcagtctagaaggggagataggcaagtaggtcaacacagttcattgtaataagtaagtatttttaagtaggaatttaatttagcctttgaggaaggggagtgatagtttggaagggaaggattatcagagcaggtcactcctaagtagaaacttgaaagttgaggaatcatgcagttagtgagaaggagaaaggtttttcagaacagagaacagcatgtgaacgtgtggaaagagttaatgggatagtaagtagttctgtatgtctgggatagaggatgagggattgcagggagagcgtttagagaggttagtaggggctagaccatggaggacctgttacggcatgctaaagtgtttggattttatcctggaagagataatgagggaatgacatagccagatattggtcttaggccactctggcagcattatgaaggatggatttggaagggtactgggaaactggttcagaggttattatgataacctaagagatgaataaagaacatgtagcctatggtgggaacaatatacagggaatacgtagggaacaacgtatagggaatgtacaggtggtgatgatgagaagtgagtaagagaaggaagataggatgtctatgggtttctggctttggccatcaggtgaattttggagtaattcacagaactacaaatttctgaatgaggagcaacatttggaacaaaaacaaataggtttggacctcagatgaagagctggtctgaaatacagaattgggaattatcagctataaaaaataattggaaacatgatgttttcttccacaagctgagagttttaatgagctcttctagttaaagtggttagagcaatgtttctcagtatgtaccttggtcacctagagataattgttaaaaaataagattattaggcccccatccattaaccagatttggaatcattgggtttagggcatagaaatctttacttttaactagcttcctaggagattgtgacatttgagagtcaatggtgagaagtgagaccagagaagagtagaggaggaaatcatggagaacactagcttttaaagattgggtagaattaaataagtttacaaaggataccgagatgaactaaagtacttttctaatgaaatctaaata

SEQ ID NO: 93359 - DNA, 1021 bp, Homo sapiens
caggtatttagctggaaaagggaggttctaggagtccattgaccactcttggagaactgctgctctgctgcatcttgagccacctagaagaatgtctgatgctttgtagttacagagtaatgttttttagctgtcatactgactggtcttagattttggaatctggattcagctgtataccagaaatctctggccaggttaattcatgcaagatagcatccatcctttagctgtggaagctaagtatcatgttgcctaaataagatagggcatcaggttttagggagaatgctgaggcagaaggaagatgagtcagattagggcccacagactattcctttcccttagagataccctttagttgccatccctctgtcagagaaagagagaggctgggacataccaggttacaaatccagggagtcttctgaagggtcatagaacacctttattgcttcacctactttcttttattagatgaatctaggaaggaatgtctacttgggctgcaaagtgatcatttatgtgtactgcttactcttattacaatgaagtgtgataataattgtacatgttgtgttagatcaactattgttattgttaggtgattacaacttacattctgtttttatagcaggcttcttagttttctgcagaggtaaccaacttggttataatgtaaaagaatgtatagaaattttgctccagaccttcctttgtggtatatatttttatgttgtattagtagcaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaaggtatcaatatcagtgtcttattctgaagacgggccacttcctaaagttatagtttgagattgttataaatacctcttaaaagtattaa

SEQ ID NO: 93360 - DNA, 1113 bp, Homo sapiens
tgttgatgatttaggggctggtgtaaggattattcaggggagaatattctggatcgtcacaatctcaagggtccttggtggctagccctctatcttgagcaattcttatcctcttgttagcctcaagtcaagattaagcaaaacacattgcttgaatgcccttattattcataaggaacaatggatgatttggaatagataacaatataaaaagaaagggagagtgggtcagttaatgagaagttacaccaacttctctaaaaatgtcacagacatttctctgaggcctgtgttcactgatgatctttccttttgatggtcttgtgaatgatgttttgaagacaggcctagatgttcatttacaaagtgtgctgagtttttgttttgtttttgtatggtacttcagggtcaggtggagtatcagccaaggggaaaaggaaacccaggcaggaagaagatgaagactatcgagaatttcctcagaagaagcataagctttatggtaaggcagtaactttgctacttctttttccttgggtgactgagctttattctttgagggtaaaggaaagagaagccttagtttgagcccttcagtgacctctgagccctttgaattgtttgggagggaatggcctccatcctgcctcattataccctttcattctgtcctgacttaggcagtcagtcggttgagggactgggaaatagggtgttgaagaggaggagagggaagagattttggtattagcaagggtgacatgctgggcttcaagtttctgtcttatgtcagggaggaagcaacggcctaaaactcagcccaatcccaaatcccaggcccgtcgtattcggaaggaaccaccagtttatgcagcaggtatgttttcttttggaagttttgagggatgtagttctcacactctgatttgttgttggtgttgtctgtgaaggaatgaggtactaaagcatttctttaaggaggcagttactaagggctctagtttggagtcagacagacctttgctcaagttttggctcttcattaactttgtgacctgcctcaatttatttaacttcctcttgcctcagtttccctgtctatgaataggggta

SEQ ID NO: 93361 - DNA, 1757 bp, Homo sapiens
gctttagatttttatgtctctaagattcttggtctggtattgggtgggatgccagggcatgtccaagacttagaaaagatcaccatagtcacaagtcattatcaatttaaaggaattggaagaaacatatatttgttctgagttcctatccctgaattctaagagattcagctccttgcatttgagcatctcctacactgggcctgccctgtttaggtgggcctaaaactttgtagaatcaccttacatgtgcttacctggattggtaaagatcctctatacccatctgaaccatactggcctctcgggatgggaggtgggatagggtgtcaggctaacagccattcacctcactgaatcttttccatgttgacccaggtgtcctacaacctaccagccatgggaattgctgccattttccaatctcctcacacaaaatgagcaccatggaaacctgaagcttcaggaggggagagaagtctcagttcaaggcaacaagggagttgtaggcatctaaaccagatctgtctaggaatgcttaggagtttgtcatcttgatcctagtttctgagtccttaaactaggtattacggatggtactcttctaattctggattttgaaggcactttttgcgacagtagatcatagtgggaagaattgtacattggtgcctctggtgaattttgggcatttgatcattttgggggaggaaccaagacaacctggaagtgaagtgaaaggaacataggaaggtagaaagatgtggcatattacctgagaaaaagtaggagactttcaggttgtgttgaagtagggtgggtgattggaacagaattgcactaggatggatttatgttgataatcatccatccaagctggttttcctaaatctattactatattggatctttttccttcttatctttgctgaagtagaattccctcttttcatctctaacaatccctacacatagcccagttatgttgctgaatttaccagtaattcttttttgtttctctcttggaaatagggaaactttgtggctggaaaatacaaatgtcttctatgtcagaaagaatttgtgtcagagagtggtgtcaagtatcacatcaactccgtccatgctgaggtgaggtttttgtaatcctgtgggcctgatatgtaagccacaagagaggtagactttgtccctattgttatggactaaggctgtcaaggaaagtatctctaaagtggttaccagagccattagagttaaaatattctctaaacttagatatataattgtatttttctgtgaaagtatttgaagtcactgtgaggggtgggcggggtggcttatgcctctaatcccagcactttgggaggccaaggcaggaggatcacttgaacccaggagtttgaggctgcagtgagctggttgcgctactgcactccagcctaggcaacagagatcctgactcaaaaaaaaaaaaaaaatcactgtgactgtaagcatccttgaactctttttttttttttttttagacggagtctcgctctgttgcccaatctggagggctcactgcaacctccacctctcgggttcaagcaatactccctgagtagctgagattacaggcacctgccaccatgcctggctaatttttgtattttcagtagagatggggttttgccacgttggccaggctggtcttgaactcctgacttcaggtgattcactcgccttggcctcccaaagtgctaggattacag

SEQ ID NO: 93362 - DNA, 2220 bp, Homo sapiens
gtagatcatttattaaagtccctagaattacgccttacaaaatatgtgcttgtaatagctgctctgtgttggatttctccatcttaaaatatagaatcctgaggtatggttccatatctgtttccttcttactgtgttctgccctaatcatgccttttttccattcttcctccacctttctttatgttcttcactatattttcgactggatgacatttctattttgcctctctaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataaacgaggaaggaaataggcagtcagtgtaaaagtgctcctaggaaagcagatgtgatgctgttgtcacggggacctgtgctgggaggactgagtgaagattctttcagctgtttgtgtaaggctgtgactttctcagctccttcctcctgtgtaaatttcactgtcttcccttcttacattttgattcccccctccccttttagtaggttttcctgctattcctcgtcaagtcctcttgtttttttatcttgcccaaagagctccctctcaaggccaactataggctcctcttgccctgtacaaaactaagaaacctctttggttgtcctttccttcctggggtatagaatgttcttggaagctccattgatttagtagctgctccatcatctagcttgtgaaaccattccaaactaattttttaaaaccataactgatttgtcattttgtatttgtgatataacaagtctagaagttagaactgttgtcattcacataataagattactctgtctccttgggaaaaaaactttatggaggctgtttgtcctctcaatatggttttaagattgaaagtaagaaaacggatttaggatgaaaactctagaactaccctatgctgtttatactgggaaatgctttgtaccaagtagcagtgactagacccacagacatgaaaagcaaccttaggagtaaagtgacccaaacattaaaatgacaggaaagagaaagtagaagcagcaataaatactgccccaactttcctggagcccgaggcctcatccatagctatgatcacttgccctctgaagcttatttttgcttctttggttttaagaattgagaaatatcacattgcccctgatgttttgacagtctcctagtgctcctggtagtgccactaagggaaaaccaaggtgcgcattccttctccctggactttaccttacttgttagtctacgccccactgtttccacccatccccttagccaacctctgtctttttgaattttctgagaatattgtcctatcctcttttatatatggagttctctcctctttatatcctgagactttgacaccagatgtagatatttatctggagctggaaagaaaaattctttttctgtacctcatgcctatctggtaatgtttaatgggttatttctctttgagggtggctttctctggaacattggttagagcagctttgttgtcgtgtttctggattctcttccccattttgcgtaaatattggtcttatatattcttgcctattttgtggcatatgccacataaaaaatgaacctgatatagacaagtactaccttttcaaattctgaaaggctattaccactttaactctttgtgctcctccaaatagctttaaaatgtgggcttttgtgaagaccactttcaaacaagggagcactgaaacctgaattggatactgccagaataggtagttttgaaacaagttaaggacatggtatatgcactctgcattttcattggcagtgtgcccttaaagccctttcagtagatgagggttgtcagggaggagaaatgaagaagctatgttaatttctggtgagtaagacctggggaatgtttggcaatgacaaaagaaataaatgactctcagaaagatgtttccagtgttctttgacgccgacctgctgcatgactcc

SEQ ID NO: 93363 - DNA, 1034 bp, Homo sapiens
gttcctgctgcagctgctgcttcctgttttctaagtggctttgagtagccgttagtttctgggcttgctcaattagctgcagtaattccttcttgaactgctggttctctctgttgatgccacaggagtattcaaaaataaaccgctttgctgccaacttcaaggcctgggccttcatattaagctctcttctttttctctttcccagtagcctcctgtctggctcgctcagttgtttctccagtaatcttttctcctggaggagctgggcctgtacttcccgtgtctttgaagctgtctcagcttggactttctttgtctcctcctgtaatgtctgtatttctttctcctgcttttcctttaatatagcaatgtccctcattgcctgcaacttccgcttcaaactggattggatattttccttttgcaagagcgctgttttaagcactgaaatttgttctgcatatctggaggctgattcttgtcttcttcgttcaatctctccacttttttgtaaatagctgttccataccttctcaggttgctctgtgtactcttcagttttgttagtcaggtattccagaaagaatctgttttcagcctggacaagtaacttttctcggtgtagctccctggattcctccagtagctgtttccgctgggtttgagcttgttttatatgcttgttcagatccgtcatttccgccactatcttttctttaagccttgtctctacctttgttagcttctctggcttgacaaaattatttattagactatgatacggtggaaggagccttctggggccctcagcaaacctgaaagaacaaacgagacattcctctgtcagttaatgaaactttaggaagtaagtgcacaactgtccttcattcatacaagagaatatttctgagcaccagaatgttccagacattatgcaaggtgtggggaatccagctagtggtaaaggatgaggaatgtagctcgtcatttacaacgtgcattcactacaaccctgggaggtattacctcag

SEQ ID NO: 93364 - DNA, 1043 bp, Homo sapiens
actcaggaaagatgatgaaagagcctagaaaattatttctactcctgaccacccagtctgtttctgtgaccctttgtagctgcaaacagtgttcagtaagtcataagatctggctttaatacccaggctctgccacttgctagtggtgtgagtcatgggcaagtcacttaaactctctgaacctgttttctccttttttaaaactgaggtaatacctcccagggttgtagtgaatgcacgttgtaaatgacgagctacattcctcatcctttaccactagctggattccccacaccttgcataatgtctggaacattctggtgctcagaaatattctcttgtatgaatgaaggacagttgtgcacttacttcctaaagtttcattaactgacagaggaatgtctcgtttgttctttcaggtttgctgagggccccagaaggctccttccaccgtatcatagtctaataaataattttgtcaagccagagaagctaacaaaggtagagacaaggcttaaagaaaagatagtggcggaaatgacggatctgaacaagcatataaaacaagctcaaacccagcggaaacagctactggaggaatccagggagctacaccgagaaaagttacttgtccaggctgaaaacagattctttctggaatacctgactaacaaaactgaagagtacacagagcaacctgagaaggtatggaacagctatttacaaaaaagtggagagattgaacgaagaagacaagaatcagcctccagatatgcagaacaaatttcagtgcttaaaacagcgctcttgcaaaaggaaaatatccaatccagtttgaagcggaagttgcaggcaatgagggacattgctatattaaaggaaaagcaggagaaagaaatacagacattacaggaggagacaaagaaagtccaagctgagacagcttcaaagacacgggaagtacaggcccagctcctccaggagaaaagattactggagaaacaactgagcgagccagacaggaggctactgggaaagagaaa

SEQ ID NO: 93365 - DNA, 4299 bp, Homo sapiens
tcggctaccgaataagcccgagcagccggtcctccagtggctccgctccccgttctctgtgggctcaaaatgacaggcatgctcctcgttttcttgctgtgtgagccctgccctcgggaccccatctcttctggccttcctccgggagacaaaagccctcccaggctgcagagatcagcgcccttttcctagctcccttcagccttcctctcgcttgctcagcgcccccacttcctcgccactgtcactagttgactcatcagccctgcccgacgctaagaagatgccctggcaaccgccgcgcccctcacccgctcctttctgacgctgtggtggttttcgttcgcagcccagaacattgcggaagtttctctacccatgcggtgtctctatggtcgggtgggtggggccaggaggaagatggcggcgtccgcagctgccgctgagctccaggcttctgggggtccgcggcacccagtgtgtctgttggtgttgggaatggcgggatccgggaaaaccacttttgtacaggtgacgtacacagcatgggtgtagtaggggagcgcaaaaggttgcctccggcaggcggaaggccaggaagaaagggagggaagaggatttggagggtaccggcgcatggctttcgggggcttcccatcaactttagttccttccccggcaaagcctcctcgggccctagccaggttaattaaggctctcttctgcgcaccttcagggcatactcggtccagcttaccacgttgtacaggaattgtcttgctgataaaattgcgtttctcggaggcaagttacaagtaactttaaagattaatacagtgctagcacacaggttttggtgaagatttgccaaatatttcttgcacgcctgtcatgttccattcactggggatatagcgaaaatgaggttgacaagattcattcgtggggccaaatatttaatggaggagatagagaaaacccacatacgaagaatcaaaacaagtaaacaagtgactacgagtaggggaagctttgttagatgggtgatgaagaaaggtagcatttgaactgagagttgtatcttggaggtggacatggtggatatttcaggtagaagaaaatctaagtgcaatattcttaaggcatgggtgttaaaggaatggaagttctctcttgtcccctctttgtctccttccaaccctctccccatatctctgcagaggctcacaggacacctgcatgcccaaggcactccaccgtatgtgatcaacctggatccagcagtacatgaagttccctttcctgccaatattggtgagtaaaccagtaacataacttgtgtgcagtgctttaaagagaatggaaaaggccaggcgtggtggctcacggctgtaatctcagcactttgggaggccgaggcaggtagatcacgaggtcaggagttcaagaccagcctggccaagatggtgaaactccatctctactaaaaatacaaaaaattagccaggcacggtggcaggcacctgtaattccagctactcgggaggctgaggcaggagagttgcttgaacccgggtggcagaggttgcagtgagccaagatcgtgccactgcactccagcctggtcaatagagtgagactctgtaaagcctccagcctgccagtcttcagtgccttcttttttcatgttttctaaactatctactttcatttcctttggatttgcttgcattcctaaacagcttaggtttttttttttttttttttttttttagacagagtctctgtcacccaggccagagtgcagtggcgtgattcacaggtcactgcagcctcaacatcccaggctcaagtgatcctcccacctcagcctcctgccgctatgctgggctagttttgttttgtttggagagacaaggcctctctatgttgcccaggctggtcttgaactcctgggctcaagtaatcctcctgccttggcctcccaaagtgctgggattataggtgtgagccactgtgcccagcctaactccttttaaaaaatcatgtctgcattgccattgtgttgcctttgtcagtaataggcaattagtaagaagcattttttcccccttgatttttgcctccctttttctaggcatgtttaagttgcatgaaactttgcactttgtggagacaaaactctttgccacaactttagagctcctagccctaacattcttcatgatttacttggcatttattctttgtaaggaaggaaaccagtgtgaaagtggaggtggtagaagagaatgctgacaggagaaggctagaaggccagttttactttcctggtggtagggaatgtgtatgtattacattccagttaattcttttttttctcctcagatattcgtgatactgtaaagtataaagaagtaatgaaacagtatccttttccatctactttggtcttgactcattcctggcttcttgtctgtgtattttgtggcttgaaagagtgtttttgccttttccttgtgaaatatacaagcaaaaggatggaagctgattgtgggagaggtaggtgatcagaaatactatttcagcttgagattttagttttcttaccatctccccagatggcaggctgttgtaattaaagagcagagagtatgataggataactgacagctacctgggtcccacaaggtagtattttgccttggaggatcatctgttggtcaccacctctttagactgggaaactcagaaatgagtgagtttagttggattaactcttagtaaattgctgtatgaaatgtgtactctctccgtaggcaagtctaagtaggaagactaatcataatcagcagattgcttggtttatttatgaggatcagagccggaggtgttatacaggtggccttaatgaccaatgccagtgggctgtcactgcctgatgcacctgtattacattttggtcactttgctttcttcattttgcctgaccactccttaaatcaaatgagtgagccagaccttgataatgactgtttccctgtgtggttaagtttgtatggtagtcaaggattaggttgccagtatccattaatggaacactaatttcataatgccgtttgtgtgaatgatagcctaggtatgaactttataatctaatctataagcgatttcagtcctcaacttggtgtctagatatggacttggacccaatggcggcatagtgacctcactcaatctctttgctaccagatttgatcaggtatatctgtctttagtatattaatatggttgtgtaaaaatctgtgactcttaaattccttagcttgatcacattggtaaagaagagcagcaaacctgagcataaatatagaaaataagtaggcattttgtcagacagagaagtagactatgagaaggtgatcagtatggtcagacacttcaaatttaatatttgtgacagctaataaaaatccaaaagacctgggttattttcttgacctgttctttgcctgtggtattaccccgaagctgggatgggggtatttgggagtgggatggactagcagtcatggaatggaaagatgatggggcattttacttgtgataaatatttgtcattctttaggttttctttgtcacctacttccataagagtgttttataatcactggtttttatactctgatgttaggccatgagacaggctgttaacattttgacaagagataacaacttgacattgacagatcaaagtcttcagcttctcagatccttggattgtgccccaagatggtattggagtgctgctgatgtggctgtgttgctttagttcagcctgtttattctttgttgtcctaagattgcaaatgttcagtaggtgattgagggattcagtaggtgatagtgcctgtgaggtatgccaccctggagagggctctgtgattttgtgttgaaatcggaatttgttgtcattgacatctttttcttttaggtgatgaaatttattgagaaggcccagaacatgtccaagtaagtgatgtcagtaacacccatttattactctgtagctgacatatttctaggcttcatggaggatctgggataccatcagcctctgaaagaatatagattgagatgaaaccattaggagtgaaaaaaaaattggcaaatcattaagatgctttagaatatagagctaaatttaatatcatttcatcctcaattactttgatccccaatttacatggcttcttaggagctcttttgagactttgtcccaattcagttgtccacctg

SEQ ID NO: 93366 - DNA, 1022 bp, Homo sapiens
gctatgtctacttcaggtttttgtgttttttttcccccatataataaagtttattgtatcttttgttttttcattttgtaggctggggatgaataaagagtaatgctttctatgtaggcattttgcctagccagtttaaatgttccagttcaattaacagagcaggggatccaccctggactgaactcaacactttagaattgagggttcttttgaaacctttttgtgttccgtttctgaaccctctaaatcagtctgcagagccctccagtctaaacttctgcagtaacccaggcccacgctacttagtgtttctgtccctataccagacgtcccttatctgcatcagtttttatgtagcctctagtatttgtataattcttcatctccactgagaagtctggcatctaatttgggactcctttttgaatatgatgacatttttctctgtatatacaggccaacgcagagagccaacagcagagagaacaactggaacgccttcgaaaagatatgggttctgtagccttggatgcagggactgccaaaggtattggagggtttcttggtgttaggaactaaaaaaaggttacacttctttcttttatttatttatttatttttgagacggagtttcactcttgttgcccaggctggagtctcggctcaccacaacctccacctcccaggttcaagcagttctcctgcctcagccttcctgagtagctgggattacaggcatgtgccaccacacccggctaattttgtatttttagtagagatggggttttttccatgttggtcaggctggtctcgaactcctgacctcagatgatccacccacctgggcctcccaaaatgctgggattacaggcatgagccactgtgcctggccggttacacttatttctatcagcaggattctgtttatatatgagagagagaaagagaaaaagataaaggaaatgtggttttatatatatatatatacacacacacacacacacacacacacacacaca

SEQ ID NO: 93367 - DNA, 1050 bp, Homo sapiens
ttgattttctatttttcccctccctcctcttcttaaataataccctggctccttgataacatttcaccctgtattttctgcagaccttctctgaacttacatttccaccaggaggcttccttagcactccacactttcactgtgactcaccagcacactggatctgctcaaatgttgttagctttcataggaaaaaccatcaccccttccaagctgtgagccagtaaaaaagaatgatgctactagtaagacaagcttcttgaaaattatttccctcagcttaaaaaaatgggactcctagggctatttgccttatgaaagcactttgtgaactaagctattatagaaatgttaagtggtattaacaatacatttagaagaggtaagatcctgcgtttatatgtatcatgagcactttcatcctgccagtttatgatcatagttacttagtgattcaagatcacctttttgaggaggcatatcactgataggtgttttcactgtagacagcttatctcctgtgctgcacccttctgatttgatcctgactcgaggaaccttggatgaagaggatgaggaagcagacagcgatactgatgacattgaccacagaggtgagaggtggctgaggtggcccgtggcaacagagcatctgcttatcctcacattgtttgcccaggagtttcttgctttaagcgtgtagccagtaatagtggataaaggatacagcaccagaaaagagtttcctatattgagagttcctgtcctgcctactggatggttaatactgagctgattacaggcctttcgttggtcttgtgtcttcttatctttaggtcctaacttggtttgagggatccaggacttttgtttgttgttattagtattttgttttaagaatatgtaagggctgggtgtggtggctcatgcctgtaatcccactgctttgggaggccaagtcaggaggattgcttgaggccaggagttctggacaagcctgggcaacatagttagtcccactctctacaaaaaagaaaaaaatagctgggc

SEQ ID NO: 93368 - DNA, 1004 bp, Homo sapiens
acacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacgtagtctcctggtgaccacctcagatctctattattaggctagatgtatagcctctactcccccagcttcttgctcttgaccctgcactgtaagttgcccttctattagcagccaaggaaaagggaaacatgagcttatccagaacggtggcagagtctccttggcaatcaaccaacgttgctatgaaatatgcctcacactgtatagctcattataggacgtcaggtttgttgaaaaaagtgggcaagacatgattaatgaatcagaatcctgtttcattggtgacttggataaagactttttaattttaactttgttctaagactgcttgtcatgatttcaaattagaaaattatataattgcaaacagcttcacttctcctgttcaacagaggcttaaggccagatgtccaaacttgtctcaataaggaggtgatattttactaaagtttcccacgtgcacatactgactaaatacagagctaggcccagtttgtattgtactctgaacttaatgcaaagtctccttggtgattttcgcaaagtccgtggatttgggtcagaggcacatttcatacataacagcccttataaacgtttgccctgcctccacattttacagtatcttaaaacagtacatttctttcaaagaattttatctctatgagtcagtactccaa

SEQ ID NO: 93369 - DNA, 1094 bp, Homo sapiens
caatcacagctcactacaagcgatccttccacctcagccttccaagtagctgagaccacagatgtgaaccaccatgcccagcttttttttttttttggtagagatggggtctcactagatactgcccaagctggtctcagactccgaggctcaagttgtcctcccaccttggcctcccaaagtactgggatgacaggtgtgaatgaccgtgcccagcctactgttaatttttatagccaaaaaaatgtaatcttttgtcccagttctaacacatttttttacctttatgtaacttttaattaatgacatacacattctctgccaaaccaattttctttacatatctctatcactcataaatgcaaactcagcaccttaaacaaatccctcccattggcagtgaatgttttaaaattctgttattcatgttctgttggcttttccatgggacgtcacaagctgactatccaacttgcttttaacatttccttggaaaattgactcttgcttgccaacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtaagacaaataaacttactcactttgattctgggagatctgccaatttcagtactttttgctttttggaatcaagctcaagaggtagaagaacaaaagcagcagtgggcagaatggaaagtcctaaaacgaatacagtttcacctatctagagatcccagcattcttctctttctaattagtgaagagaggattagcacagctttacaggcattctttaaaataatccctagttaagatgtagatgcaatgtgttgtcacgttgattaccaaggctgattcagctgatccagctggttgggaagatatccccttcctcctttagtattttattttta

SEQ ID NO: 93370 - DNA, 1054 bp, Homo sapiens
agttttaaaaagagtaagtctagcagcagtgtagagaatagatgacatacaaagagagattggaggaagggataccagttagaaggcagcagaaatctctcacgttctatatgtcaaaagttgaaagcataatgccatttagattaatggttcataaatttttccaccaggatcatgcctaagacacacagagtaagaaccacttcttattatctttaaccctactagtttttctcctattgatccagcacagatgtatcaagataccttatcatgccttgcttattgttcaggattgagcgtgatggtagttctggtaatgagttagtgagtgagatgggaaatagggatactagagctccagatgctgttgtagctattggtccactaatgacccaaattctaccctgtggttcagtgtagtaggaattgtcatagtatgacaataaccagcatctaacagttacatttctcttaatttatttagggagaacacctttggtcctacagttttgctgacactgacatttttctaagtggtcacaaatagcctactttttacataaataactggctagacctcgtatttttcactacagaagcctataatctaaagttgccaggatttaaacacattacttttaggttattgtctacatttatcctgagacctcttctcttcttattccaaaatgttgagatactggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcc

SEQ ID NO: 93371 - DNA, 1110 bp, Homo sapiens
attgtgggaaaatatacataacagaaaagtgtaccattttaagcattttaagagtatcactcagtggcattaagtacattcacaatattatggaaccatcaacactgttcattttggaacttttttatcattccatactgaaattggtatctgttaaacactaacttcattctccctccttcccagcctctggcaaccaccattctacttttctgtctctatgaatttgactactttaggtatctcacatgatgcagtaagtgtccttttatatatggcttatttcacttagtataatgtcttcaaggtttagccctttgtttttatacgtagtttggcagcttgtagaacctctctttcagtagttgatggtgacattttaagctccttgcctacttgccttctttctttttcttttcttttttaaaaacttatttattcatcattttatctacctctagtatctcggaaaaggaaagccaagaactgggaagatgaagacttttatgatagtgatgatgacacatttcttgataggactggcctgattgagaagaagcgtctgaacagaatgaagaaggctggcaagattgatgagaagccagagacctttgaatcattggcaagttttatttatggaagtagctgtggtatttaatagtttaatttttaataacataatgtattatttaaatatgttttatgataatttttaaagtagtagcattgaaatctgatactgaagtataacttttgtggtctgttaatttaatggtaacagacaactagtcttatccaagttgtttgaaaaaaatatggcttgctgctagatcctttccttcaggatattgatccattaattaacattctttggatatgatattacctctctcaaaaggaaaggaaaaagttccaagttagggcgttctgaggtgaaattgactttagccttctggcagtcaagagaagtcaaaggaattttgaagaatgtagtatggtaatatgtagtctgaaacagtatgttcttcaggaaattatcacaaggtgacgtgttaatgggtaggtaacagacaataataggcaggtaataggctacctattagactagaa

SEQ ID NO: 93372 - DNA, 1050 bp, Homo sapiens
tatctttgtcattactacactgggtatcctgcatactgtacccccatccccatgcacacttttttttttaagtgctcagagctattgcgcttaagtgggagctccagataagtaagacactcttcagaggttggtgggaagtagggctttacaccatggatcaatctcctgctgcttatatgttctcctttgccagtgacctttgtactgtagtcatttcatgggtgtgaagtcatgtagcatgtggcaaattacttgactaagggagcagcctcatcatagctctgtgtctgtgacagtcagcattgttcttgtccattcaaaatctgttggtctgaatacctctttcttattgttatatgcttagatattcattttgtggtaatttttattttgccagaggtttctttgtcagtatcatggtatttttagataaaaccttgggactccctggaatagatgtgtataattattctttcttcctaggactgaaactcagactacaggtgcagaaaacaaagctaaaaagcttacattgcctctatttggtgccatgaaaggaggaagcaaattcaaattaaaaactggaacagtaggggtaagttgtgagtcagggtgttaaacttttagcccttgagttatccctgagctaatttttctcttttcttttttgaaactacaaatgactcattccatagtaatgtgagaaagggctgtgggcttggtatgatcacatctttcccagaacttggttcttggattcttttttttttttttttttggagacagagtctcactctgtcaccaggctggagtgcagtggcgtgatctcggctgactgcaacttccgcctcccgggttcaagcaattctcctgcctcagcctctcgagtagctgggactacaggcgtgctccaccatgcccagctaatttttgtatttttagtaggatgggacttcaccatgttggccaggatggtctccatctcttgacctcgtgatccacctgccttggcctcccaaaatgctgggtttataggcatgagccatt

SEQ ID NO: 93373 - DNA, 1050 bp, Homo sapiens
attctttgagaaatgtcttcctccttttcttcaggatctgtttgatggatttacatgccttgtttccttgaaattacgctaagtctaaaatgaaaaagcagcacaaatgacttatttctgattgtctgatttattccttagaagattttgtaatcaattgaaatcctttaatatcatgagttataacagtccagaattcctgtagctggcactcatctgaaataactattttagttccttacaagctattttcaagtgttttgtatttagtaatctttgactctaggaactaataaagacacttgtttagggtctatagaggggtaaaatttcatgtcaaagtcccacctccagcagacttctgtggagttcatcaacctaaaaagagtaaacattcagtacatttagactgacctccttgaaaagatttttctcttgttgtcattaagtagaactacttgttcatggttttgtttccctcttagaagttaccccccaagcgtccagaactccctccaactctaatgagaatgaaagatgagcctgaagtagaagaggaggaggaagaggaagaggaagaagagaaagaaaaggaggagcatgaaaagaaaaaactggaggatggaagcctcagtaggccacagccagagatagagccagaagcagcagtgcaggaaatgaggcctcccacagatctcacacattttaaagaaacccaaacccatggtaatatctttcttctccttcctgtgttgttcagtgggcagttacattgattgtggataggttttaaaaagcaaggccagttcttgtctgtgcatttgactttgtatgtgatatactgactctgtagcaaggaaacatactttcttggtcttcttcctttgaccgccagtcattatttgtcttcattgcaaattaagggcagttatttccaatccattccagaattacagaaaattgaaggctatggaatctgaaaccatagctgctgtggaataatcctgagctgctgccactgtgtgagttggagggcagtggaacagggta

SEQ ID NO: 93374 - DNA, 1038 bp, Homo sapiens
atgtgcttgtctgaaaaagactttatttctctttcattcatgaaacttagttttgttggatacaaaattcttgactaatgtttattctgcttaaggaggctaacaataggaccccaatcccttctgcagttgtaaggtttctggagagaaattcttgtgaataaaacaatccatcttttctttttagcttccaccaacactttcttccaaatatcctgaagatgacccagactactgtgtgtgggtcccacctgaaggtagattgtttttacttttttttcctctaaggttcatttatttatatttttgaataggtaatatagatttaaggttcaacataagaaagttacaagagtatgtagtgataatttgtataccatgtttggatccttattcaaacaaacaactgtttaaaaaaattattagccagtcagataattttgaacactacctggatatttgatgatactaagaaattattttttatttttttaaagtgtgaatgatgttgagttatgttttttggaaaaagtccttgtcttctaggaatatatacggaagtgtttacaggtgtaatgttatctgggttttaccaagtcaaaagaaaggaaaacaattctggctgtgcctcagctactcggttgttttcctcacaagacaaccaattgttgttagtttcttatggatacttatatataaaatgctaagtagagaggagcatctatagaaaaaaaatcataaaagttaacctgctggatcaaaggtataaacattttaaagatattataaattgcattctatagagattgtaccagttttatgctcatacacacacccttaaagcaatgtatgagatacttacttcctcatatgttcatcacagcttgagatttctaatatattagtaactaatataatttagttacttgagatgtctgctttttctatgctaacaaatgttagggtagaaatgaaagagggctgtattttgaaatttcatacaaaaagtaaaatttctaccgtagaataaaccttttt

SEQ ID NO: 93375 - DNA, 1020 bp, Homo sapiens
gaagggcaggtcctagccccagcccttcctatccttgggtttttctgtcagagaagggataccttctagccacttttagttccaggaccttgctccagacaagctggatagtctaggaactgaccattttagcaagtttaatccagagggctggatttatgtcctacttggggcaaaaccaggcatgaactactccttcccatcaaggagcgctgcactccagcagctggctttaatttggattttccaggaccagctgcatttagctggggttggttgggtttcctcaggtctgcctttatcacgcacaccccgtcagaagttaatgcaaccacggcagggagtgaccacaagggggcagtatagacccattacaatgcggtcagcttgcacaaggggctgaaagaagataaaggtttcaaagcagaagaaagagtaagaatcagaaaaaaaggaggattgtgaaaaagttaggagcagcaagctagtttcgctcacagacattcctggacccaagacctggcagcagaaagttagccagagacaccggtcaggcccaaatggtgctcccaactctcctccaaaactgccttttccagtgcttaatttcacttagagaaagtcgctctccatttataatgccaatattctatggaggactttgggcattgcatatttattccttacacactatatttcagctttacagtttacagaggatttttttcacacttgttaaaaaaaaaaatccgaatcccctattagacttaaaaggtaaaaacagatgttaattacctctgtttaaagaaactgaggcactgggcagggtggctaacacctgtaatcccagcattttgggaggctggggcaggtggatcgcctgaggtcaggagttcgagaccagcctggccaatatggtgaaaccccgtctctacaaaaaatacaaaaattagccaggcatggtgacccctgcctgtagtcccagctactcaggctgaagcaggagaatcacttgaaccc

SEQ ID NO: 93376 - DNA, 1021 bp, Homo sapiens
ctttgaaggcaaggactgggtttttattccagtacctgaacagtgaatgaatgaatgaatgaatgagtgagtgtgagcataaagaaagcctgttacatgggagactcagtaggatttcactgaacctgtgaagtaagtaaggctagcaatcagaagcatgttgtgaggtcactggtctgtaggtgtgtgtgtgtgtgtgtgtgtgtatgtgtgtgtttgtgtgtgcagggaaggggcaaggctggaagaacgccgctgtgctggcacagccttcgtcagagccctgaaaggggctgagtgggctctgactcagctctatgactcattcactgtattgctgtctccatcctctgggcacatcctctggaccatttctgctcagcctcaagtggaggaggtgagatttgggccggtacctccggatgactcacctggctaagctggaaggaaggggccgaagccccaccatcctgcacccccttgtcactacccctgtctccctaggggttctcgtgcagacacagacttcacaagtaggttatggctgctccagtaatgaatgacgctctccatcccaacccaaagcattaccccccaatcacgcttcccggctcaaatgccacagtttccccagtcccctcacatggttgtcccctgtgcttcttgtgggcctctgaggtcagctgataaggaagtttacaaggctctcccagaccattggtcattttattcttcttcatctcttacaaacctttttcagtttacaaaatagttttacatcccctttctcatttgattctctcccagaccctaggaagcctggtaggaaggcgaatatccccattcttcagggatggacgttggagctccactaatcctttcactagtaaaggaaaggaagtgaagggcattgaggggacacggaatgttgggaagggcaggctgggcagggacagtggaacagtgggctgggggcatttagtgggacagtgggctggagaatagggacagcactggccag

SEQ ID NO: 93377 - DNA, 1009 bp, Homo sapiens
ttcagggctgcctaagtagatgaaggcatagcttgatttctctgaaaaaggaggactcattccacaggggttgatggtgagtctcctctgagccagctgtggtgctgagtgctgaggtgacggtaaagatgagtagtgcatggatgctcctgcccacggtgagtggatttaagaagagagcacctgatgctgccgagggattacaaaggaaagattcagtgaggcattgcaaaggaaagattcagtgagggattgcaaaggaagggttcagtgagggattgcaaaggaagggttcaccgagggattgcaaaggaagggttcagtgagggattgcaaaggaagggttcagtgagggattgcaaaggaagggttcaccaagtgattgcaaaaggattcactgagggattgcagaaggattcactgagggatttcaaagaaaggattcaccaagggattgcaaatgaaggattcagtgagggattgcaaaggaaggattcactgagggattgcaaaggaagggttcagtgagggatttcaaaggaaggattcagtgagggattgcaaaggaagggttcagtgagggattgcaaaggaaggattcagtgagggattgcaaaggaaggattcactgagggattgcaaaggaagggttcagtgagggattgcaaaggaagggttcactgagggattgcaaaggaagggttcagtgagggattgcaaaggaagggttcactgagggattgcaaaggaagggttcggtgagggattgcaaaggaagggttcagtgagggattgcaaaggaagggttcattgagggattgcaaaggaaggattcactgagggattgcaaaggaaggattcatagaccagaactttgacatgggatctgtccagcagaaaaggtagggtagggcatttttgcagagaatgtgatggacaaacacatgaaggcacagttaataatttaatatggacaaactaagggtggcatccctgtagcagacatggg

SEQ ID NO: 93378 - DNA, 1028 bp, Homo sapiens
agggtggggcccagcaatctgtttcaaccagccctgcaggtcattctatcctcaagttaacactggcctgtgccacagctgctccagtagctgtccacagccatgggagggcgctccaaggccgactttcaccactgggaacctgtcaggcacagcagaaggcaagaaaatgcatgaactgggaattaggcggcagagttctagtcctgccagttctgcaattattggttgagtgatttggagcacattatttaatgtttaacctccctgggcctcagttttctcatctgtaaaatgaggatgatgactaaatgttctcatctctaatttccctttaaattctgttattcagctctcctttggagtaatatgttgtctgtgccaaggatggaatgaaaacagagtatgatggctcatcttgactttttccttacttacaaatggagagccccaaagtccaaatccttggaccagctatcccccaacttcctccttaggggcagaaggtgagagcaagcaaacatttgagttgattcatgaaactttactgggcaaagaatagaaaatgttggtttggaccctccttcactatctggggcccctccacatgagctccttcaccgatccgtctccttcagctgcttccccactgtgactctaccagcccctctctatccccccttcaagcctgagcactttccctgcacccccacctggagttgcccaattcacatgctcttgtttattcactgctcttctgaggaagggtggggttggtgtcagggtgacttactaggtttgacaggggcttggtggcctcatggggagcccctcagacgctggcttcacatggcccctcctgctggcttcacatggacccaacggccctccctggagcccacctcacagtggatgggactgtacctactgggcactggtggggcccagcattcagctgacggctgaaaaaacctccggtctacattgggctaaaagggaggaagaatgtttcttgcccttttgagatg

SEQ ID NO: 93379 - DNA, 1776 bp, Homo sapiens
tggtttctgtagaggtatattctgactctcgttctttctacccttgtgacatatttcatatatgtcttgcctgattgacctcatgtaccaactcaccttccatacagtactgttagctcctagaggacatagacatagacttgtagagctttgtatttcccagagtgccttccacagagtaagtgcttaatatttgttgaatctgtgttgaataattattgtctatcttaattacaaacaaatactgtatgcctcttatgaggcactgtgctgaatgttgaaagcaatgcagtggtgtgtaatatagtcttagatgcttccaggttgttttggaattacatgagaaataaaataacatggtctacatggggagacaagacacatgaaaaaataacaaacagtacaggtattaaaagatctggtgaggcaaacatggactttctgctttggatgagtggaacttaaatgaaatatgaaggggcacaaggttttgcgcattagcaaactaaaagctttagtctctttattttgtcccttcctgaatataatcatttatgccctggaagagagggctgttctgagacagcgatctttacaatttcctcactagccagctgtggttaccagtattttgatattttccccttcctgacttctgctcctcgtgaagggtggatgtctgaggctagtcccgcaatgtggcttgattgttcttattgttttggttaggtcattgcgaagtaactctgtgtagtggagcaaatcctagagatttgaaaccattgaaactgtttcatggaaaacttaggctgtcttacaactgaaccttttagggccaagtgatatctcacaactaatattaccctacagagttctcaaaatgtgccatccccctgtgactgattttagtttatttcgtcagctcgtacataacagcgtactttttaatcttagaaacattctggtgagaatggtgagcgaagctgggacaggtttctgcttcaacaccaagagaaaccgactgcgggaaaaactgactcttttgcattatgatccagttggtaagatctggggaggttaatgcttccaaggcctgttgccccctttgtaggctgaacatctgaactctctggaggtgtttttttagcctctgacactagcattcatttagtaaataggtattgaatgattgttatgatgctatttaacatcccaggtgctgggatacaccaggacacaagacaagtccctgtactcttggcacttagtctagtctgagagggggagaaaagatgacaaattataagtgctgtgagagaaacaatcaggatgctgaggtgtaggatgaagttggagagtggtagggaaagtcacattagatggctaaatcagggaaggtctctccaggaggagatagttaaccgagacctgaaggtgagaaaccagctatgtaaagagaataggtggtagtgttctggaaacagacaagtgtcttaagaaggggacggtatggtgtcctggcatcatctgttcgacagtggctagtatttggttcctgatagaagttaaaggaatatggtttctatatattagtgcagtgggggtaggaaatttgatttttccattttgtgccatccactaaaatgctgtactatatggtaactttaaatggtctcattagatggaagtatttatctagaagagacaagtgttcctaaggccatattatctgctcacaaacaaaaatagagtcagcacctgattgctgttggtgga

SEQ ID NO: 93380 - DNA, 1042 bp, Homo sapiens
actctacattgcctagcacagttctatggacttaaatattttattctttgagttaaaggaataggtgcagtgaatgaatcaaagaattctactcaatatagccttgctctactaaccttaatcagttactcctagtcagggtcatttaaatagtctccagattgcttttcagtgagacaacccccctaccccccgcctttttttaaaccaagtttttagttccctgtagaaaaccatgggggaaatatttcttgtcgtaatatagatgagaaactgttttggttctttactaccatcttgtaatgcattaatgcattgtagtcctccttggagttttaggaggatcaatcctacttacatttcacatgatttgaagtatgttaaaaagatcccttatgtacagtgtattaatatcatagataaattctgttgacaggttaatgattcttaaattcagctgcccatcaattgagtagttttaaaaaatgtagacttcagtccaactctagccctactaaaccagaattaaggtaggagtggaggtgagaatggacttacttagataagctcattcttagtcgtagatagcttgggaatctcatatgcagagtatccatattgactgtagaagaaaaaagctaaaatgtctgtatgatagggacaagtgaggaattgttaggtcatagttgtttaagttcctggatcttccttgggtgattattccatttctggtgttttcttgtttttgttttagcaaagaggaaataggtaggggtgtgtgtgtgtgtgggtgtgtgggtgtgtgtgtgagagagatggaagttaatcgagtgccataaggcattatagaaatatgaaagccttactgctcagcatctagtcttcaatcttttctttttttttttttgagacggagtttcactcttgttgcccaggctggagtgcaatggtgcgatctcggctcactgcaacctctgcctcccgggttcaagtgattctcctgcgccagcctcccgcgtagctgggattacaggcatgcacc

SEQ ID NO: 93381 - DNA, 1128 bp, Homo sapiens
gatacttaataattttctgccacaatttttttttctccctccatagtgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaatagcctgtgctattgtgtcttagtgatgtttttccccactatttgatgttttaaaaatcaaccacattactaaaaaataaccattgttccatgtaataaatgtttccataacaacacttatgtaagagtttccagcctgctccctctgtactcagagaaaaggcagagtaacattccagagtgatcttgaagaaactcccatgtaataacagagatggcaagggggaccaggaatgacaaaaagaggagccttgtaacacaaaccaagagaacctctatttctgatttgtgcttatataattaggaaaaatgccacaggcctatattttcaaacccagatcaccaaagcagtatctaggattttctgggacagctttggattcctttattccctagatttttctttccttttaaaataaaagaaggtatagtgtttcaataaagccactgctaagacttctggggcatggtggtaccacacagctaactagcatggaattctgggagcaatccctaatgttcagatacggacctctctcctgcccagagccatacactttctcactcaggctgttgtttcccacaagttttgaaaattgtccagttttctcctttgtcaagttcccggttgaaaaggatctgctcattttaagatctgttggttcacatcctaccccatttaaagcatttgtgtgggagaatgatacagtgcccaccctgactacaaaataagaagttccttctccatggcccaaacctggctctgagggaaatgtaagagca

SEQ ID NO: 93382 - DNA, 1034 bp, Homo sapiens
tggcatcaacttcttaacatggcacacgaggttccctaaaccacttttccagtttcatctcttacttcctcctattcacttaaggaacttacttcttcctattcacttacgggtctcagtacatggagacacctcggcttggacttttccctagactaactcctatactcatttttggagactcagcttgggtattaacttggccatcacatatttattgcctagcactatgttcaaagcactgtgctgtcccggaaaccaccagtctcaggccctctggctgccccctgccctccccttgagggtagcacgcctgtcttcatcacctccctgtcctgagacctagtgcaaggcctggaccatagctgaggtaggcactgaccgaaccaagaactgtcaggaggatgggtgctgagcgatgaggtgaggagcacacactgtcccaggaacgccctgtaggaggatgacaatggaacagatgcatgaaagttctggtttgccaaattccagttgatagaaaaggggacaagttggaggaaatgatgggtatgaagtgtagctgggaaaaacccccaagtgatgaaagtctccaaggtaagatcttgtcaggcagctctaacagattccagacaatcttgcaagaatgacgtcactaccaagcttcacttgttaggaatccgtacccacgctgaatgagtcactacccaaactgccgagggaccctaacagttacagcgcgtgcattcctccccgatgtcttcatgcattccatctcacaagtagatgccactttcttctcttttcaaaacctctccctacacaaagctattcagagcctacactgtggacatgaattcctcagccatgcttgtggttttagaagccagggaaaagcaaatgggatgaaacatgactaaatcataagtcaatgcattatttcttaaaaaagaatattgccaggggttcaggaaagggagagagggcaaatgtaaaccaccagggtctctgttacctcccaccaccatactggggcc

SEQ ID NO: 93383 - DNA, 1049 bp, Homo sapiens
gacaaagaatgacttttacgttcccaggcccagtcagctagatactcacgcctcagcctcctgcaggcaagaacaaggcagaagccccatttttagaacttggaagagagcgcagagcaagcctggcccctgggccagcctaagtatgagccatctcagcagctggcgcagccctccttgaaacactctcccttgaagaaattctgacctaaacccagtgtagccagcaaggctgaccctgttggtggaatctggtggccccagtatggtggtgggaggtaacagagaccctggtggtttacatttgccctctctccctttcctgaacccctggcaatattcttttttaagaaataatgcattgacttatgatttagtcatgtttcatcccatttgcttttccctggcttctaaaaccacaagcatggctgaggaattcatgtccacagtgtaggctctgaatagctttgtgtagggagaggttttgaaaagagaagaaagtggcatctacttgtgagatggaatgcatgaagacatcggggaggaatgcacgcgctgtaactgttagggtccctcggcagtttgggtagtgactcattcagcgtgggtacggattcctaacaagtgaagcttggtagtgacgtcattcttgcaagattgtctggaatctgttagagctgcctgacaagatcttaccttggagactttcatcacttgggggtttttcccagctacacttcatacccatcatttcctccaacttgtccccttttctatcaactggaatttggcaaaccagaactttcatgcatctgttccattgtcatcctcctacagggcgttcctgggacagtgtgtgctcctcacctcatcgctcagcacccatcctcctgacagttcttggttcggtcagtgcctacctcagctatggtccaggccttgcactaggtctcaggacagggaggtgatgaagacaggcgtgctaccctcaaggggagggcagggggcagccagagggcctgagactggtggtttccgggacagcacag

SEQ ID NO: 93384 - DNA, 1024 bp, Homo sapiens
gaagagacacatctgtcatgtcttccaaactgagctgaggacatctgcagctactgccaccatctcactctagtacaacgggaaaaacagatgtaaaaatagaagtgatatattcaactattaacagtgaggcaaaactgaatatagcagtctgcagaagcactgacgtagaacgggaaatggcttcttctaggcaggctgtctgccttgagtggacaacatgccaactaaagatgtttccagcacccatgtcatccctgactttttaataagggattaggaggaagagaaaagcgagaaggttacaaaccgactgagagcaagtaataccctcctgacagaaaagtgaaggagcccatttgttcagaagaaaatgcctccctgggagctcctcactcgccacgtgaattaccttctctttatcagatttatgaagaggctgcacagctgtgtgcagaacaggtaagaattttaataatgaaagtgctggatgagaggacgaagacagcataaaaaagatgaggaagattctagacccagaaaatcactaccctggttcctgtcagtgtcactgctgctccacctgggggatgctgagagtccattcacgcatattcagcagggcaattcagtggagagtctttatcacgaatatccattcataagtgaattgcttaggtggagcttttttgttgttgtttgaaatataattcatgcatcataaaattcactctttaaaggggtatgctttagtgttctttagtattacccacaagcttgtccgaccattaccactgattccagaacattttcatcaccccaaagaggaactccatactcattagtagtcactctccatccccttccagcaaccatcagttgacttcctgtctctatggatttataatacctattctggatatttcatagaaataaaatcataatatatgacctcttatgcctggcttcttttacttagtagtatgttttcaaggtgcatccatgtcatagcatgaatcagtac

SEQ ID NO: 93385 - DNA, 1055 bp, Homo sapiens
aacattagaatggaatgaaaaattagtatattgaaagagaaattgggagaaaaatatggatcttgttgaaagccccctgattttacagattgtaattggtgtggggaaggtcacagactgaatgagtaggagaggcctcctgaatgccagggcattgcgttttctgctacctgtcattacctctcctaatctgcttccatcttctctggcaaaaacaaacaaaagaaataagtagtctgcaaacatggaaagcaaaaactggaaatttgagaagaggcattatggcccaagagaggcttggaagaattatgtccttaggtgccaaacttacaggtgcaatttatgctaaaattcttggcagtggccctttcctttctcctttcctgcctcccctccaaccttcctttttcttttttttttggtagacttctctttgttgccccaactctttgttaaaattattatatgtgcagaaaagctgaatgaacactctacatttcacctaaacatttgctaacattttgctgtatttgcttttcctcttccctgtatgtatttagttttgtttttgttgaaaagtaagtggaaaaaaaagtattttgttgttgagaataagttgcagacaacatgatgcctcaccccaaatacttcggcatacatctcctaagaggaaacacaataccattatcacacctaggaagattgtcagtaattccatgctatcatctaatatccaagccacattcaaatttccccagttgtccccagaatgtctttcattgatggtttttgtcatcactgttattgctttatttattttcctgtaccagtatctatcaaggttcccattgcattggttgttataaaaaagaagggagacattttctagaaaaacgcatctggaagtggattcaggttacttattttcaccactgtttctgttgacttttgtgtattctaggctgagattttaactggcctcacggtgggcagcgctgcagatgctggggaggctgcattagtgctcttgaaaaggggctgccaggtggtaatca

SEQ ID NO: 93386 - DNA, 1008 bp, Homo sapiens
ggggtaggggcagcctagattccaggtggtagagttgttcctttcaagggcatccacttttgccatttcccatctctctccacttaggtgcacctggaatcactgggccagggccccaggccccagtctggcagccagatgtaccaatagaagcctagtctctgcagaaactcttctctaagagttagatccatcacacacttgaaccctaccttggttgggctggttccaggtgggattaagttgagccagcattcaggctagtggctagggtatgtcaaagtttccccttcttccactggtaggtctcattatctattgtgtccacctcctccatgaagttcttgtacatcttgtcatagaggatgcacaccatattttcctcttcactaggctccagcaactgggccagcagcttgtgcccagctgggtctggagcagcttgtgcccaactgggtccacattgctcagctgggtccgccattgcttcccaggtgacagggagctcgtggtctctgtgaaagatctctggtgatggtcatatcagtgtctctgtgggtagtacttttcacacatgtccaccatgatgtcacatgaagctgatttttcaaggtcctcggtctgcaccctctctgcatcccgtagtctggcaggaggcaaagcaatgtgcatgtcattgtcttgtcacagtgaatggtgcccttgtgtgtctccattcatgatggtgccatgaggttgctgtgggatcatttgggtaacaggatggactctgagacaaccatgcagtgctgggtttggaggggtgttagcagtggtggcagcagcagtaaaagcagaaatgttgtattcttgattctctttctgctttctccttgttagactgttttgccttttgccatctacacaccttgctgttgtttgaccaagctaaagacttgggtataagaatactgagttaacgttctttagtggtaagataaaaaactaagacacttctttggaatagta

SEQ ID NO: 93387 - DNA, 1051 bp, Homo sapiens
tagtatttatcatgtttttgcatcataaaagtatcttttggaattgtcattggcaggtttttataaatatgtttattatatctatctttgtatgtatttacttaagaaattaaaagagtatgtaagtcagaaaaggattctgagaaccaatatagttcaaatggaagattggaattataggtagattggcaggaattcaggacgcgagagaccattactttagatgatctctttagaaggcctgggatttaaaactgagccatactacctttagaagttccaaaggatagactgccacagattatgccagcagtcatgttgcaagattggatgaccccttcaaactggcttgtcaaatttattaatatcttcttgcaaggaatgaatccaagaatatgttggagctacatctggatggaaatgaaatagtgttacaggttctgagcagtcagacagataacctgatgataaattttgggcagtgaactatattgatgttgctgtcaacttagtagagatatcaaaagaacacttggaaagaaataaattaatgtttgttactgttgtgggaaaaccaagatgaatagggagattagaagacatcaaagtaaagcagcttatcttcatatccaaggaccttcagcatctaaagattcttcagaaaagtgtttttcaaactctttgatggaagaacagattaaaaaaaatgtagctggtcaccagctgatacttttgtaaaatataaaaatgaattgctagaagagtgaaatgaaaaagacatgaaatacaaggcttgactcttttattagtagattcatcagatttattcttacacattgctgtaaaagttttaaaattcttatctcattttctgtacttttcttattatggattagtaataatttacagaccagaactggtccatggacctgctctctttgaatagcacgattctagaaagatttctgcattctaacagtccaggagttggccttcttaagaattctatctcagaggggcaacagtagtatgttattgataagtaattcct

SEQ ID NO: 93388 - DNA, 1051 bp, Homo sapiens
ccaaacttttttttttttttttttttttgtgacagaggcttgctctgttgccaggctggagtgcagtggcacgatctcggctcactgcaacttccgcctcctgggttcaagcgattttcctgcctcagcctcccaagtggctggggctacaggcacgtgccaccacgcgcagctaatttttgtatttttagtagagatggggtttcaccacgttggccaggatggtcttgatctcttgacctcatgatttgcccgcctcatcctcccaaaatggtggaattataggcgtgagccaccacgcccggcccaaagtgtttttttaaattatgcaccctgtcttagtcagtttgggttgccataacaaaataccttagacttggtaatttataaacagcagaagtttattgctcacagttctgatggctagaaagtccaggatcatggctctggtagattgtgtctggtgagggcccgttcctcatagatgatgccttctctgtgtccttgcatggcagaagggaaaaggggcagacgagctccctcaggcctcttttataaggacgctaatcctatttatgaggcctccgttttatgacctagtcagctctcaaaggccctacctcttaataccaacacattggggattagattccaataagaattttgaggggccactaacattcagtctatagcacaccccaaattattttattgtgtacctctgctacatgcatatttacttataaaaatatatttatagattataaaacatacataaaatataagctaaaaatgatataaagataaaattaacaacactgtaaaaataatttatattacttatattgtggtattttcacctgccatacctgaaaaagaaatctgaaaaaatatgtagatactaatggaagaaatgcttttgtcgtaaattaagtgtccagaaatgtgagggtctgtctctgaactctttattctgttttactggtttgtctatttttgtaccaacatgagtattttaattactaacatttatagtaaattttgaaatcca

SEQ ID NO: 93389 - DNA, 1081 bp, Homo sapiens
attctattcctctttctacccttctgttttcctttagcccatccgataattttttattactacagtcacaattaggtatcttaatttctaggaactctttcttgcactgtttctcattctcagcatcttgttcttattttatgaatataggtcctttaaattccttcaaagaataaaatttagagattcaaaaaaaatgttttcttctgttatctgaattattttaattttccctagggattatatttttgtttatcatattttttccctcttttatgctatagtttttcttcaaataaaaggtattcatttctgtttaagatagacaataaaatagtgattgggacttctgagtaggtgagcaaggcttatggaatgtgtggatgaatgatgggccagatgtgagtcaactgctctagctctcctcaaatagtttgttctatttcttcattgaatacctgggcatacatacctgatcaccctgtcattttcagggggtacgtatatagactattccgtgaggagcttttgcttactcttcctgttcttagccctgtgtctcattcttgcctccccttacactggataactagaaacttttatgggtttactaggacagatggcttcctcctcatcagtagcctcttcctcacattattacaggtcaaagctttcctctgccctatcttgtcaagtactacacttccatctgcattctgtctctagcaatttgctaaactttctcatctactgattaactactctcctcccttcctcttcatcttcctgttgtttgggattttatctttctgtattcactatcatttaacgggattggagggggtcttagagaagaaatgagtgtgtgtggtcagtccacagtcttgagacaaaaataatgtgacttcacaggcatctttctagtagcatgggtttatgttaggaagcatttgctgttaccctatatcctctcattactataagctcttcatgggaaacctttaataacatttgtgattagtgtattaggactgtcactcatcatataacataattatattctagcaaattattgttggat

SEQ ID NO: 93390 - DNA, 1033 bp, Homo sapiens
ctcctgagtagctgggactacaggcactggccaccatgcccagctaatttttgtatttttagtagagacagggtttcaccatgttggctaggatggtctcgatgtcttgacctagtgatccgcccacctcggcctcccaaagtgctaggattacaggcatgagccaccgcgcttggccagtttaaactatagttctaaccaacgctgaatcaaagtattcagtaatttactagaacttacagtaattttatttcataacttaagctcaataaagttagagatggagactgttgtgtttattaaattaaatctttagtctctagcacagtaaagatattcaattaaatatttgttgaagaaatagaatgaatgcatgcatgcataaattaatgaatctttagtgttcagattttcgttggttgaagtatgtgttataaagaatgtggcattctgttgtatcagccttttgccaacagaaatttgatctttagaagttatttattatacaaggaatttgtaattggaacattgctcttaacaattcagaaaacaggaagaatgtacagtcatttgcagatttggagtctgaatcaattttatctttatatattttactctgccctctgcaagcagattaatgaaaatagcatgtaactaaacttatttttcaaaatattttatgtattggaaaatagtacttctgtaaatctgtttcattgtaagtaaaggaaactgcagttaatgagaatgagaatgagagatgagagagggcgtatttctactcactaattgattcttacagaattatccccattcaaagttaaataattgaaataaaaaagatcagaagattatagtacattaggaatgatattattgtttcctcaggtcttttactgtgaagagacaattgttggccagtaaaagagttgccaatttgtataagattctattgaaaaatgttaaaggatatcctaagtaaagagaagtccttgaatctcacaattgcagaagacacaactcctcctgcaac

SEQ ID NO: 93391 - DNA, 1048 bp, Homo sapiens
atacacgttaaggtctaggatggtgcaactgaagtggctgaaaattttccagctatagcagctattcacataaaaagagccatgagtgtcatataaacacctgtttgtaaatatagccatcctagtcatactctgtagcaattaactctagaagaaattattccatttgtgtttttgtgtactgtatttaaatagggcaaagagtgagcctgtttgctcatactttattcccaatctctagttgagtatctggcatttagagaggtttaataaatgtttgtggaaagaatgagccgtgttcattctttggatctgacaacaatgaggtttgataggaagtgacagaacttaattctgccagttctttgaataatgctgtttatgcagctttgaagagagattattgaaatattgtaagttatattgagcaagtctgtggctagtaaatcaaacagtttgctaacattggttttacatttgaaattatctgtggtttaaacaatttattttaatcaggggctgttttattataagaaacccactggaactaacataaattgaagaatttatttgtctttgtaaggaatcaagtaaagcctatgatgcccaagggcagaaaggacagccaggttctcagggactagaaccgggaactggaaggctggtagacatagtcgccagtcagcatctgtgtccatgtttgtgtctttctcctgcaacatattctattgtcactgtattctaaccgcccctccaccccaaccaacccccgacttctgtttctccccacattgggtagaaatgacttcctgagcccctacatgaggactcaattcaaggccaccagagaggttgtcattgagtttaaattcctgggagagaggatctgattggcagcttgggccaagtgaccacttgtgatcaagttatatggccaggatttctgggtcatgtattatcaacctgattagtagaggttagttttaacacaagataagataagcatagcctggcagatacccagaaaggtatctattaccctgtttca

SEQ ID NO: 93392 - DNA, 1052 bp, Homo sapiens
ttttggctttagcaggacaaaccaaggaataataaaatagcctgtcttgtgatgtatttggtttttcattcgcgctcacaaacctgccactctaatggaagtgctctctatttaggaggctccctagaccagttctcttctagtctgcaagaatgcttgcaaggagagtaggagttaaccatttttactatgacttgcaacagttgagctaagtaaaaagttggatgctgtctagggacttagtattttgcatcatgctgagaggcataattttacttttatttttgtcttttaaaaagattcatttacttaaagattgttattatctagcatttaaggtatttttagaggctaattgtggaggcaggtcacctttgatttagtgaatgttctacaaaatgctcattgaaaggcaagtaaagagtgctaattttctggattagacattctctctccttagatattcaggattcctttgtcttggagttttagaatattttattttcttggaattcatgggttagaagaaatatattaggaatagcaactaatattattaatttaaatttataaagtcagtttaattatagctatgtattatatataatctgtctttggtactgattatagtttattaaaaatgactgatatgattactaaattaacttattgggcattttatggttaggcttatttacatgcattattttattttatcgacacaataactcttaggtcagaatttatatcccactctttaatatcaattttattgaggtagtgtaatttacatataataaaatgtacccactttaagtgtacagttctgtgtgttttggcaattgtaaacacttaaaaccacaccatagtcaagataaagaacatttccattccctaaaggtatagaacatttccttacccacacaaatcggtcccctccaccaccttcctcttaaccctgagccttttcatttctctaaaactgaaacagttttgcctgtttagaattttatataaatggaataatatattatgtagtttttggtatatgg

SEQ ID NO: 93393 - DNA, 1035 bp, Homo sapiens
cagcccaagggctgatttcctgtcagttcctgtgtggtttgcactacatcctctttgcaacagatcagtattttaggtcatccatcataactgctctcctgtaagttcttggcaatttgatctcagtttgcagaaggcagctggcatactttgctaggaagtgcagctggagagctcctgtctcactcttcctaaggccaggaagcacactattgttactcattgctgctttcttcctttaaagaacaaaaaacttcaaactttggcaaattctaaagttactaggtagcaatttgaaattactctgatcgttttgttggtctagggcaaaaacttgagtgatcttttatatcatttgtaaatcttgtctggtttttccataacacagatatgtgcattagtggaagtttcctccccattgcaaatgaagttatgcttgtcttcagagtcacacgggaatttttagttttattttgttttaggctttgattgtcaaggacagtaacatggcctaatttcttctctgtgttttattcccttaacattgagatttttctattcctaatatcagcattgggtaagactatttaccttgggtatgacttgaatatttgcactggattttcaaactatacgaacagagatagttaaagcactttttttggactatttaatgttaaaataaaagtatcgttttagtgtttctgatttctcattccataatgggtgacctatgttgtgagatttagaaaaatgagcaattttcctcctttcttatgactcacaggtcacattttggcaacatgttttttttttcctgtagaatggtgattacctttaccccagttcacctaagagaggaacctgtttataaagaggatacaacctcatgcatgaattattttaaatggtattcttaataatctatgatggcacagatcttttatacttctgagttgtcttcttttcatctttacgaaaaccatatcttctgtagagttaaacaagattattaatgtagctcttggtttcttt

SEQ ID NO: 93394 - DNA, 1052 bp, Homo sapiens
gccaacagaatatgatgcttattatgccgtatgactttcaaggctgggtcataaaaggcaatgaggctttcatcttactctagcaggaatacttttgcttggagccctgcaccactgcataagaagtctgtctatattgaggttgccatgctgtcaggtagccaaactacatgaagaggccacatgtaggtgctgcagttgtcagtttttatcttggaggtttcccagcccaggcatcagaaatgtcagtgaaattgtgttcggcctttcaaactgagcactaccagctgaacaccattgagtgatctcagtcaatgctgtgaggagcagaagaatcacccaactacattctgcctatatttctaacccacagaatctatgagcataagaaaatggttgttttaagcactgagtttggggtagttttgtaggtggcagtagtaattggaatgtagaccctgaagaataggagtggacaagagcctgtaggagggtggaagagatggggagaagagcagagatatagaggttaagtctccagagggagaaggaaaagacaaaaggattaggaaagaaatgggtgaatattgaggagaaagggtgaggaattcacaactgatgacagtaaacagcatttagttttttcaagaattccactggctgctttatatattttatatatatacatataaatgtttataaatgtatatatataacatatatacatatacatatatgcataaacttatatatgtttatatatacacacacatatatatgtatatatgtatatttagtttttttttaatttttattttttatgaagttgaagtagagctcacctgccaagaggtagaaggtctacaaaggcctggctgcttggtggaaagtattgaagatggtatagatgactgacctttagcttcttgcctaacaaatactcttgtgaggaaagacagacagaggcttggcattttgtcattaagtgtgagtggtctgccttccttgggagaatttgcacacagtatacactatcagtgtgaagtactttg

SEQ ID NO: 93395 - DNA, 1051 bp, Homo sapiens
gaaaaaattgggttttcattttcaaatgtacttaaaatgtatttagaaatgaagttatcaaaagattttaactgtagcttttgatttaaataagtacccagttttattttatgaaacagaagggatcagaaagaaatttgatatggtcaaaagcaaatttaattaaaatagaatattagctcttcaagctactattttgctatagtacctcttaagaaacatgggtttgtcagaatttatgtcatcttaataattaactgaactgaaagaactgcatatgtttttagagctaaagaccatttgatgtcatctaatttactacctattgtagcaattgctttagtagtgttcttggtaaatgcatatgtagctactatcattaaaaagaatattatccacgagacaacattacagtgctcattcaaaaaatatttttgtcgtaggaacaaaacaactttattttcttatttgcattgacagttttatggtactgaaaggagctctcagcagaattcttatttgaactaattaaccataccaaaattccttttatagtgttgatctttttgacaagtggaattactagaattaccacagtaatcatctggttgaagaaattgtggataatggcagcagactatagatgaaggaaatcgttgtcccaatatttaaagaaaagaaggagaggccaggcaaggtggctcacgcctgcaatcccagcactttgggaggctgaagcgggtggatcacctgaagtcaggagttcgagaccagcctggccaacatggcaaaaccccgtgtctactaaaaatacagaaattacctgggcttgttggcgcatgcttgtaatcccagctactccagaggctgagggaggagaattgcttgaacctgggaggcagaggttgcggtgagctgagattgcaccactgcattccagcctgggtgacagagaaagactctttctcaaaaaaaaaaaaaaaaaaaaaaaagaaaaagaaaagaaggaaggatatattcttaaaggattcagtaaattgtctgagagcat

SEQ ID NO: 93396 - DNA, 1029 bp, Homo sapiens
ggcatgactggttttgaaatgtgaggacatgagatttgggaggggtcaggggtggaatgatatggcttgtctgtgttcccacccaaatctcatcttgaattcccacatgttgtgggaggtacacagtgggaggtaattgaattgtgggggtagatctttcccatgctgttctcgtgatagtgagtaagtctcatgagatctgatggttctataagggggagtttccctgcacaagctctctgtttgcctgctgccatccatgtaagatgtgacttgcttctccttgccttctgccatgattgtgaggcttccccagccacatgaaactgtgagttctccattaaacctctttgctttgtatattgcccaatcttgggtatgtctttatcagcagcatgaaaacggactaatataggaggtgatctctggaagcacagtgagggggtggggaagagaaagagagggagaaaagccaaaatagggtgcattgaagagtaggttattgctgttgttaagtggggttaaatttcactcacaaccccccagctatgtgaaagtcacttcagtattgtgccagggaagggcaaggaagttgtttacacatccaccctcatccttcattcttagtgtcattcacttccaagtagtccagcctttttatatactggccaagctaccttctaggccaggtaatgcccttatgcagacagatgcagttactggagctggatggccacgatttctggcagtggttctttctcaaactgaggttggggctcgggacgggggaggaggttattttgctctgcaaggagcatttggtaaattctgtggacatttttggtagtgacaactgggggagggaaaaagtgctactggctggcatctagtgggtagagaccagggatgctgcttaatataccgcagttgatatggttgccccctacagcaaagagttatccatccccaaatgtcagtagtcccatggcttagaaactctgttttacaggaattcagagctgcaggtga

SEQ ID NO: 93397 - DNA, 1084 bp, Homo sapiens
tctcactacgatatttcattaaaagaaaaataaatgtaaatacatagtgttctaggagctacacctaaatcaagggtgtgtgaatgtgtatatgggtatgtaaaaatcaagcttacttgctaaattttcccatgtgtttttttttttcaatgttttactatttcatgacaaggatcattactgatttgttttaaaattatatttaattctgaactactttttaaaactacaacaatcatagaaaggttgaaaaagcttactttcttttttatagtgtcacttgcattgtagttattaaagagttgataacaaattgcagtaatgaaacagtttgtgaatatgcattagaagatcactaagactaaaattttctgcagtagaatatttattgctcaataaagtaatgctaatttatagcatttggcttaaaatattgttgttttatgcaccgaaataagtataacaaaaatacaaggttaaaagttcatttaaaacatattacatctgaagatggacaatacccctttctgaattagtctaattttctaagaatcaacaacatgtatattatctctgatacacataagaatcacgtagcttaatttcctgaaaattgtcttattattaaccactgaaagaactaggcatatttaacctggagaagagaagattaaaagaagacctgacagtcatctgcagatggtttggggactatcgtgtagaataatgcttagggtagaactagtgttagtgggtaaaagtgatttgtagctatattttctgtttcaatataagaaagaacttttttcaacgggtaataactgccaaggaacagagtgtggtatctaatgaggcagggaggacattttacatggagatagtcatggaaaattaagtgacctttcttaccttcccttcattccctttgtttccttctttcctaatcagtgtttcctgtagatctgtgctgtccaatatagtcgctgctagccacatgtggtgatggagtctttgaaatgtggctagtctgaattgagatgtgctgttaagtgtgaaatacacatcagatgctaaagtttatatt

SEQ ID NO: 93398 - DNA, 1018 bp, Homo sapiens
gtgctgagattacaggtgtgagccactgcgcctggcctatgtacattttctttatcagattcactcttgatgggcatctaggatgattccaagtctttgctattgtgaatagtgctgcaatgaacatatgagtatatgtgtttttttcatagaatgatttatattcttttgggtatatacacagtaatgggattgcagggttgaatggtagctctattttaagttctttgagaaatctccaaactgctttccacagtggctgaactagtttatgttcccaccaacagtgtgtaagcatttccttttctgtgcagcctcaccagcattttgttattttttgactttttagtaatagccattctgactgatgttagatggtatctcgtggttttgatgtgtatttctctaatgattagtgattgtattagttgtattagtattgaattgtttcttagaaactatgttttcctggcagttattgaaactgatagacaaaatagtatgataatatttcactggtgaggaataaggcaagtatcctgtggacaggctgtgttccttctgtaattagggagtaggagatatggtccactctgcatatctggtaagtgagccttcctgagatggtgctgataccttctaaaaattgtcagctgctaaggcacaagcgtgtaaataaaatctactttgtatttaacatttctgtgatttcatgtatgtgtcatattataaagcactgttgatgtgcattttgaaaggaaggaacttctgcccccattgctcccactgttatagcctggcaagtttcagggagtaatgaaaaataagacttgaaactcttattttgttgttaggtggttgtaacacttcttccttttttttaaacctcgccttatagcacctctgatcctgcttttatttctttgttctcctgcatactcttccattttatgaaaagttggagtaagcagtgtccaggtaatctgtactctgtgttcatatcatctgctccagggtg

SEQ ID NO: 93399 - DNA, 1833 bp, Homo sapiens
catataaatggaatcatataatatgttgtcctttgttactgatctctttgacttagcgtattgttttcaatgaagcatgtattactgttttattttcttattgccaaatacgattacatcgtgtgcatatactgcattttatttatccattcatcagttgatagacttacaggttgttgccgtattttagctattgtaactactgttgtgtggatatttttatttctcttggatatatttctaggaatggaattgcagggtcaaatggtaactctatgtttaactttttgaggaaataccaaactgttttcaaaagtggctgtggcattttacattcttaccagaagtgtatgagtgtttcagtttctccacattctcagcaacacttgctattatgtcttttttattatagccatcctagtgggtatgaagtggtatctcatacccacaaatgaagtggtatcgcactgtagttttgatttgtgctttttttgatggctggtgatactgagcatcttttcatgtgcctattggctatttgtatatatcctttggagaaatgtctattcagatcctttgcccatttaaaaattggattgtcttttattgttcagttgtaagagttctttattctgagcataaaaataaacaaaagacaaagagtcacatccattagtatttattgcttgtatactgtgcattgaacactgttcaatatggaacttgacctcaagaagtctaaattttatggaggtggctgggtgcagtggctcatgacttgtaatcctagtaccctgtctctcaatcaatccatcaataaattttagggaggtaagacgtagatatctaaaagcaaatacaggtagtatataattaaaatgttggaataattgaaacaaaagcaatgctatggggtagttaaatactgtttttcacgtacaatatgtgatgtgagaagagaggatgttcaataaattaagatggagtctccattgtaataaaaaaggaaaattattgtaggttggaattttgggattaaaataatctagaagaagttaagtgatgggtaggttatgctatagctgtcacccaattgcttctttaacttgaacttcttctcttttgctcttttgctccttgctcagccctttccagccacagaggcatccttgccattcctcagacattctaaacacactcccaccttagggccttttcatttgctattgaccattttttatttactctacctgtaacccttcctgcacttacctgaatggcttgttctctcctttcttgaagtgtcattatatcagagaggctttccctgacatccctatgcaaaatagcaatactctcctcagtacattctcatctttgttgtggtctgttttcttcaaagcacttatcatcatttgatgatttttggttgcttgtttggtgtctgtctctgccagggtgaccaactgccttgatttgccctggactgaggggttttctgggatgcaggacattcagagttaaaaaagggcagtcccaggcaaactgggataatgagtcatccttgtcttttcactggattggcagcttcaggagagagtggaatttgttcactgctatatcctggtaatttgaagagtgcctggtatgtaggggtatacaatacatgtttgttagatgaacagatttcctttaaggttctgtatcccttaagggacttgcagctttccaggactagaaaatacactttagattaaaattttaaaaagtagaaaaaaaatttagagaaatttggagggataaaaataaaatcagttaacagaacctctgaaa

SEQ ID NO: 93400 - DNA, 1046 bp, Homo sapiens
aaaacgctatcccgatggatggtgctcgatgcctagacacttttaagtgccttggcctacaacatattttaaaatagaatgttctctcatttttcaaatctccatttggtgcctcatttgagacctgtaaagcacttgtccttagccctgaagctgaacatagtgctcaagacagataagcagaattatagcacagggtgacaagtgtggagatagaggtatatgtacagagtactgtgggaacatggagaggggcactttaccatatccatgtatgtgtggtaagtaccagggacttggaaacatattatttgattttttatgaataatgtatctctcttaggtaactattattaacaaataacatttatacagaagagtgtataaatcacgtgtatagcatggtgaatttccaaaaggtaaacacacctgtgtaagtagcacctagatcaagaaatgatatttccaacatccagaagcctcactcatgtcctgttccatcactatgaccaccttgcctcagagtaaacactatgctgacttatgatgtcatcattatttttgcctctctttgatcttcgtacaaatgaaatcaaactatgtgcttgtcttctttcactcaatgtttatttgtgagtgtcatccatgtagttactttggttgttgttcatgctcattgctgatagtattctattgtatgagcataccacagtttatccattctactattgattgacacttaggttattttcagtttttttgctgttgtgaatattgctactgtgaacattcttgtacatgtcttggttaatgcacatgtatccattcctgatggctgtgtattgaagggtggacttgctgggtcatatagtatagatgataggacagtttgaggtttctcaactttattagtttatcagttagggtccagtcaggagacagaaaccatagcagtaatttgaatagggaaaatttaatatagagaattacttacctaaaggggtaaaggagatctctaaagaatgcaagactagcagttgtaggga

SEQ ID NO: 93401 - DNA, 1053 bp, Homo sapiens
ccagtttattatttttcctattaaacccatcctcatgagttcttttttgtttgtttgtttttcttagatggagtcttgctctgttgcccaggctagagtggagtggctcaatctcggctcactgcaagctccgcctcccgggttcacgccattctcctgcctcagcctcccgagtagctgggactacaggcgcccgccaccacacctggctagtttttttatatttttagtagagatggggtttcaccatgttagccaggatggtctccatctcctgacctcatgatctgcccacctcggcctcccaaagtgctgggattacaggcgtgagccactgcacctggcccctcatgagttcttaattttagagaatatgttcttcagttttacaattctatttgattattttctgtaaattccaattatctggttaacttatcttttcatctatatctaaatggctttctccactttcttgcttgtgttaattgtatttgttttccagtccatgtgagctaattttaatatctggaatatcctttgatttttctgtgtgtgtttcgtttgcttttttcttggttatccatcatgtggttctgtttttggtgtttctggtagttttgagtgaatgtcagacattccagttaaaaaactacagaggctccagataacgcagtcttcttccagagagagggtttactgtcccctctgatagggacataggctgatgtgattggatggtcactttaatccagtcagggtttttgctgagtcgaagctagtttatggctttggtaagagtctgtttacttctggttcacttctgttctgggatagtgctcttcagggttttacttgggagattggagtggccagtgttcctaaacaattctaagtgccttggcccacaacatacttcagaatagaattctctgtcgtttgtcaaatatttaaacacacaagcagtgtggatctcaaattctaaatgttgtcttacaagactgctgattgctttgctctgcttttcagaggcgttttcttaatttttagctt

SEQ ID NO: 93402 - DNA, 1033 bp, Homo sapiens
aaattgtgaggataaagacaacacctatggaagaaatagagtatatttagttgttagtcactctagtactcttcacggtgcttatgttcaataatttcagtgttcttggccttagttctctaatgcgtgttttggaaaatacattatttttattctctgcgtggttacagttttaagagaaaaatggctaattaagattcttttcctttggagggtattcttttcattcctgtcccacttgagggactttccaagatagaaaggaatttgcctactttctttctcttaataaatgaggaagattagatcaagagatgtggtttaaaatttcttcgctctccacttctctcccacctttgtttcctcccatttatccatccccgattcttaagaaagaaacacaagttggaattaagctgggtgatcctagagactcatttgaagtggaaattcaagatggagtggggctgcatactggttaccttcttttaagaggaactgaaaggtaatctatatagcaatttctgatgggcaagaagggacatcacaggcttttgaattttataaatggagccataattataattagctatcattttgggatacttttgcatgttttaggtttaaagcttacttgcctatggaggaaactagacatgtgaagtatgccacctccaaagattctgacaccctggcacaaaattgagatgataaattctgataagattccaccagtaggtcatctcttggtagatatttgaacatgccctagaattcctctgttagttggaagtttggcttacctagcaactgggtgaggctgcctactgaatggcattttgaaaagttcagacttaaaatttcctattttgttttttctccattatgagtcttaccagtcctatcacaaacttttatgggaaagtggtttttcagctacaaaggtatttgtgcattttgcccaagacatatgtcctcctcaagaatatataactgtcatattctgtattgacatgagaatcaggatcatatt

SEQ ID NO: 93403 - DNA, 1051 bp, Homo sapiens
ttctctttttcatagatgcctgctaacttatgcctcctcctcctctttccctgaaggagctttgggcatttttctgtatctcctactcaagagaatggaaagctccaatgccttgtattgccagacctgtttttaaaatatgccctattcttagggagtaactaaaactttatatatcttctgttttctccccttctaggcaaagtggttcaaaccacaaattacctaacaagtaaaagtggtcgtgtagcaatactagaggaatttttatcttgtttagtatagctaaaccatccttgattgggagtgttttccagtgagtttgccttgaatggctaaggagatcaataaagaaattatattttaatggaaggagactggttggtatgtctttaaccatttgtttgaatcacttgaaatgaattcaagttggtaaggtatgttgccaacttatatgtttttataatttttaaaaattgtttggatataggcctgtaacttgccaaataactaaggagaaatgacagaatttaaaaaatataaatcaagacaactaacttttctttttgctctagtagggaatgaggactggtaaggaatacttgaccaagaaatgaaatattgtattttattcttgcttataaatgtttagcaatgctctctgaaggaaatgcatagcaagctatgttaggatcattttaagttctatacggtgctgttatatcctactgatactttgaatttagtcttgaacagctcagaaggagtttctggctattgaggtcaacagatttgccagggaaaactttgtactttacttatcaaatcactttcatatcaagatacccctcttattcactgtatgatgctgaagctcttaccttttcctctgttcatcatctttatctgaacatcctaagacccgtttttcctataaatgaaagaacacttatgaatttccccattgtcatttagttcctataaatcaactcactcagtagagcaaagtaattcctttaaaaaatgcattcctttactttttctttgtttt

SEQ ID NO: 93404 - DNA, 1069 bp, Homo sapiens
cagttttaactggtcttttatttgttacgacttctacagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactgggtaaggatttttgagaatggaaaaaaagatgacttcatccataataaaataatcaattcatatgtccatttgtaaatcctagtcatttctttagataaacatggtccaggtagcctatatgtttctcataatttagagtttaaagagaccttaatgtttgtctagttcattgtgtttctcaaagatattacctgggaagtttgtaagattcagagtctcatccccagccccagatattcagcagtcagaggtggagcctgagggcctgcacgtgctaccagcctccatgttgttatgatgtatgtggcttgcaggccacattttgagacactaacaagtttccccctcctttgagtggaagacttctccaatatcccagtcaggtaagagaggtcagtaactctggaagcagctagcttacatggtgccttttatattttctttttgcaacttataattatatgatcctttaaaaaatcaagtcagaccttatcacttctcttcccagaaccttatgtacttctctttttttctctcatggtaaaagccaaagtccttccagtggtataaaaaactctatatggagaaatgcaaatcaaaatcacaatgagataccatctcacaccagttagaatggccataattaaaaagtcaggaaacaacagatgctggagaggttgtggagaaataggaatgcttttacactgttggtgggagtgtaaattagttcaaccattgtggaagacagcgtggtgattcctcaagaatctagaaccagaaataccatttgactcagcaatcccattactggatatatacccaaaggattataaat

SEQ ID NO: 93405 - DNA, 1083 bp, Homo sapiens
cagagtccatttgaagaatcagccttaccagtttgtcacccagctaaagttataatcacttgagtgtttcttagcttttagctgtctaagtggtaagagcagtcaatttcagataaaagcttgtttgttgacaagggaagtgcctctaagaaaggaagtaaaattttcccttacagaacaacctgaacttggactccattctgcacaaaatgtctacctgtcacttctaaaaggagaagaaaactgtcacagctgtgattaccaaaagcaaagcttagacttaataaattgccaaaactcagagtcttgttagtttaagttgcttgccaacgtactataacttgaaaaaaggaaagatgcacatatttattgctaatgctggggaaattgccattaagacagttggcagaaaggctgacattttaacagtcataggttagataattttctgcatctatccaagagaagattttgaccaaggactgacaaaaaaaaaaaatcaaattattctgttcacttggcggcatctaaatgtctcattttcagcttacaggaaagattgctgtgaaagcaatctttgacattacaactgagtgaccataaattgcttgaatagctgttggaaattcaaatataaaaccacatgaaaagtcattatctgaggtagaacaaggatttttcacttgttttgctcttcatttacagtttataacttaattttacattaagattgttttaaaattatcatgtactcagtttcacagaagatgattagcttataggtcataaggaaaatcagtgccagaatgaaaaactgaattcttttttttttttttttttttttttgagacggagtctcgctctgtcgcccaggctggagtgcagtggcgggatctcggctcactgcaagctccgcctcccgggttcacgccattctcctgcctcagcctccagagtagctgggactacaggcgcccgccactacgcccggctaattttttgtatttttagtagagacggggtttcaccgttttagccgggatggtctcgatctcctgacctcgtgatccgcccgcctcggcc

SEQ ID NO: 93406 - DNA, 1040 bp, Homo sapiens
tttccttctacactcccagattctcactgggctaggtgtcccttttataagctcccatttaactctatgctgttattgttgcctctacacttacccctttcaaagtatgaccccttgtacttaaaaacagacctttttaggtttagctgtgtcttgatccaaagaaccacacttaccagagtatgttagttttagagtcatctaggagctcagcataataccaaaaccacaccttttggtaatcttggactgtaacagaaggcaagaattataataggatctcacaaaccttctcccacccaccatgatgagctatttgtagatccttagtggctcttaagtattctcccaagtgttgagttgtgagtagcctgcacataatggcgttcaatactgagaatagctactcagctctgagcatccatcctttttctcaccattggcattcctggtggcacagtggcttctatcactctctctggcttgcctcagctttgattctgtccattcaattctcatttccgccttgtctgtcacagggttaggcttatggtaatgaagaaatgctctgtccttagccagagattggtgtaagttaaaagatgctgtgagcggtaaaacaaacaacatttaggcagatattagttattattattatcttcagagctcaatatatttctgtctgtatttttaaggtttagatcagagttttaaaattagggccataaccttttttgttttttgagacggagtttcgctcttgttgccgaggctggagtgcaatggtgcaatattggctcactgcaaactctgcctcccaggttcaagtgattctcctgcctcagcctcccgagtagctgggactacaggcacgtgccaccacgcccggctaatttttgtattctttagtggagatggggttttaccatgttggccaggctggtctcgatgtcctgaccgtgggtgatctgcctgcattggcctcccaaagtgctgggattacaggcatgagccaccatgcccgggcaagggccagaacc

SEQ ID NO: 93407 - DNA, 1054 bp, Homo sapiens
aaaaacatggaatcaacttaaatgcccatcagtggtagactggatgaaaaaaatgtggtacatatgcacaagtgaatactgtacagccattaaaacaatgagatcatgtcttttgcaacaacagcgatggagctggaggtcattatcctaaggaaactaacacaggaacagaataccaaatactgcatgttcttactcataagtgggagctgaactttgagtatatgtggatacaaaaaagggagaaatagccaccaaggcctaccctagggtggagggtgagaggagggtgaggatcaaaaaactacctgtcaagtactatggttattacctgggtaacaaaataatctgtataccaaaccctgtggcatgcaatacacctgtataacaaacctgcacatgtacccctgaacctaaaataaaagttaaaaaaaagaaaaaatttcattgaaattatgacagagttatgtttactacttaatttttcctctcttctgatttcccttatgtagaattcaaaacttaaatttttacttgccttaagtttccaaatatgatttatggtaattctgacaatggtatatatattttcttagtaaaaatgaagaagtcacaggtagtttcttggaaaaaagaagttacaggtagtttcttggaatgtagattggggtaacccattatggaaaacacaatggaggtttctaaagaaattaaaaatagaactaccagtaatgcctcttctgggcatataaccaaaggaaatgaaatcaccacctcataaagatctctgcacagccatgttcattgcagctttagtcacaagagccaacatatggaaacaacctaattgttcaacagtggttgaatggataaggaaactgtggtacatatgcattttgaaatattattcagtcctaaaaaagaatgagatcttgccatttgccacaacatgggtgagcctggaggatatgatgctaagtggaataagccagacacagaaagaaaagtattgcatgatctcgcttgtatgtagaatcttaaaaaaaatttcaaa

SEQ ID NO: 93408 - DNA, 1032 bp, Homo sapiens
aaagatatgaaagacttttatcctgaaaactacaaaacattgctgagagaaactaatgaagatctaaacaaatggatatgtcatgttcatatgctggaagacttaatctcgtaagatatcagttcttcctaaattggcatatagatctggcacaattctagcaagttgaaatctcagcagaaattgtaaaaattgacaatctgattctaaaatttattttgaaataccaaggacctagaatagcctaaacaattttgaaaaagaagaacaaaattggaggactcacattccctgatttcaaagacttattataaagctccagtaatcaagacagtgtgatgatggtctagaaaaaaatataccagtatagatcattggaacagaatagaatattcagaaatagatccacacatacgtggacaattgatttttgacccaggtgcaaaaggcaattcagagaagaacagataatcttttcaacacatgatgctagaacaattggatatctatatttaaaaaaaaaagagaaaaggcctggtgcggtggctcatgcctgtaatcccagcactttgagaggccgaggcgggcagatcacgaggtcaggagatagcgaccatcctggctaatacggtgaaaccttgtctctactaaaaatacaaaaaattagctgggcgtggtggcgggcgcctgtagtcccagctactcgggaggctgaggcaggagaatgacgtgaacctgggaggcggagcttgcactgagctgagattgtgccactgcactccagcctgagcaacagagtgagactctgtctcaaaaaaaaaaaaaaaaaaagagaaaagaaaagaaacttcaatccatgccttgaaaagacatatatatatatttgttgacatatatatatatatttccatgtaaagtttaactcaaaatggattatagacctaaaagtaaaacctgaaactatacaacttctagaagaaaacgtgataaaatttcaataactttttttttttaaaaacctgtgttctaatt

SEQ ID NO: 93409 - DNA, 1054 bp, Homo sapiens
tttggttttggtccttgaggtttgagaaactattttggctccagctcctataaccagctcttctttggaatctttgagcccctcccatagttttccaataagtaacttttttttatgtgagtatgatttgggttcctgtcacttatgatcaaaaaaatcttgactcatccagtaagccagtaaggcattattatcttcatttttttaagatgaggaaacctaagctcagagaagttgaatgggttacccagggttatcctaactgtatgaactgtatgtggcagggcctggatttcaattcaggtctgtctcactcaaaagcccacgctctttttaccccaagagactaccatggaggcttcctgtagagcaagccgttttcactggatgaagggttgggatttcaatgcttcacatattctttgtagtctctgatacagtggaactgtgaaaatgcttattttttgacaggaactttttagtggagacccatagtagtcctgtcaacaaatctcacctccctttctttctaaaaaagtgacattagcaagttacttggcactgaatggaacttagtttgctactacgtatcttgtgggcatctgcaggctatcttgtaaaatggtggagtaatctaatcttgtttcatttgaagtatattggcctgtccaggaaactttattagcacctctaaacaattacgtcattaaagggcaagacttagaagccttgttaaggctgtgtaagatctgttttccaacttaaatgaagttaagcaaattcccataataattttagaatgattcagtgttttctagttatcgtaaatgatattgcaaaaagctggaaatcaacatgaagctattctttttcatttttcagaatcagccttttgaatgattcctatactctaatgttcaattgatacttgattcattttagaaaattgtcatagacccatatacttgagaattggcatgtgtgaggctgaagttttatgctagtgcacccaggcaatccataattgcagtaaagaaacatatacttgtctggg

SEQ ID NO: 93410 - DNA, 1044 bp, Homo sapiens
gttgagtgtggaatgccagattaaaggatttggatttcatcagtacacattaaagagtcatgtcaggttttaaaacagtcaaggtacaaagtggcaccttaagacttcactggggaaggcacatggagggaaggagcataggttaaaggaggctactggaactagaaatgaagtgatccacaggtagcagtacaaacaggaaggaagggcagatgctgggaagagttgaagctccttatggcagaattggtgtaattcacctttgtattttcttgctttatagcacagtgccctgaacacagtgtatactcagtaagaattttcttttttccttttttaaaaaaatttctttttaaagaaaaaataatatatgcgtgtatgtaaaatgatttaatgataatgtagatgagttcttacattatttgagtggacctcgctttttctacttttttttttaaagaaacactgtgatccacaattgtagcaattaaaatcttaaatctaaaagaaacataaaagggaatataatgctagagctcattctatttttattcagtacatatatattacttagtatgatgagactaccgtaataaagaataggaacagacttctgattatgtaatagcctgcaattatttttatggctattgcattccaatcttcttatgcaatatttacaacctacatatgtagcgagggcacaaaatacaagttctaacaatcctaaccataaatcagaatcaaagcatgcagtataacatttgtgacctcccttggctgctgcagacagcctttgttaagaatacataaaatactgagtttataactctgtggtagatctgggattttaagttataaaacttaatcactctctaccccataattaaagattctgtcaagacaatttgatattagtttaattgtgaagatggtgaaaaactcttatattccattttggaaaaataaaaacacaaaatgttttaaatattgtatgagtgtaatgagaatttcagcagattataactacaaaagattatgatt

SEQ ID NO: 93411 - DNA, 1037 bp, Homo sapiens
aaacgtagtgcagccagccacatagattcgcagactggcaggctggtcacagagcgcctgcttccatccagagtcccttctacatgtaactctccccagggcaaagcgcctgcatgtgcttcttctcacagccctttaagatatacagggcaagtaggagctgcttcttttctagaagaagaacttatccaagcctgtggtgcagacgattgttgtaggcaggctagagccacacttacctgattcccaatttgtacgtaagaccaggcaaggtccactgtgttgagaagatgctttctgtgaatcaaattacttggtacagaaaatgttgctttcagtgtatcttgtggcaactttaacattgtagacatcaccactgaataagatgaatgcgtgggaattgtggatttgaaaacactaaaagtggttatcaggctttagcacatcttaagagtctgcatttccactagcctaattcacactgggcccttctcagcgtttcttaatgctacgctactcccacttcctttcctctgtttccctcacttcagccctaaatgaatttaggttgttgaacagaaatgatcataaatccctttttaagccaaatgaaaagaggcccataatttctttagtttgtttcagacccattacctttcagaaggtcaaacctgcctcattctctaggtgtggacatgatacggataacaaaaaggcatggggatatgttttatcaaatgtcctaaagatgtttttacatgcagtttttaataaaaaacaattatctactatgcataagaactaaagtaataatgtgcaatgcattttgtgctttttaataataaattattagtaatgaagtggagacaacttagagttgattgttttctttggaggtaaggaaacatattgaaactaaacaatagtagctgcctaagatttcatgatgtgacagtggcatattgctatgggggaaaaaaaacaaccatgcacagaagaacaagccattcaccctgatatcagtaatttgaaagtga

SEQ ID NO: 93412 - DNA, 1061 bp, Homo sapiens
atggagcaaataatatttcttcatttatctgtctgtctttaattctgctgtcagactttatgtcatctttgaataagtctctaattttctgatttaaattaatacccatttattgaatttttgtcagaattataaatggggtcttttctactgtgttttctggctacggcccatagtatataggcttgtagtagttttagatggatttttatcctgcaactttgctgaagccatttagctaacactagttattttaagttgattttattgagttctgtaatcatataactttataacttgatgatatagagctatgacatatatcaaatgtattttttcctttttccccatgtttatatttttaattcttgttcctctccaatatctaattgcctattcagtcaagtagctacccttgcttccctatgaactaggaaataaaggaatcagcttactccatgaaagtcgcagccagcacataaatggattaaggtgtaaacgtgatattctctttgggagatgaaatggatcccaagtgagcaatattggacttgttggaatgtgttcacatatgtgaagaaagaatgtatcaaaccaaagctagggaaagaataagaaaaaataatgttagagaatttggcagtaactattccagcattatccaaaataaaggatggtttcgccagtgaattttgaataatgtgaaagtggaggtaaatgcagaaggatgaatgtagatcacagactttaaactgtcttggtattccctttggatatactaacaaggttaggatctcagactctattaaaaggcagttcctctaactccccttgttttgatctcttgttcactcagaaacccacataagcctttctcataggaagataatacactgatcttaggggtttggagtattcattccatccttgtgactgtgatttattattacaaagtaataaattgacttcttacagggaaagaatgcagtaaccatacgaacatagagaattttagtaccaaattaattttgatagtaaactaatgagttagcattctggct

SEQ ID NO: 93413 - DNA, 1319 bp, Homo sapiens
ttttaatgtctaaaacatacttattctcatattttgttacattttaataccatttaagagtagtagaatttggaaggtgacatagagatccacttttatttcattttcatttcaagcccctgtgtctttaaggaaagggctaagctacaacttggtcattctccagatccaagaggaaatggattggagcagttgtgcctttgtagagcagatgttttggttggaaaggctatcagccatctgactcataataaattctcaattccagtaaattcccagttttcagttacagtaggtaggatgcaggaaaacagtgtcttccactttggggtctttgaacttatttcacatgttaccactgttccttgtgcattacaatgtgcgaacagacaaaatactaggggaggttagagcaattccaggaatagactcagtcagttggtgtttttgagagagaccattggaggtaaaccaaagccactgccctctctgacacagtactaaccacaagaaacataactgcattgagttttcttataagttcctatgttaaaataatgattttatataggaatcatgtaataaaataatgattttacaaactgaattatgtcagtttgagtaatctataaacggcctatagttttttgttttgttttatgaggagggtttcctttatccttttcataaaatgctgaaagtaattatatggtcctgatgtgatatctttcattttagagtatttgttttttgggaaaatttactcaatacttgaacttattgagtaaaaaaaaaaaaaaatttactcagtaagcttctcaaagttctagtaaggccttatagccagtgttccagatggatgaagcagaattatgaaagtgatattcaacgtgtcctactttgtattgtgagctgagttgagagaattcattatttacttagtatttttgttttgttttgttttgttttgttttttagacaggttcttgatcctggctcaggctggagtacagtggtgtgatcacatatcactagagccacaatctcctgggttcaattgatcctgccatcttagcctagtagctgacactatagacacatgccaccatgctcggctaatttttgtattttttgtggagatggggttttgccatgttgcccaggctggcctcgaactccagggttcaatccatcctcccatctcagcctcccaaagtgttgggatgacaggcgtgagccactgcacctggcataaagtggtgtcttattatccccactctgtttttatcgaggagtcagtttcttttcaaccatcactg

SEQ ID NO: 93414 - DNA, 1057 bp, Homo sapiens
gagcagtcaaatcatctttgtttatgaaaataataagcaagatagaattaaaaaaaaacttaccctattctgtattgtgacatctagtagtaatgagctcaaaatgtcgcttttggaagacatgggcaggtggcagcagctctgtcctggtgtcctgggctcaccctgtaggaagtagctatttcaagaacattgcagttatcctttcctgacctgacaatcagtgcttcttattttcactgaatatagttagttaatcatagaatggccctaactgtacattattacaggaaggttgatattaccaccttagaatgccatggtcctcattgatgtcctcagagaagccattctccttccttaattaactgagtccatgtaaagatgtcaggtgaatacatttaatttggcacagtgacttctatagcctttagtctttacacatttgttaattttaatttcttgccctgtactttctaaaagtagacattaaaacacataaagcatatacttttaacctattttgaatatctactgtgtgcctggcgcagacaatatcatttattcttggataataagggaagaagaaatggttccttaagttgctcatgatctttgggccatacagtatttagaaactaaatgtagaacaagtaaatatacagtaaatctttcctgcatgtgagtttccaagttttttgtacatttctttgagcactggtgctgagtctcttctttgtgcccaatagcatcctagaggatatagtatcatgattaagaggctagggtctgagtcagcatacatgggttcaaaactcgtcttcaccatttaatctctctgagcctcagtttcttcatctgcaagtgagaataattagttcctaccttacacagttgttacgaagattagagataatgcatatacagctggaagctagtgactattgagtaaacacggaataaatgttagctgatattactgggcctagtaggaagaaggagatctctaccctgccctcaagaaattcacaatctatttggaatataaaatatatat

SEQ ID NO: 93415 - DNA, 1039 bp, Homo sapiens
tttagtagagatggggtttaccgtgttggccaggctggtcttgaactcctgacctcaggtaatccacccacctcggcctcccaaagtgctgggattacaggtgtgagccaccgcgcccggcctgttgcaaaatttttagaaaataatctgtcaaattcttttgaaatgtaaaatgttcataacctttgacccaagaagctcagttttaattctctatttaaaaatataagttccactactaacaaatgcacacacacaaatgtacatacactgagacaagcatacacacacaaaagaatatttattgcagcactatcaagtggccaagaattgtgaacaacctgaagtttgttgctaaggaaatggtttaataaaaaataaatccatgccatggaatattatgtggctatttaaaaagcagttgatagagcgatatgattcctttagggaaaacaaaacagaaggttaaagagctgtttatatgcaaatgtgtatatgtttttatgagcataaagaaagtagtttgaagctacctacacacacagttaatattggttaccttgaaaagtgggggtgagagaggggtggaagagcttttactttataaatttctgtatggtttgacttgttaagacaagcctaaattttgtaatctaaaatttttttttaattttattttattattattatactttaagttttagggtacatgtgcacaatgtgcaggttagttacatatgtatacatgtgccatgctggtgtgctgcacccattaactcgtcatttagcattacgtatatctcctaatgctatccctcccccctccccccaccccacaacagtccccagagtgtgatgttccccttcctgtgtccatgtgttctcattgttcagttcccacctatgagtgagaacatgcggtgtttggttttttgtccttgcgatagtttactgagaatgatgatttccagtttcatccatgtccctacaaaggacatgaactcatcattttttatggctgcatagtattccatggtgt

SEQ ID NO: 93416 - DNA, 1062 bp, Homo sapiens
gtatatgtgattttatttaccaccaaatttgatatcttaacagaatggaaaatttttattttagatgcttaaaatatttttaaaacaatgagaaaaattgtataactaacaggtatagattttaaagaaaaaaattcttgccttgaaaaaaaatccgtatcagtcttctcaaaaaagagaccttccagatctcttaggctgattttgtgtcaggatttaagtaatagaacgtaatagtaaacatggtttaatttagccttactcatgttttctcgagtcactgagataatcctataataaatattgtgctcctggagagtttttttctttagtcctttgataaatagatggtcctgagtatgctaagacagccagctctcaggagaagatatgtatttgattttggtagagagagctgtcttatcctctagggacttgagatgttcgttttactagtctgggagcagggccaaaagggttcttcatgacttagaatggaattctgaaaagtaagttcagcaagttttcattagtgagtttggccttttgtcttgcctgtgcctcccaaaagatcaagagctcagcctttgctttgaaatattacaaaaaagaaccagaacagaatttagttgggggagaaaatcaatcagccccaaaatatcatatttttggaaacattctggtgtagaactcccacctccctagccacttaagttagtgatatctcagtgtttttatctagcttcctttttaggcagaaaatacacatttagaaagaagatgtatataaatctgtgataattcaaatctcactggtacatgtttcttaaacttgtttgacccttaagttctgtcttaaatttattttgagtcttggggaagttctatgccttatttctcttaaatgctatactcctctctacagcataataattagtctaaagctataagatatactatatcttaatttaaaaaatcaggcctagcacctttctgcaaaacatctcaagggttttgtgcagattttttttctgccgtgaagatgagaaattcatgatttcc

SEQ ID NO: 93417 - DNA, 1102 bp, Homo sapiens
ctccatctcaaaaaaaatgagtaaataaaaaataaaaaaaatttattcaacacctcttagtgttttgttgcaggaggactctaggttatccagttagccatattgctagatgtctttctgtattgtgtcttgatgattccagttttctacaaggattgactgggattgcagatgtgctctgaatgacatactagagatattctagctgtgtagctgttgaaatgctttcctgtttgtcttcacttcttgtggttttatattaaacttctatcctttgtgatgacttatctgagctactagcatctctaaacaggactggtaactggtctccctgcatctcctttttccccacttcagtctagttgccacattacagacagagtagtcttctgaaaacacaaatctgatctatcattctcttgcttaaaaacagagtttattacttttccttgtaataaacagagtttattacttttcctcgtaaatgatcactcatcagctttatccaactcaatgcttttcctgcatctctcaggcatatttcttttttttctacctatatctcttccatcttcaagttctagcatttatttctttgtactatcttgaagtctgaactctaagtctctaattcctcctatcctgttgtttcagtgactttccccttcaatcctttatgtcagacacttgatggaagtagaaaccaatgtataaaaaaggtagcttaaggttataaaacagatggtcatcaacactgtgagaccattattccaatatcttccaagtatgaggaccttttattaatgtcaaaaccttttatatgggcataggagaagcgcttgactacaaagaggcaggacaaggcaatttttttagaatggtggaattattctctgttgtcacggtgaatatacaactctacatatttgtcaaaacccatagaactgtatatcacaaagagtaaattttactatgggtaaaaaataaatttcaaaagcatttcatagatccctagggatagaagtaatacttttagcatttcatattaataaatgaattcaaaatgccttttaaatatacttgtattttttaatcacaacag

SEQ ID NO: 93418 - DNA, 1024 bp, Homo sapiens
taatatcatcatatattattccttgaaaaaaacagattatggagcatgatattttaaaattttagatttttgtgttcattcaatatgaaaacccttcagaatatttgtgtgtagatagatattttggtgattggtctttgttatttccaccctggtagagttgttcaccagagattgttcatttacttttttcaaactctttcttaaaagtgtagattaacttggccctgtaatttaatgttaagggtgaaaatggtggaaacaactgaaatgatcatcagtagggaaacaacctaattgtccactgacagattattggataaagaaatatatatatatatataaaacaatggactagtattcagccttcataaaggcaacgtggatgaacctggaagacattatgctaagtgaaataagccaagcatagaaagaaaaatactgcctgatctcacttatatgtggaatctaaacaaaatgtcaaatacacagaaacagagagtacaacagtggttaccaggggtggggaagaggtaggaaaatagggagaagtaggtcaaagaatacaaacttgcagtttgtgtaggatgaataaatctagagatcagatatacagcatgaggactataattaataatgttatattgtatactgaaaatttgctaagagagtagattttatgtgcttttaacacacacacaagtaactatggaaagtgatgaacatattatttgttttactatagtaatcattttactatgtgtatgtatatcaaaaacatcatgttgtataccttaaatatatacaattgaaaaaatgaaaaaacctaaacatcaaaaccatattaactatttctataggaaaatatatgtatgtggatactgatgctggatactactagtggctaataccaatgaacactcatgccacatgtgttaagcgctctatacctgttagctcattcagttctcacaacaaccctatgaggttcgttgccactgttgcccccattttatggtgacaa

SEQ ID NO: 93419 - DNA, 1619 bp, Homo sapiens
agaaatactttactcttattctgtggttgtcaggtccattactttcagatcaagatctcatctcttggaatactgtgtaccgcagaaacagtatcgcattgctcagtctggcacactttaggtttggctctcccactccctggccccttccctgatgtgatgccctttgaatgggctcctcagaggcatgtgctttggtgccacaataaggtaaccaggactgtttattaagcttatgcattttttcaagtgcaggcagccccccactaataagttgcattccaaattgtatgtgtaggttggttatttggactctggaacgtgttttgccatggaaaccatttagtacatagttgggttaccaaggaaactggatgtactgaaggagtccatcaagccatagtgcctgctacatgcagaaccacattttgggggacagaacccaatcctttttctttctttttttgtagctgtcagttgggcagctcgccttgttggaggatgggccaggagctagcagtgatctagctgcagcagattggacctgctcagttcacccagtacaagtccatataccaggagggcccaaaagtcaagtcagatctctctgtaacagacatgcagggcaaacaagagctgtactgtcactcacttctggatcgttacctggaacagcactaagcaacttttcctccttgcttatgaaacccagtccacatcccagagccaggagagctggagccagagtgagcacagtgcacacaaagtgcttgcctttgttcctcgtgttctcaaatatccttgcaataaatgatcatctctccaagtagtctgtgtggacccagtatcacgcaggaaaagccgaccagctcaaactgggtgtggggcttgtccacaaaagcttatggccccatgatctaggttccttattaatagcaatgcattttcctgttatagaatatgtcactcatcacagtaaagagagaatgctaagcccattgtactattccaaagacaaggaatggaaatggtaacagcattattactgtagtgtttttattgtattttaaaaaaattaagccgagtataacttaaatgtttcttgtgcctgtttataaccagtgctgccctgttcccttggtataatggatggtagtctacacactgagtactgggtacgaagactcagctccttggtgttacttccttggaaccttcacctggtgtcctaatcagagtgatggccttcattcccccgtcttgttgtcaccctttggggcttccttagtttagtcctttgtttcctatctttgtatatttgcacaatcacagtagtttaactttacatttatattgtgctttctactttacaaggcacattctctttgcaagctagatagggccggcattgtcatctctgttttccagagttaaaatgaatactcaggcattttaaaggacttgccaaactttcacatccactggcagcagatctggaggtagaacacagggtttccagggcccggttttcctgcgctctttccaccgtatcactccacacgcctgtacagttgccacttcctttagctctgcttatttcttgatgggtggttgttagc

SEQ ID NO: 93420 - DNA, 1037 bp, Homo sapiens
ctacagtgaagtttttctacagtaattcttcaatagtgagttaaaactaattactaatacaagcatgagaataacaataaattagagcaagatagttggaaatgctttgataacatttggtccctttcttaaaattaaaacttttagcatttgctacctatctacctctggatttccctaaatagaaaattcaattcaaatcttttcttggagagaagagtttccaggtctttcttgagatatccaaccccttttggtagtcttcacacacagattttcccccactgttcgtgggcactgacacctcaccagagagtgggcaggtttgcatggggtgacaactggattatttacatggcactgtgaataagtgataagcctagttctgcagggggctgtttttatttcaaaggatgatttaaatctaccatgttagaatatgtaagaataaactcaggtggagatgctttcctgaggcctttaagctataacattctgtctatagcaccccttttctatcccccaaagagccacatctgaaatttagcaatccatttcttcaagatttcaaacttgccttaaacaattgagaatgaagagccatgtgcctctaagagctttgaccacagcccctctgccctgggcctcccagaatttccacaccagatcaacagggctgtggagttttcagggccactgctatcctctggcagcttctcagctcttgctggtggcctcagtaccagctttgatttctctctaggtcaaccctttcccagggaagagttccctcaacttcaagggatctttctcctcctccaagtctaacctccgccttttttgggtttggcgcagggaggggaaattgcaggagctgataacgggaaggaggagctgggagtcttcctcggttttactgtgaaggtgtcttgggtaagtggctggggagacaggaatgggcacaggggatgaactggagagagctcaggatgaatgacactgctcacccattctgaaatcatgctactccaccaaca

SEQ ID NO: 93421 - DNA, 1374 bp, Homo sapiens
gtgaaaacagccacatttggttactttaattaatgcctttaataagtagaggtgttaggctggaaagcattatttttcttacatttctgtgtatgaaatcttatattccttctggtgccttcatttgcctttcctttccttgcccttctttatgtatttttttaaatcattcatagactcagagaatgttcaaaacagcagcaacaacagcaaacttctagctagaagagtcgttaaaaatcatataatcaggtccttttgtttcacaggacaagatacttgagaatagaaaaggttaaataaaagatttcttcaaaatggctcagaaaatgtggctatgggagatatgtcaacagtgtaactattaacagagtttgtatatttgtgttctttttgtcttttcttaagtaaacaagtatatgaatacactttatagttgagaatcagtctttcacagaccctgttttgtatctccgtgctattcctaccttttaaattttattccatttgctttatctgtattcttcctgtatctctcttctctctcttttgcttctgtaaactaatacctttgcaacctaagtaacttaacattacagaaaaataaaattgaagttttaaaaaatcttgaaggtcggcacctcagaaaaggcaggctaaattaaaagataaagaaaaaagtacttggagacttctggaatatttgagttctttttaaaaactacctcaacagctgtagaagtagatagttctttattatcacaatctttaccctccgtttgctcagctgcaagtatatgtttaactagcacaactcaaatggatgatttatggtggcttttgccttacaaataaaatgaagaacagttagttcttaaggtaccaggttaagaatttggagagaaaaggatagggaatttattcatttattcataaataattgatcgatagagaggggtcatctccttatggagtacaccgtattttaatgcaagcagatgagaatcctgatgacttatacaatactgttcttcatcttcatactaaggtgactgagctaaaagtgctgaggtaataaatgtaaaagtgcttaggaaaaatggaaaagccttgtgttaatgatttcttattcaaaacagctcagttctataactatttattgggaatctaaaaacaaatatttgtgtgctgagggccaggtgctggagataatgagctataaagagaaaaggagagacagtgagaaaaaacagcattttctttccttctgggaagaaaagtagaaggatggaaaccctgtaccacacagttccccataccaaccaccagatggggttatcagccacaggcagctcagttgctggtccagagggc

SEQ ID NO: 93422 - DNA, 1010 bp, Homo sapiens
acctcacaccgggacagtaaagacaaagggcacctgaaatgtacatggctctcttcaggatgctttgagaaaccagaacttaagtaacggttaaagtagagactccaaagtcagacagacctggatgtgaatccagcctccaatactaagtagctgggtattctcttagcctcctttttgtcaccttttacccaggcatgaggatagtatccacttcacagttttgaggattaattgaattaaaacatgtgtaatgagactactgtctggcatacactactctatggagtcagtgcccagcgaatgatagctcttcctagctcagccaaccctgcaccgggcttcttcctaagtgctgttatgcacataatctcatttcatttccctaccaaccagccaggtaatgctcttcctcgcacactagagcagtgttagttgaacatttgaatttttaagcatcttgactgaatatgacactgcattggtgacattttgatagctgtcactgcatggtttagttccagcatctttcagcacattcagaagcatcaacctttacatgttggggcttctccaacagcaattatagccacaagtggagaaaagctatacatgttctcataaaatatcatcgagatttgtgtcataggcctctagtgacaaagacatgtttaactgctagatgtcagtttttttccccctttcagataaaattaaactgtggagttaccatttaatccacaagtgtaagaataaattggttttttagtcccaattctgtagaaaatcaaaactagtaccaaatatttttatttataaacatttttattgtgggtgtaggcatatctgtgtgtagacagatagaatgaggtgccccccgaaaaaagacggtggtgtcatcttttgtggccagcctagtgaaatcctcactctcctcagatgcctcccagccggcagccaccctgcttcccccatgaccttcttctgagtgtgaagctctgggtgccagc

SEQ ID NO: 93423 - DNA, 1087 bp, Homo sapiens
cttcatggtttcagattttcccgtatgcttcagtcaggattttattcagcaatcatttattaagtacattcttaagtttggtgagtaccataccactgtactaggtatcaaaagagaaaccctttccccttttattggtttgttcatgttttcacttattttttcatttccttcattcaagaaatatttgtttagctcctactgtgtcccaggtacggttctgggtgcagaggaatcagtgataagcaaaaacagacatcgtctttgccttcaaggaattgccagtgtactgcgggagaaagacgtaaagaattaattgcaattcagggtgatacatactataatagtagggtgttcaagtttctttgaggaatgtgaagggtgtaattggctctgcctcaggcatcaaaaataactttacagattactggacatgtgagaggattctacagagagaggacagcacatacagaggtgaggaggtataaagtatggttggttcggggagcttgatatctgaatgcaaaaacagcagatgcaagaggtgaagctggaaaactaagttgggtagccaagttgttaaggtcattttgcatgccaagtttaaaaatctggagtatgtcttagagaaaatggtgggggaaggggcactgaagctttttttttttttccttgctttttttttttttttttttttttgagacagagccttgctctgtcacccaggctggagtgcagtggtatgatattgtgtcactgcaacctccgcttcctgggttcaagggattctcctgcctcagcctcctgagtagctgggattacaggcatgtgccaccacacccagttaatttttgtatctttagtagagatggggtttcaccatgttggccaggatggtcttgaactcctggcctcaaagtgatccacccacctcagcctcccataatgctgtgattacaggcatgagccgctgtgcccggctacactgaaggcttttaagcagagaaaatgctttggaagtaaattgtgtttgctcaaaattcatatgttgaagccttaaccccctagtacctcagaatataactgt

SEQ ID NO: 93424 - DNA, 1003 bp, Homo sapiens
ctctgagtcaaagtatcacaattagtgtatataaaaagctaggaatattaacttcatctaccaattgccattaaagtaattaatttagctattaatactgaaaataaagaaaaattaaatataagaaatatttcctcctaaaatagctaaaagctatgctccatatctttatgtttgattgatagtatcacatttttaagaagttatttttagatgtttatgaactataagagaatcatataaaaggaatagctgtaaagggggattagagggctttttgttgttattattttgtattttgtcattctaagagattaaacaaagattcatgaatagaagctagaatggaaaagaatttaactttgcaagaaattaatttctcccttacatcttataacgttttttaaagtagagaaaaatcaaataggataaaaggactacagattcttaaaaaatatgtttaagtaaagaacacggtataaaaggatatatgcttcagagtacatttcctccaacccgagtcccctcgtcttccagttccccttcacagaggcagtcagttatgtatgcgtgtccttctatgaatatacaaaggtatgtgaacatatcctttctgtcatttggatggtagcatgctgtacatactacgttgcagtctgctttttaaaatatatatatatatatatcttggagattgtaccatatcagtccatatagattcactagttggttataacagttgtttaatcatccttactgatggatctgagtttactttctgtcttactacaattaatgatgaatatctttgtacatacattgaagactactgttctaatagtcgtgtctgtcaaatgatgaaagatgatgatgggtttctcacatcctgataatacctgatagctttcaaagcacttcctatatgttttttgttttggaatgatctactttcaggaatggttagcgacccactactggaggtggtcaaccactgcgtgcattt

SEQ ID NO: 93425 - DNA, 1020 bp, Homo sapiens
tcacacacacaatcatagctgcacagtgctgtgatgaaacatcactagggtacctccactccccatacagttaggaaactgtggaacagagacatcctcccgtgttcagagtcacacagcctagatagtggcagtggtaggactacaatcatggcagatcagtgctagaaaggctttagagtgtctgtatgtcattcagggttcccagccttgagaagaggacctgctatgcagttactgcggactgcaaattcacatgtacaccaactgttgtttgtagactaaataaataacatctaacatctgtataccgttactttaaaaacgaatgttgactctgctgtgattaataaattggaagtttattttcaactgttactgcatccaaagtaccttttttcattatattttctcactgcacagattcttaaagtatatctgctgttgtttgattagtctgagagaggttttgatgtgtgaagtgtccctcgtgcttgaaaagattgggaagcacacatctagtccaacccttccacttactttacaagatagaccaaagcccatgagggttccctttactgccttagggttgggaagattgtcagtaataaagtagggaccagatcctgattctttaggacccaaaagtgagtgctttgtttttttcttaagtatatcatattaatggttcccattaatccagaacatccctatgaattagaaaaatccacaaaatatggtcaggcgtggtggctcacacctgtaatcccagcactttgggaggccgagtggggtggatcacctgaggtcagaagttcaagaccagcctggccaacatggtgaaaccccatctctactaaaaatacaaaaaaattagctgggcatggtggtgggtgcctgtaatcccagctacttgggaggctgaggcaggagaattgcttgaacctgggaggcagaggttgcagtgagctgagatcgtgccattgcactccagcctaggcaacagagcaagactctatc

SEQ ID NO: 93426 - DNA, 1049 bp, Homo sapiens
ccctctccccccaccccatgacaggccccggtatgtgatgttccccttcctgtgtccaagtgttctcattgttcagttcccacctacgagtaagaacatgcagtgtttggttttttgtccttgcgatagtttgctgagaatgatggtttccatccatgtccctacaaaggacatgaactcatccttttctatggctgcgtagtattccatggtgtatatgtgccatattttcttaatccagtctatcattgatggacatttggattggttccaagtctttgctattgtgaatagtgccacaataaacatacatgtgcatgtgtctttatagcagcatgatttataatcctttccccaggtagtttatgtaggaactatttaatgttaaatgaatcattaggtaaagtgcgtatactacttcatgagatggctttaattaagtcacttattttcttaagactttatcttgataatttttttcttggttcataatgaaatggaaaagatttgtgccttgactatcctgaaacttttatgttactctcacaagtttactgaagctgcaaagaataaataaggctatttaaactatggtgactataacccatttatattgagaaataagcctttcaagaggttaaaaatagcataaaggcaggtacataagatgcttgtcagctaaaaagacccacccaatttaaagtaacattaatatattaaaaccccatttcttatctgagcatatttatagcagaacaaaactccagagataaattcatctgccttcagacagccgtacacctgaactccaggtggatgtttgtgtttgggtctgtttctaggtggaatgatctcatgttctcccttaccacagaattgtgcaacactgatacacacctgtgttttgatctttaaaatctgtcgtggtaacatctcaagtaattttaaatagcttcgtggatgatccagattgcacgtctgccagaaacatccttgggcacagttttggagctgacttggattcctgcaatactaaactcgagtcatat

SEQ ID NO: 93427 - DNA, 1409 bp, Homo sapiens
tggttatatttttaaactatactgagaaggggatagggtcagaacccaataatggacctgaaatcactgaaaataattcttggatattgaagggtaaaatttggcctatgtcttgtaaacagctgcctgtatcccgtaaacaggctcagtcagatgctaacagatatttgtcaaaattgcacatgccagagattgaaacggaaaatggacatgagccattttggagttaggctttcccaacaacaggcctcggggctgtttaggttctgccacctagatacacgggggatggtttcttcagtgttttccttcctcatgagctcccaaaggacaaggaagcaaatccacagctccttgaagccccttagtccctaagctacagttgaacacagcaaacacatatttaatattgtttttatctgcttaattgtaagttagtattgaacacagactagtttcaaagttttatttgcttaactttatgagtcctttcattaaaaaaaggatttctctgcctgggcacaatggctcacgcctgtaatcccaacactttgggaggccaaggcgggaggatcacctgaggtcgggagttcgagaccagcctggccaacatggtgaaaccccgtctccactaaaaatacaaaaattagctggggatggtggtgcgtgcctgtaatcccagctactcaggagtctgaggcaggagaatcacttgaacctggcagttggaggttgcagtgagtcaaaattgtcccactgcactccagtctggcgacagagtgagactccctctcaaaaaaaaaaaaaggatttctcttctgtttgcttatcaatactctaagcattatggatttacaaataaatataaattatagttttcattcccaaagggcttgcaatttagttgggtagataagacatgtacaagaaagaattaaagaatacagcagcatataaaaaattatttaagttttgtggtgcaattagaataaatggtactgattaagtattataggcggtaagagcaaaagagaaaacatcagcatggactagaatctttggatcctggcacatggtagttgcacagaaaatatttgttgaacagaggataggccattaaacaccatttaaaatagcatcaaaaatatgaagtactcagttatacatttgagaaatgatgtacaaaacccatataccaaaaagtataaaagataaattaaagaagacctaaataaatagagaaatatattgtcagtgggccagaagtctcagtattaagatgtcaattcttcccagagtaatcattgatctatagatctacagattaagtagtcaaaaatctcagcagacttttttttttagggattgacaagccgattctaaaatgtatatataaatgccaaggaccg

SEQ ID NO: 93428 - DNA, 1027 bp, Homo sapiens
ctgaggaatttgtgtgtaattcagcaagaaatagagagccaggagacttctgcaaaggggtgaggtaccatgatccgagctgtggcctaagactctccattagacaaacagaattcggaatattagagtgatcaggaatggagaattaaatatcgactacaattgtccataccttttctgaggcttagtttttcttccgggttcttgatggtggtgatgatgttactgactgatgaggtggtgagcggaggctgaaaccccaccagtgctccactcacccagctgctcttctggccaagtcttgtgtctttccttcggcacattcctctatccagaggaaggggcatctgtttgtcgcctatcttccaggggtgacatcttttataaattgcacaaagattctttatatgcctgcagcagccttgattaaatggcagcactaggatttgaccccagtcctacctaactacgaacgctgtgtgattttgccagtgtttactactcttacaacattatttgccactactcttacaagtccttgccagtgtttagtaccattacaacaactactccccctactattgctgctgctattatgaaggaggagagggaaagaatagcatctgacattctttgagtgctggctgtgtgccaagcacagtattcagttatttacatgcattatttcatttaatcatcacagtctccctgtgaggtaggtactgttactatgttgccaagtgacagaataggaattgaagccagtcgttcagactccaagtctgaggacttaaccactacactagtatcttccctgaatacttaaggatgaaatatcttagaaaacaaaactgctgctctattagaagtcacataaaactacaaaaattatttaaagcaacaaacttgaggccaggtgcagtggctcacacctgtaatcccagcactttgggaggccaaggtgggagaattgcttgagctcaggagttcaagaccagcctgggcaacatagcaagacctcgtctct

SEQ ID NO: 93429 - DNA, 1064 bp, Homo sapiens
gtagccccactcatgttttactctcctgtttctgagccaaaaggaccatgatcttgactaagctctctcagagacacctgaatccaaagtaatgctaattttgaaatcaatgacattaacctctaaaagctttgatggtgcccagaattatttaatagaatcttcactaaattttccacttctctcttaattttcttctaattaaactttattttcttcaaataacagcatcatgataagttaaaagctttgacttaatttttgtttaattgccatattttaaaagaacttatttctattattttctcagtgcaaatgtacagtatttctgccactttatgaatttttaagaagttttcatgtgttgtcctaagaacctagcctcctttacaatattatttctagaggaaaatgcattctgtaaactcctaacaaataagccaactctagtgactccttttgttggtaaattgggtacttcttgtactaaatgttccaactggtagaggattgcaatttttgcaggtattttagagaaccaaaccagcctgtaattgcagtatttagttcatcttccttggaatgaaaaccatctaattagagttgccatgacaactctgttttcatgcagtataacagacctattgatctgaagttcaggttgatggagcatgtgtacgtgttagtgacagaagccaacatccaatatcgtacagagtgttggctccatttccctcctagcttattttctaccttatgcactcacaagtatttattaagcacctactgtgtagagagctcagagaagcccatgaaatattcaccataagaagaaagaaacagttataaaaccctatcgtggatgtagaataaaaccccagtaacttaccctctccttcataatctggccttttcctggacatttgactctttcttctcccacctccccgatacccaccactttggccacactggcccctttctgtgtttcaaacacttcagcctcatttccacctcagggcttttgtacttcacattcgctctgccagaaggtcatttctcca

SEQ ID NO: 93430 - DNA, 1044 bp, Homo sapiens
ctttattttttaaatccggaacagtttcttaatctttatctttcttgaccttgacatttttgaagagtacatatcagtcatcttgttccttaatttgggttcatttgatgcttcctcataatcggatttatatgtgtgacatgatgtgtctgtcctgagtataacatatcaaaagtcacatgatgtcagtttgtcccgggattggtgatgttgactttgatcacctggttaagtggtgtctctgtggtttctgcactctaatgttactagttttctctttaataagaactccgtggagtgatgtgttgagactatgtaaatgtcttcctcagactttcacccactagttttgacagccattgatgattcttcagctgcatctttcttactacgtttattagttggctttctactgtaaagaagagctttcctcatttatttatttatccattaacatatgtgtttcagaggggatttattgattctgttttattcaatgggacacacaccattactgtcattattttgctgcataaacaaagcctcatttcatcatgtttccatcaaaaaacagttgtattttgaatgctatattagatttctactgttgctgtaacaaattaccacaaatttagcagcttaaacccatgccaattgattatcttacacttctgtagaacagaagtccagtgcagagctcctgcggctacagtcaaggtgccagtgggccgcattcctttctggagactctagtggagaatctgtttccttactctttcaggttgttcagagagttcagtcccttgcagtcacagaactgagatctggtcctttgcggaggtcagttgagcttctagaggctgctgtccttatttggctcatagcccccttcctccttcaagccagcaatggcaagtccagtccctctcatgcttcaagtttttcctgcctcttcttctgtcatcatatttctctgactcactcctctgttttcctcttctacttttaaggactcgtgtgtctagatggattgagagcccaacc

SEQ ID NO: 93431 - DNA, 1182 bp, Homo sapiens
ggactttggtgagaaaaatcagggccggtgagaaaaaatgatactggatgagttgtggctcagtgctgctgtttcctgaattttgtccctcacttgtctcagcacctgggcctgtttctgacgacgtgctttcactagctagtcactatttcttcttcattttgtaccaaacaagtttgtgtggtaagattggatcttttgatgttatacacaccagcaaaacgaactgattgtcgaagcccagctggtctgtggtgggaggcagtgtgtagcgcagcagcggaatgtgtgggttcagaaatcggatggcctggttcagtcctgtgtccgtcatttactggatgagttcttttgagtcagttacttaacctcccaagccttactgctatttgtacaatatatcaaccttacagggcttttgtaagggttaaataaagataaataaaagaagctcttaatataatgcctggctcatggaaaatgttcattatgtgttagctgctattgatgttcttctaaatagtagtagattttagatcaataacatagagttccatagtctttgggaattaaaaaagctcaacttcacaatcaaactgtgttcttatataccttagtgcctctctctctctctctccatctctatgtctgtctctatctctgtctctcgtattacaaaagtaatatgtgtcagttatagctttccaataccaaccaaaaaaaaaataaataaaacaaggatacaactgggtgtggtgggtcacacctgtaatcacagtactttgggaggccaaggcaggcagtctgcttaatcccaggagtttgagaccagcctgggcaacataggaagaccttgcttcaacaaaaaatacaaaaattagccaggtgtgatgcttgtagtcccagctacttaggacgctgaggtaggaggatcacttgagccccagaggtcaaggctgcagtgagctgtgatggtgccactgcactctggtctgggtgacagaggaagaccctgtcaaaaaaaagaacaactatacaaaatgcaacgtgatcatgtgtcttactgtaatactcccttcctctgcaagatgatctcgtcgattcccaagtgggaagtgaagtaaaaaactcctcacttggatttccctcagttaacctaggtgtctctcctttcaccaccgc

SEQ ID NO: 93432 - DNA, 1044 bp, Homo sapiens
gaaactactgggttaaataaagggtgaaatgacgtcctttaaaaaataaactctcagttaaaactatctttcgtagtgcctaaagtgctttgcacctgttgaggctcaccccagacagccaaccaagtcattcagaatcagacctgccagagtgtctggtccatcacatttgagatcaaatgaatctgattgtttggtggttggggtgggagagtactgaggtatgaacaaaattaagaggagttcctgcttgctgctgtgtgggaaattgtaaacggagatgagccgtacatcacagtgtctactttggtgacggtctgaagcctctaggagcccctcatcatttgggatgctggcctggctccctgatagccagacctactgtttcttcccatccctgtagtcttccatgattaaaatccccctcctctcagggaggtaacatatttcagcagaaacagcctgaactccggtgacaggcaaacctgtgttcagatcttggttttacctatgtctagttgtgtgaacctaggcagtattttctgttctctgagcctcgtttttttcacatgtaaaattacagcgatacttcccacctctttgaactatggagagcatttaattagataatgtgataaagcacctagcaacatgtgttagttcttggtagtgaccgaagcagggtgcggaaacatgggcctggcagcagaacacctggcctttggatctcttcacacctctgcttttctccatcattacaggtaatttttgtctaacggctgtatttcggaatgacacaatccaagcagagagagggagagggtttcaagtttaaaggattactcagactgttttccttccatgtatataatttaatgactgattaaagacttctcttgtaatattttatataagtcaaagcctattactgtcaactccagggaagcatccagcttattttctttttcagaattttattatgccaaggattgtttctctaagtgagcgatgagtagcttggatcttgccattctgtatgttata

SEQ ID NO: 93433 - DNA, 1076 bp, Homo sapiens
atgtacgccttaaagttctgaacaatttcttttaataattgtgtgctggttcatttaaactgaaaaaaagaatttctttttttttttctttttttcttttttcttttttttttgagaccgagtctcactgtatcgcccgtgctggagtgcagtggtgtgatcttggctcactgcaatctccgcctcccaggttcaagcaattctcatgcctcagcctcctgagtagctgggattacaggtgcccaccaccacacacccagctaatctttgtatttttagtagagacagggtttcatcatgttagccaggctggtctcaaactcctgacctcaagtgatcctcctgccttggcctcccaaagtgctgggattacaggcgtgagccaccatgcctggcctgaaagaaggaatttctgaaagttgtggaaattatttcagaatcaacattgtgtcttagtgcttggatcagtgattattgactgcagcttcttgtataccttttgaaatacaagataatggccgataagctgtagaactagagtgttgcagcaattcattttagttcagtttcaatgtttaatgaataacttatctgtgcccagcaaagaattgggcataatgaagagtataaaaatatgtttcagtaatacttacagcccattaatgttggtaagacatttacccatgccaatcaaaattttctaatttgtactgttgtgtgttatcaatgatgtataatgcaaacatgctaatttatttaaatgaattaaaatacagaaatgtaatcataaagtgaagcccatatacccatcatcattaacctaggcagttggtggccagactttgatgagagaagccaagtctgcttgggggtgtcacttcttaagttgcttgagccctaagagaagtgtccattgtactcttgtcctttcagtgcacttggaggctcctcagctcttcatatcccagcttttccaggaggaggatgtctcattgattacgttcctcaagtatgccacctgctcaccaacaaggtaaaagcaagtccccaactcatccctcttatgagatttcttc

SEQ ID NO: 93434 - DNA, 1101 bp, Homo sapiens
aggggacgtttggcaatgcctggagacatttttgattgttatgactgagggggtggggatttgctactggcatctaatgggtagaggtcagtgatgcagctaaacatcctacaatgcacatgacagcccctcacacacacacacaaaaaattattgaatgcaaaatctcagtattgccaagctagagaaaccttaccctaaacagattctgtttctaattatctttccagtatcaggcctcaagacttttggtattattggaaacatacctgctgtgatcatttggttatcatccttattcaatgaaaagtctacaactttgataaaatgtaatacataacttaaagatggggtaatgttttaatgtatccccaacatcatttcttcatgttcttctgcgtagtaggcatacctaatggtggttgtcacatattaatccatcagtctgtaaacatcgacccagctttctcttgatagataatttagagtctttttatttcctgattatgtaagaaccagtgacccatggagtcaggttcaagttgcaagtcaactgagaccttcattctgcagtaatttggtacgtacaatgttcagtcttcaggccaaggcaaaggagccaactttcccagcttgagttagagaaaagcagtgggtttgaattgacttcactcaaacccatggcttttagaacttaccctatgccttaataaactactgcaggaggaataactttggctgtatttagccaaggcatcagacagtgtaaagatactgactttaagggatttttcttctgcagcagatttaccttcttcgttatgatttgctttggttaaaatagttcttaagttcatttttctatctgattacacaccaatagatagtaagggcagaaaccaaaaaaacatccatagtggcagaaagaagaaaacgtctaagtaaaaccttatcatggtaaaattcatatagagatgatcgagcgcaggccacagttttaaggagatgggcctctctgccttgaggtgttgcccaacaatcaccacttttcaaggtgtcaggcaccttgtcaccatcataacctacagtgtggggccaggt

SEQ ID NO: 93435 - DNA, 1048 bp, Homo sapiens
tcccaggttcaagcaattctcctgcctcagcctctcgagtagctgggattacaggcatgcgccaccatgcctggctaattttgtaattttagtagaaacggagtttctccgtgttggtcaggctggtctcaaactcccgacctcaggtgatccacctgcctcagcttcccaaagtgctgggattacaggcgtgagccaccgcgcctggtccactagtagcttttcagaatgcagcgtggcaagagaaccagatagcaaggcgaagtaacagaacaaaaaaaatcctctggggaaaagctacatgctttttttgtgggtcccagtcaactgcactgtaagtagacacacaaggaggcagctgtctacaggagcagagttgctgcttagaaggggagacaattgagtattgagatttgtgactgtatgacaagctgtctttttccattacctataaatctttggtaaatgaccctttgagtcattcagcctggactgtaggccttttctccctggtaaaattcctgttagaccaaatctgaccacttttttctcttgttttcctctacctccaacttaactgagttctgagtttactaagaacctactgcatgctcagtactatgcgaggtattaggggatataagtatataactcagagttgaccttaagatacttacagtaacatagcacagaaattagaaaactacagcctgtgggccaaatcccgtgtcagcctgtttttatagggcccttgagctaagtatagctttttgtttgtttgtttgcttgtttttttttttttttttggaaacagcgtctcactctgttgcccaggctggaatgcggtagtgtgatcttggctcactgcagcctccgccaccttgagttcaagcgtttcttctgcctcagcctcccgagtagctgggactacaggcatgtgccaccatgcccggctaatttttgtatttttagtagagaccgggtttcaccacgttacccaggctgatcttgaactcctggcctcaagcaatctacccgcctaggcctc

SEQ ID NO: 93436 - DNA, 1057 bp, Homo sapiens
tcactattttgactcaaattgaaacttctgtttcatctttagagtttacttccagaaagcctgttttgtaatttctgacactagtttgagaacttactggattaatcttcactgggaatattgtcttcattataataccttagaattacatgacccctttttagtgaccttaaaggatttcttttaaggaagaaggttgtaaatcacttgcacaatcatgcaatgaatttttcccctgtaccctcttatatatgttgtatgaatcttttcagttgtaattattggattaagtaattgccaaagcaagtgtttctgatcaaagaaaggtcttgaaaaattagcaattttgacttctcagtgatttttgacatgctgtcaaattaacaactgtaactcaagaagtcatcttacccagtgaaagaaaggaagctgtttacagagtaactcttatgttattgatgtagttcagtataaccttttcttagaattaatattaaagtactgttgacattggtgaagcatgggcattattatgttttggtgcagagcttctgctgttgttgaaaataatagcaataacagttcacaggtatggagtgaaggctgagtgcggtggctcatgcccgtaatcctagcactttgggtggccaaagcggatggatcacctgaggtcaggagttcaagacttggccaacatggtgaaaccctgcctctactaaaaaaaaaagaaaattagccaggtgtggtggcatgcgcctgtaatcccagctactcaggaggttgaggcatgagaattgcttgaacccaggaagtggaggttgcagtgagccaagatggcaccactgtactcaggcctgtgtgacagagcaagactttgtctcaaaaaaaaaaaaaaagtatggagtgtataccatgctctagacactgttctcagtactttgcatatgttatgttatttaatctgcagaacatctttctgaggttaattaccagaataacccattttacaaataacaaaactggcacagcaagattaaatgacagagctagtgtttaa

SEQ ID NO: 93437 - DNA, 1023 bp, Homo sapiens
gaccagggacctaaaaagacagtccaggcaaaagattagacctgaactagaggagtcatagtagggatagaggggaagaaaaatgtttaagaaacatattggaagtagaactggaaaaactgtgattgatcccaagtagaagatgagggacagagaagaaataggatgattcccaggtttcttttttaggcatctaggtagctgatgatgccatcatcttaggcaaggtttactttaggaggaacagagttggagatgttgagctccgttagggatataatgagttttaggagcctgtggacatccagttaaagaataaatgagagaacattcacatagaacaaaggtgtggtggaggctctcaccagcttaacctagagtccattccaacctgcaaactgctggttgtccccagtccagatgatgctgaactctttggcctggctgaactcttttgtccagtcacatgtcacactggacaggaagtggcttggaactcgaaaccttgttgatacacttttcctcccaaagaggtgatccaaattcctgagatggcccgacctaggatgtactgaaagaggctttgggcagtaacttctaaactgagaatgacttgtggctaaacttgaacccttgccttccagtagatgaaaggtgaagcaatttatctctcgaaagaaaaaatatggtatgattccacttatttgaggtaacagcaagacactgtctcaaaaaaaaaaaaaaaagaagaaaagaaaggaaggagaggaggagaggggaggggattattattattaataataataccattgttatgcataaataatataatttattgagtattcactatatgcaaagtactgtgctaaatactttacaataattccatataattctctcaacagccctgtgaggttgggctacttattatccccattttacaaaaagcacctccagatagtgtaacttgccagaagtcccatagctagtagctgaaggacagagcatttgaaccaagaccat

SEQ ID NO: 93438 - DNA, 1040 bp, Homo sapiens
gctcaagcttggtaattaccctcagctcatgacatttataccaatcagtaatgtttaattatcccagatgattactccgtcagttctaggcacatggtggaatgtagaggtggttcctaccttcaagagcattaactttcagttggcatgtgtggagagatgtggtagatacaaatacattttggaaggggaggggaaggagagttatgttggctggtagagaattgggagaattcttttgggaaagcatccaagaggaggtggttttaagattccactttggaggctgggaatgatgaagaggagacaaaagattccttctgggatttagaccagcttactgttcaaaaagcaacaatgaaggtctgtgaccataatatgttcagaacttcaattcaaaggacaaatagaaatcaaacacttatccatgaaaaagttgtaaaaactaaattaaatatcaagttttttgttttaggtttagaaatgtggttgctgggtgtaataatttggacatgtcatgggaaaatgatcctttaggcaaaatcctttaaaacttgtagctttgaggaggaaagtggagtagtgatggaaccccacataacaaaagggacagcctgttgcttaggcaaaggctgcaagataagaggaacgcgaactggctcaactcaaggattcagaccttggtgtaattcagaacagtcaaatgaaggtgacttcagacttctgtgaagctcacttttgctccaaagagtggtgggagcatagcagaaagtcaagaattggacagaactttttcagtttgactgaagactcagcggggctccacgtaaaccaacagttattgagcctgtcccatcccagaggtacaggataatgcaagatggtccctgctgtcaagctgctcattgcctggcagggaagtttctgagaccaagaaagcccacagtgggatagggacttccgagggttctgtgggaatcagaagggagcacctccctctgcgtgagggagctggggaaggcttgacagagaggccattg

SEQ ID NO: 93439 - DNA, 1050 bp, Homo sapiens
taatttcacagatcaggattttaaagcaaatagaattattgatatatatctcttccaacagccaataaacatcccgcagagaggacagcttacgcatgggctcacacaaagaaaattgcagagtctttgcttaagctacagcctgaaatattaaaattctgattttcatgcgctgttagaaatagttttcaaagaattccttcctccagccccatcacaacccctgcccatgtgagaggttaggagtaaatcatatgttttttaaaacatttgctgaaacctcctcccttttccaagtctaccaaatttttatctcaaaaaaaaaaaaaagaaagaaagaaaaaaatgggactaatatgacaacaagatttttaccttcacagtaaatagtacaatttagctgagtaacttgtggaagcttgttaggttgaagtgactcacttgcgtagatgaagttatttttagagatgtaatttgtactgtttagaaaagaataaagagatggtaaaaggctagatcgctcattatagtttacagagctcatgaacccagcatccatgcaaaagatgactaagcaaggggtcggttggtactttctctcagaattttacagatgtgagtcatccactttagtctgcagacacagcaccgagatacctgtgactcagctctcatttagaaaaagccctagaattcaattctgatacacttttatagttaagtagtgaggaaattacatactgaagcaaaatatgcctttgtaacgcgcagccgtgggatgtttttagcaaagactgatttatcttcatctctggcctttgaaagaatcgacctgtgatccacgctgggtaacgtgcccattgagcctgctggtacacatcacagtgcccaccttcttcgtgtttggctcacaacccaagtactaaattgtcctcaatagaaatctcagcctcaccctttctacacttggatgccccagcactaaggcccacttcctttaaccaaatacatgtacatatatgtgttcgtatatatgaaaatcttctgcct

SEQ ID NO: 93440 - DNA, 1129 bp, Homo sapiens
ttcaaaaacaaaccccagttatctggaaagcacagctgtcagaaatggtttactgactgtgaatatgcatgcttttcttcggattaacaatgattcaatacctttgattgaaaagtatcttattcctttaaatttggatgtacaagtcaggcaactcactcaagtcaagggcttgcctcaacatgatcaccttatgtttgcacagtttattctctttgagttagttaaatttcagaataatatgacaatttaaaaacagtattttaggcagcaatcatacctttatctcaaatgaaatttctaatcagaattgctatcaaagaggaacattaatttccattcccctgctgcctgtcccacccatgctcatagaagaagtaatgaccaaggagctagtcagaaaacagtagcaagaaaacaaaacaaaaagctggacaattcacaggccaaagaggtaatcctaaatatacaaagattgattatattgtgggtctttaaaaaaaaaaaaacactcacaaataaattggttagcaaaaaaagaaagagcctttatcttaaagaaagcacctatgagaatggagagaatattgcatgatcaaagcacaaaggaaaaactgtctgaccgaggtttcatcaggcttcctctctgttcagatctttttctgatctgtggtccggtttggctgcaggaccccatttgaccgtagattctctagagctatgattttttatttgctggaagaagattgtagaattaaaaatgaagagttccaaaggactctgaatttacctcaaataaatagatggacaaaactaagttgaaagcttagttttcaacttgttttgaaagttgttttgaaagcttggtttgtattttctcagctggaaatcaggctaggaaaagaaattatatagactcaggtttgtttgtctgttttaattgcttctaagagaaaagtgagtaataataggtatcatttatgaagacctgctatgtgccaagtattctgcacatatattcattataccatgtaaaccatccaggagccttgcaaggtaggtattatcccattttaaagatgagaaaacctagacttagagagtatagtcagttgcctgaggtcaggta

SEQ ID NO: 93441 - DNA, 1052 bp, Homo sapiens
ggcttcaattacactttgttagacaaatctccatggagaaataataatgtaatcaatgctttttggggactgtggtagatatcaacattaccttgctgctgttttttaaaaatcagaacaactcacttgcccaggtagatacatttccttcatattttgaattatttctgatgctaactgggcatttagggagtcaaagaagatggttccaaaataggtgggaaaaaatcattttttagcatattaaaatattaataccagcaactcattttctacaaaacaaaataataagaacgaaaatagaaggcattccaaaacccgaaaaagccagtagcttgaaaatcacatagcctgtggtattatctgcattgctttggatactgagtgatgactgtatttgctttaaatttataaattattgcaattgagttctactgtttaaaattgttgctttcttgtagggaagctctcatggtacttttctgctggtaatgattgctttggaggttactctcaaccttgttttatatttgcaaaagtgtacatagtataaaacaactgaagtcaaagtatatgtgaataggcttttttttttgagacggagtttttctcttgttgctcaagccggagtccagtggcgctgtctcggctcactgcaacatctctctccagagttcaagagattctcctgtctcagccttctgagtagctgggattacaggtacgcaccactatgcccagctaattttttgtatttttagtagagacggggtttcaccatgttggccgggctggtctcgaactcctcacctcaggtaatctgcctgcctcagcctcccaaagtactgggattacaggagtgagccaccgcgcccagccacgaataggcctttttaaaaaattaatcagaagaggcgcggtggttcacgcctgtaatcccagcactttgggaggccaaggtgggtggatcatctgaggtcaggagttcaagaccagcctgaccaacatggtgaaatttgatctctactaaaaatataaaaaattagccgaac

SEQ ID NO: 93442 - DNA, 1051 bp, Homo sapiens
ctaaagtttggagtttagaggtacaactattgctcatgaacctctcagtgtggaaggcctcacttcagtcatacagaataggtaaatatagaaatatgctgagtgttttttatatttaagactttggtgtctggaacatcagtcttcataaaccatgacctcctagattgaagaagcagtggatcaaaatcatagtttccaaaaataaatcgaagagtgcatgtggttataactttatcgcttggaacagtcatatgcttcacacctgtgatcccagctgaaggatgatcagatccaaagtatcacacaaatatagactatctattaggcctcctcttcatttgctcatccagtatttattaagcatctaccatgttccaagcattgtgctcaatgctaggaatataatgataaacgaattagaaattgtccctgtcttcatggaatttatagcccagcaaagaagataaagcctttatcatatgaaacttctgacaatttcaaagtacctactaacaaaacctggacctccagatctggaatgttcttgattagccatgactaatcaagaacttagtaggacttcctgttcttgcctccccctcccagagagaccccattcccttccatggggcctcctgacctcacctatatttttctgtagtacaagactttcacttatagcaggcttgataactttttattttattttattttattttattttgcgacagaatcttgctctgttgcctaggctggagtacagtggtgcaatctcggctcactgcaacctccacctcccaggatcaagcaattctcctgcctcagccttctgagtagctgggactatcggcatgtgccaccacgccggactaatttgtgtattttgagtagagatggggttttgctatgttggccaggctggtctcggactcctgacctcaggtgatccgcccacctcagcctcccaaagtgctaggattacaggtgtgagccactgcgcccagcctgagattcttaaataatgtcagggtgtcttcttctagaaacc

SEQ ID NO: 93443 - DNA, 1451 bp, Homo sapiens
gggctttccttgtgtatacataggatctgccctaagaagatgggcattatttgtggtacgtgctgaaccagatgtgtctttgtggtttccatggcaaagctatcttggtgtgtatgtgtgtgtgtgtgtttcctaagtagacattttagcaagtatgaattgagtctttaagaagttgcagaccacaagcccgtgatttcagtataggaatatcgtaagtgaagcctgtttatcttaacagattggttcagagtttcaagagacatttgctttatgttaacaccagtctaaagaaaacatctgaagtaatgtttaaaaaatctgctttctactgtagcgaagatggatccattttaaatgtaataaaagagaaagccagcagctcgtgctagcaagaagaaatagtttaagtttccattcttcagctgaactgagtaaccaccctgtgctgtgtcagaaagccagataaacaccgtgaaagaactgtcctgcagtatagtcttgagattggtggagaaggttgaagacaaaggatggaaagagaggagggtcaactgtagcattccttccacaccctgtttctttgtcctgtgaaaatactgtacgtacacagtgcgtaaaaggctataattcacttggggagctctgcccatgacataaacactctcatggtttatgaacagcagtggagccttttgagtggaatcagctgtttattccctcctgtagagcaaaattctaaacaatgtaacctcagaaaggacacttcctggcactgaccagggcttttcctaccacatgtgcttctttctttctcatggctgtctagcagattctgtccctcgcaagtgaagcagcatttacaaggtgagcacaggctttggggtcatgtgtgccccagttgctattgcaaagtctaatcctgcaagctctgtggtcttgggcagagctcttaacctctctgaacctcattcctaaaacaggactgtactcctccctattggatggacttgctatgagaggccagcaagttaacacttggaagaccatgggttttagcttctgctgtgtacctcagtgcctttgctcacgcctttcctcccaccctctttctgccccctcaaacagacacatccttcaaccttctcccatatgggttttcccatccactctactttgccagcagctctctcccctcccagtctcctttgactctaatcacatactgctttggaatctctttggtattttcttttagttcttcacatcttcatatatattttgtttccttaaccaaaccatgagtactttgaaggaaatggctttgcatatatatctttttttaaaattacagtataatttatatacaatggagtggacaggttttaagtatatcttttgacaagttttgacgaagttaccttatagcctctttccaaatagtctcttta

SEQ ID NO: 93444 - DNA, 1034 bp, Homo sapiens
ctgtggactggtcgtcccctcagcatttcaaataagcattcagcagtgacagcagccagtagtgggcagtgtggtctgggaatgtcatcctcctgcccctgccagcccctgggggcccacagacccagaaaacgaatgagaccctgcccatcagcgaagcacacagtctaactcagaagttttgccacacacattagctcacacagctttacagcagacctgggctgtgagcaactgaatagggttgcttttgttccacagatgaggaaacagaagatgagagaagttaagtgagttacccacgatcaccggccggtcagggccggagccaagaccaaatccaggctcttggctcccctccagcaacaattctcacgtgtgtcgatactctcgtgaacaaactgaagcttatttttttatttcccagtgaaggatgatggacgttatataggtttgtgaagatggaaatttatgattatttttaaaagactttcagcttccttgccacaggggaggatttgggctggttttcttagaggggattcagcacaaggtgacagtcaccactgtatgtttccagaaccagggactcaaacaccagggtttgcgtgattttatctttaccccgcaacagcaacagaagccggtggcgcctgtaaacgagtgaaggtcacctgtatatttgtaaatacttcctgccggttcagcctgtcatcgagcatcgtacctgcacacagagggcagcccaagactaattagtaaatggctataaaatgctttgaagatgaaaagaaccatatgtgacagcatattattaatacttagtaaatcctgtctccggcttactcagcccttgtaatttcagttgaatctctcttgcttagcactgatgaggaaaaggactcacacgtgtttaccagcaatacttggatatgatcaagcatctgtgaggccccgagaaggaggggcaagggaccctggttagccaatgctcagcttcttccagcagcccggcttcctgaggacccatcgcc

SEQ ID NO: 93445 - DNA, 1035 bp, Homo sapiens
tgaagaatggttaaattccttatggaaggctttggggaacatcccaggttcagtaaaaatacagagtatttgcgttaaactggacctcagtggggatgtgatgggaggtatgagacagattgtgcccttatccttttctcttcttgggagccaatcttctaggatgttggaattgtcccttttccatcctgggaatctaaagaaagggttcttaaagggaaagaacccagtcccttcctagatacactcaatcatacctgcttgcctggcaaggcagtttacagagtccacagggcttcatggcttgaatgcttgataacccagacaaaaatctatctgatggagaatcgcctggccaaggggctgggccaagaaccccaaccctgacttccatctcacataccagttctgcccactcacgagtctctgggataagccctcggccccatccggtcctgtaggggcccaaaccctagttccaatacctgtcagcaaaaagccatgggttcatagctgaagccaaggctccagtatagagtctcaggaggcagttttcccaaatcagcaactgttgtggggggaacttctctgacctgctgaggtttggtggccctagagggtccgtgttttcggccgtctttctcattggcagtggaaggagcacacgcatccttcccaagcagcccggtggcaccctagcaacagggtacagcagggtgatgggagtttccatgcccaaagaccacaaggcttgtaagggtttgaacgtcggctcagggtctggaggttcaagctgataagtgagagcccgtctcctcggctacctgggttggaggaacatctcagttctgactttttgctttcttatttcctctgtattcgtttccctccaacctgagcatgggagatgagaatgaacctctgggacaggggttggcaaactatgtcctgagtatttttctaaataaaatacagtggcacagtcctgcctatttgtttacatgttatctagggctgctttcgcactgcagtggc

SEQ ID NO: 93446 - DNA, 1015 bp, Homo sapiens
tcctgaccccgctgcttattagcaatgtggccttgaataagttacttaatctcactaagcctaaatttctgtccctaaaatggagctaatggtcgttcttcactcagagagagaattagtgagataatctaggtaagccatggtgtctgacatttagtaagtgcccaggaagtgttgttagctattgtcttcatctcacccagtttttaagtggggaagaaactacttggagaagctttatgtggacacaggagtcatctgaagatgaaggttcacctgggttccattagggggacttgcctctgaaaagctggaagtagggggctcttctctccttcccgcttcttgcagtttccagtagctgccttggagaaaggtcaggaccagctgctaaggagcacagcccattttagtttctatactctgtcatcatcttatattttaaatagaatgcttcctgcagcatgttccagagagctctgcaacgtggtctgggcataaattaagaagcggggagaaaactgcactagcagcaccagagtttcccacagaaacatctgtgaacatagatcaatgcctatgtagctgggtagagagacacactcagccagtctgccccaagcaagatgctgatgatgggaagggaggagggacaaggacagcaagggatgtctggctgcaaatgccgctacttgttagtctcctgggttagaggacatcttttcacggacctggctgtgccctgatggagtcatagctctgtcctgaacctctttggaaagtgacaaaggcagacacagtatgctcccttggtgatctttgttggtccaaggctactggtgtgcaaatcccttcaaggtgtcctgagctggtaccctgagaaacagttggcaggcgactcagaggcttaaaaacccaggtgccacatcctgcagatgtgtatcctggagagctgccaagagggcctgccgagtgtgagtgctggggaccacgtctatcttggaagtcatttgga

SEQ ID NO: 93447 - DNA, 2084 bp, Homo sapiens
tgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctgtttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatg

SEQ ID NO: 93448 - DNA, 1017 bp, Homo sapiens
aagggctttgtcagaggaaagggtttcggggccaaagcctggacagagctctcttggaggtgtcacagaaatctgtgagcctaccctaacacccacccccagaaactagtcacaatggactctgatgccaggcatatgctctgagcagattactttgcctgtctgtaaatctcacttaagacataggttataagcaggctcactctgcgtcccagttgtcactgctatgtcactgctgtttcagagtcctgctctccctcccttcctcagctgtgccttttgggctttaaactctgcatccttccagtgtcctgggaagagtaccagccctgggaggggaggccctgagtacgagcccggtttcctccctggcctctctaagcctcagactctacgaggtggggctggttaggaacctctcccacagggcagtcatgaagctcaaatgccatattggatacgaaagttctggtgagctgtaaatagtgtacacgtgacacacgttggtcaaaatggtggtcctggcagtaatgcagcaaggtggcaggcccacctcgggggaaacatcagtgagcacggccatcactgtcatggtccctgggcacggccaggccggtccccaagagtgggcaggtcagctttcctaggtcccatcccttcactgcattccaagattccagggccttgagtgctgcttgaggtttgctgcctgggcagagagcaagtgaatgccatacctaatcaaggaaaaataaaactggatgatcctttctttcttatactatttgtatttatttttaatttttatttcaacactttttggggtacaggtagtttttggttacatgagtaagttgtttagtggtgatttctgagattttggtgtacctgtcacctgagcagtgtacactgtactcaatatgtaatctttaatccctcaccccccccacccttcctctctgagtccccaaagtccattatatcattcttttttttttttttttgagacagggtctt

SEQ ID NO: 93449 - DNA, 1513 bp, Homo sapiens
ggagggtgagtgcgcgcctggccgcgggacagagggaggtcgggcaccgccgccgacccctgcgtccccgtctgccgccggaacgcgaggggacccctttcccgccccgagacgagtctctgggagcgcggcgcggcggacgaaccgaggagggggcgaggaggctctgggcgcgggggagcggcctctgggagcgcggtcaggggagatcgggggagagggggccgttcccgcggaccctcgggggccaggcccgccggccgaaggctgtgcggagcgggtctgcgggagacagcctttcggaaaggccgccgggctccgcgcgccgtggtgctcgcctccggtgacccgaggatggggagaggatgcctgccactgggctttgtgcgtccgtggaatcactgttcttctctgttctctttgtgcattgcccttggctgcctccgattgtcgttccgggagtgaattttacgtatatatatataaacctgtccttaacaggactgcttcgtctgctctgcatttttacacaatgctatatagaatggattcttcttaaagagaggataaaattagcgggaattaatctaccgtttgttacttggcctaaaaaaattgtaagacaagatatttgatcaggttgaagatgcacctaagaaatgtgatgtatgtagatgggtttgctgaagggattggcttttgcatttgatttgagcagagcttaatttctgcacaaacttagtgaaaatctatttttaaagcctgtcttgtattcgaaaggtatttgtaggtctacgcagcatttgaactttccgggctcaagtgttcttattgaatagttttatgttggtgggaaggcaaggggggaaaacgaagaggtggactagccgggagttaaatgtattgattcattgcaggatattattcaaagttaaatgcagtcttctgccaaacagtccctctaccctaaagttttcgtcatcaataattgttttgtgagtgtgtagaaaagcctttaatcctttttaaacaatttagaggcctctttgttagccgccgtccagcgattgcatatgtactgtttgctttcaaattaccttaagataattgctagagtgaagcagtatgtacttatatttggaaaatcatcaaagaatattgtaatgggggaggggtaattcctttttctcaaagtatgtgtcggtatctcaaacccaagttctgtgagtacctgttctgtaactaaatactgtgtatttgctccagatgtgaaagccatccagcagtcttaagactgaataggaagcaaaagttttaccaggaactcttatttaccttttcctttactatcaagttattcctgggaggccccctggtgcctgcagtcagtgttcactacctaagactttgtttcagatgtgaacatcttgctgggtctttgagaaatttgctttgaaaataattgtattttgtaactgttttatgagggaaatacagttaatttaaaaatgtg

SEQ ID NO: 93450 - DNA, 1055 bp, Homo sapiens
tgccaccacgccccggctaattttgtatttttagtagtttcaccatgttggcctggctggtctcgaactttccatcctcaagtgatccacccgcctcggcctcccaaagtgctgggattacaggcatgtgccaccgcgcctgaccttgatatgatattttcaaagagtcctttaggtcattttaatacaaacatgccatttaatgtaaaacagaaatattgattttattatttggacggtgcatattctttcggtatgttttcttggattaacttttgcttagaactaaaaaccaaagacttctactttatcccctgtagtgaccctgttggccacattcttgtggcttaccatagtgttttgatcatttaaattgaagctagtttgtatgagtattctggaaaatccggtaaaagcttcttacttagatgagtggttctcaaagaggggtgggaaatgggagtatagcagaatcatctggggaacttcattcaaactataagtgctaagtttattttggaggaagtgaagtggaatgagtagaatctaatgcatttgggaggaggttagtatggaaaactgctgctgggtgaataagagtgccagctctgttcccaaccacagtcttgatccaggtatttaaaaactgggatgtgccagttgatatagtatgtctattatgtgtcatatatgtgataatatgaaactgtttagaatttgctttttcctgattatgaaagggcagcattctttcaagaagtcccctgtaattccacaatccagagataaccgttgttgaaattttgatatatttttgtttaaagatacttaacatactttgtaaaattcacatgctttacatcattagaatattctttacatagctttatgagttaatttttcatgtagtattacatcatgaacattttcccttgtcattgaaatgtcttcaaaaataccgaaaagcgatttgctgtgtgatagaaaagtttttcttaaagtattttttaacatattaccacgaagctgaacttgactattacaatatgagttgt

SEQ ID NO: 93451 - DNA, 2946 bp, Homo sapiens
gtatctcccttttctttcttgtgaaacaggtatagtactcttaagatttagttaggctgacagactacacttttaacttttcctattcaagacaggctggaatgcagtggcttgatcatggctcactgcagcctcgacttcctggtctcaatcgatccttctgcctcaacctccctagtggatgggaccacaggcacatgacaccttggctggctaattttttttattttggtagagacggggtctccctatgttggttgcccagtctggtcttgaacccttgtgctcaagcaatcctccagccttggcttcccaaagtgttgggattacaggtgcgaggtgctgcgcccagcctgtagtgtccttttgaaggttaaaaaaaatgaatggatttgaaaaatgaaatcgattaatgaaagcatattaaagccctccattttaaaatgacagctttatccagatataattcacataccatacagtttgcctatttagaggatatgatttttagtatactatagagttgtgcagccatcaccacagtgaactgtataatattttcaaacacatataccccccaaaaaaccctgttcccggtagcagacaccccatttctctccattccctcccggcccccactaatctacttttttttgtctcttagatttgcctattctggacgtttcatgcaagtgaaatcatacaatatgttgtcttttgtgactggtttcttttaatgtttttaacattcatctttgttgtagtatgtatcagtactttattccttttatggctgaataatattccattgtatgtatacaccacatttttaattcattcatcagttgatggacattttgttttctttcggctattgtgaatacttgtagtgctgctatcaacatttgtgtagaagtttttttttgtgggcatatactttcaattccgttgggtatatagctgggagtgagatttctaggtcatatggtagccctatgtttaactttttgatgagctgccaggttgtttaaggcctctttactgattaaattgtttaattctgacccagcaacctaaaggttaggtggttggaaagaagtgtcagttgttgccgacaacctccacttctgtagggaaggtgttttgtgtggatgtgcagctagacttgttagaaaaaagagcatgttggggagtgggggagatcacccgaggaatattttatctccttgattcttctggatgagatactagaggagacataaggtcgtggcatattttttaactgattcagagattaggtgtttgttttctctgaattaagttcagcaagtaagggaaactgacagtttgaagaagtagcccagaggtgtttttattttgctatctgaatgcagacctggagcttttctggtaaatatctaaatccaagatgaagattcgttgggatttaatacattatttaaattgagtctagagacaaagccacattaagagtcaggattagtggggaagatagttgcatctagtaggtctttttcttccttattctccacgtttattacttttaaaagagtatacattccaatgccatgcatttttaattttttttaattaattttttttttttttggaggcagggtctggctctgtcacccggttggagtgcagtggcatgaacatggctcacctgcagcctcaaccttctgggctcaagtgatccttctacctcagcctcacaagtagctgggaccacaggcatgcaccactaattaaaaaaaattggtagacacagaatcttactttgttgcccaggccagtctcagagttctgggattacaggcacccagccccattttcaaacatttctaacaggtaaagtaatacaggtatgaaggaatgttaagattcttagaaatactgacttaaattctgttatgtatttctgaaaggttattctcgaatgttggtggcatatagggaggcaaggggaagaaatagtttgtaaatgtcagtaggtttagcagtggtgtggtagatggggattcccagtggagtcttctaggatttgtgattggatacagattgatacccttaggcagcagccactgcttctagcagctttaaatagccatttcaaggcttattcaagtataaataaccagtagccagttttttcctgatttgatagaggaagtcagtccttggtctagatgggtacttgtcatacagtaggaaaaagggcgggggcagttgtcctttattctgcctctgcactattcacatgtggagcacagtgatttgtgagagtatgtataaccttcgtgaacatcactggcctcagaaccctcccttgccaaatttacctgcatctgtgcaaagacaagtggagatattgatgatatgtgcatatcccagagggaatagcgtttgctttttgatgcatgcccacccttgcataattgggaggttttaacatagcatatttcaccataaaggaattttattctaagaatgttaatcagaatatccctaagtaacagaagttcccatctggtcagttgcaaggtgaccaaaacactttcttggtttgagtatagtcatatgttctgtcaaatgatgttttggtcaacagtggacttcatgtaaggtagttagtggtcctgtaagattagaatggaactgagaaattcctgtcacttagtgacatcataggcataatgtcatagtgcaatgcattactcttgtttgtggtagtgctggtgtaaacctattgcactgccagttgtgtaaaagtacaacaggccacgcgtggtggctcatgcctgtagtcccagcactttgggaggccaaggcaggtggaccacttgaggtcaggagttcgagaccagcctggccaacatggtgaaaccccatctctactaaaaatacaaaaattagctgggcttg

SEQ ID NO: 93452 - DNA, 1014 bp, Homo sapiens
cattaaaatccattgatctttcttgtactttaaatggatcttacacatgactttataatacgcgttgttcatttggataatattgattcagctgagttatgcagatgtccagatgttgaaacagcttattatctaatacagtatccagaaatgacatttgttaatgttacaagatctcatcagaagagtccttaattatggagaagctgtcagattcatggtgctgattacaaggtttctagaattttagtttgtaacttgaaagcttgaattttatcattggcaacaagtactgtcagttgttttccttgaaatgacagggtcactttgttcatgttcacgtgtatctgttgaatatctaagtctgaataaccatagtttgtcagttaatactttccagtaaaagtgtttagtgaaaaaaagtgtctaggtctgcttggaactaaaacagtcacaggagtgctttcctttgcgacaaccattgtactttgggatggagcaggagtgctttgtgggcatttccattttatcatgtagattattaaagagatgtattcaaagattgaagtttaataaaattgatcatttgtactgctttaccaaagggcatacatgaagctgccttttttgtgtttcactgcatgtgtgttgcaatgaacaacacagtgactgactaccagtggggtttggtgccactgacttggtgtgtactgagacacttaacagttttacccatccttgcttttgtattatcaaagcagatgtcagtgcagtggaaaaaaaaaaagtcctttattcctgaaatgtctagccctcacctatatctgtcacttttcttcttcactcttttctcattatacttgctatttgtttaccaatgtacctgaaatgactttttacttatgctttgtgaattcatgaaagccatgggccttctcagaaaaatatttttacatatacacaatattacagacaatttgtggtactatacagagccactaaaggccattttgg

SEQ ID NO: 93453 - DNA, 1525 bp, Homo sapiens
tgttgcttaaaagcaggcttttgtgctaaatatggagaaaatgctaggaaaaaattaggatgtctagatttaactgccattaattagtatgtaatcttgggggtgggggttgagtaagagttagaataccagtggtcagtgaagattactaagattttatgaggccaaggcgagtggatcacttgaggtcaggagttcgagcctgggcacatggcgaaaccccgtctctactaaaaatacaaaaaattagctgggcatggtggcacacacctgtaatcccacctacccagtagattgaggtaggagattcacctgaagccaggaggtggaggtttcagtgagccaagatcatgccattatactccagcctgggtgacagagagaccctgtctcaaaaaaaaaaaatttatgagacaccgtgcataggtgttggaattagtgcttttttcttgccatcttttctgttttagagaggtaatgataagtaagaacttgctggggaaagtagcataaggttagtgaaaagtaaaatttagtatacacacaacacacagacacatatatatcacatacccttggatatgtgcgttggaaagacaaacctgcaatggaaaagtttttacactgatataaaatgtgaaatataatggttgagtaaaggacagaattcttttgggagaggatacacattttgcttaattgagattcaaagttaatgttctctgtcatcaaaactgattgcaagtggtcatctcttgatgctgatctgtagtgagattctatgtatttcatcttagaagatgtctttttacacagggacatactgcatattcatcacttggaaagcatttatagaattctcctgatacttgcctttcagcatgtcattacattgcagattaatcacttccagtagagggttaggtggaagctcctcggctgcacagttaaatggattttgatatatggaaattttttttgcgcttgagtcaaggtttgaagaatgctagtttgagtttgaaaaaatgtatctgctgcaaaattgtgtgggaatgaagatctcacttgtcttaacttggcagcacgggttatgtataaagcagtttgctgactgggtatggtggctcgcgcctttaatcccagcactttgggaggcggaggcaggaggatcacttgagttcagcagtttgagacctgcctgggcaacatagtgagaccttgtctttatagaaaattaaattagccaggtgtggtggcatgtgcctatagtcccagctacttgggaggctgaggcaggagaatgtcttgagccagtaggctgtagtgagcctcattacaccactgcactctggcctgggcaataaagcaagaccacatctcaaaaagtaaaaaattaaaaaataaagcaacttgctttaattcagacagtattagttgtcagaatgacttaccacaatggaagtttctcatatatttttttgccttataattttaggctgaatttattagaaaacatttaggggag

SEQ ID NO: 93454 - DNA, 1248 bp, Homo sapiens
tgtaatagccccaaactggaaataatccaaatagagtagtaaagatattgtcatatgttcatagaatggaatacaggttgaatattttttatccaaaatgcttgggaccccaagtgtttggaatttggatttttttcagatttttgagtatttgtattatacttaccagttaagcatccgtaatctgataatctgaaatctgaaatgctccaatgagcattttctttgagcatcatattagcactaaaaaaggtttcggttttggagcattttggatttcagattagggatactcagcctgtatttcaaatgactgttaaacacaattatatggatgtatctcacagatgcaataatgagcaaaagagcattcttatgtttctttttatctaaaagtctaattcacaaatacatcaaatcaatatatactgatagcaataaggatagtaacctcaggcattactgtcattagttagggtacaagggaatcttcagggttgcaggaagcattctgtaccttgatctggatgatggttactcaggtatatagatagtttaaaattcgttgagttacacccataaagttagtatactatatgtatgtaatatgttaaaatattttctaaacagtagtaagtatggtagatatttgctatcatgggattttatctggtctgaaattactacatgctgaaaatttctaggaaatttttgatccaaaaattttatgtggtgaagtggaaaaagtactggcctttaagttagaagactaagtctgaatccctctctgctgcttctcactcctatcagtcttataaaacctgggcactgtgatcttatgcgagttattgaatctctgtcattgtacagtggaaagaatagcttctcttttcagttcctggggtgtgaaaaggattaaatgaaatgattgatgtgaaggtgctttgcacctaatgaagtatgctgatttataatatttttataatccagcagcgttcagatatccaaacactggaatccctcatggatgctgtgatagcagtctagttgccctgtgtaacaggttgcccggatgatttcttcctttttttcagaagtcttgagagtacataaaggagcaggacttttgaattggaagacagctgggattgccctgggacatctgccttattctgtccaacctttggctaatttatttctaatttctaaaactcttgtcagagttttaaacattgggaaaacctttag

SEQ ID NO: 93455 - DNA, 1833 bp, Homo sapiens
cagggccttgctttgctgcccaggctggtctcgaactcctggcttcaagcagtcctcccgctttgaccccctaaagtgctgggattacaggggcaagctactgctcccagcctattttcttttcttaaatgctctttcacttaagattaaatgagagctcagctgtaaatttaaggttaaagggagtcaggggagatggtgatgagaggaaatgattacaagttgagttcagtggggcaaataaggaactcttctgtctctccatgcaacattctgttccccttcatcccacaagttactggaaaccatattatcttatggctcagtaatgcaaagatgcctcactccatctaaatagcctttagaggttttaatataatgatctattgggaatgtaacgataagttaatttttaatacatagctgatatcttttttgtatttcttttgatcagaaagtagagataggagttgctaaaattttggggactgctggtaacattccaagaaagtgtgtgaagctaaatcacctactgacaattactatttaatctccctttcttcatagcacattgttcttaatgaggctgttttgacatcctactagatgcgagataagcaggccagaccttaaagggtgcgggctctgaaatgtttttttgtgtgtgttttttttgttgttgttttttttctgtttgtttgttttttttttatttgagacggagtctcgctcttgttgcccaggctggagtgcaatggggcgatctcagctcactgcaacctctgcccccgggttcaagcgattctcctaactcagcctcccaattagctgggattacaggcatgcgccaccacacctggctaattttgtatttttggagagatggggtttctccatgttgatcaagctggttttgaactcccgacctcaggtgatccacccacctcaacctcccaaggtgctgggattacaggcatgagccaccgtgcccggccctgaaatcttttaagtctctttggctactaggccccaggttggtcacaggacagcaaaaaacaggactgcatttcatcaacagcagacttgaggagcatcatcaggaaccagtaacaatgaaaatagaagtcagagatcatagaataacattattttaaaccatgggaccaaatagggtaatttgctgcctgtgtgacttttctgatttttaaagtatgggcatgactctttttgaaagattattatgagtaaattttagaaaactgactgttttatttatcgtttgtcagtacgaggatgtcgtccaggaaagattgtgcagatgactgaagcagaagttcgaggcttatgtatcaagtctcgggagatctttctcagccagcctattcttttggaattggaagcaccgctgaaaatttgtggtatgtaaatgggtaaagttggaaacaactcttttgaatcatgtttttcctcccatgtttaagatctagagaaaacattttttgaaatttttgtataaaacagatcagtaggctttactaaataaaagtgtataaaaattgaaacttataaaaatgacaagttacagacaagatgaaaatacttgctatatatcaacagataaaaggagttctatttataatatataaagagttcttataaataagagaaaggcgatacagtataaaaataacataggaagaggaaggtcttagaagaaattcaaatggccagtaaacataaggacgtcagcttctttttttagtaatcagtgatgtgcaatttaaagcaagtctccaactctagtcagattataaaaaaataccaaagattgat

SEQ ID NO: 93456 - DNA, 1102 bp, Homo sapiens
ttaatttaccatctcacaatttctgtgggtcaggaattcaggaacagcttagtgggtcctctggctctgggtctctcacaaggctccaattaaggcgtgatctcgggctgcagtcatctgaaggttgaactgtgaaaggattcagttccttatagactgatggactaagagcctcagttccaaatgagctgttggtcagaggcctccctcagttctttgctacgtgggatgcttcattagacagctggtttcatcagcgagcatggaagaaggtgagagagtgcaagcaagatgaaagtcacagtcttttgtaacttaatcttggaagtgacagcccatctcactttcgcttattagaagtaagtcaccaaatatagcccatactcaagggtaggggaggattacacaggatgtgaacattgggaatcatttcatagaagctgcttataacagtaaccaatttttctaaaactgactctttctctttttaggagatattcatggacaatatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgtaagtgaaaataaagacttagaaaagtaattcatggaaacattgcctaataattttctggttcagaagagttgctttgattcagagttttttcaaaataagatctgtcaggcataggccaggaagaggaacctgaaactgggaaacatgttactaattaaattggttccttgagatctccttggtcatatttcagattgactgcagcttacttggctgaagaggctcttttaaaattagtttatctagtaaactatccaggtgaaacagaagtcactgtaggcagtggcccttggttttctagtgtccattaaggttttaactctcggcattcttgtggtatgacagcttttattagtcctgtgtcacaagaattattg

SEQ ID NO: 93457 - DNA, 1049 bp, Homo sapiens
ttttttttttttttgagacggagtctcgctcttcttgcccaggctggagtgcaatggcacgatctcagctcactgcaacctccgcctcccgggttcaagcgattctcctgcctcagcctcccgattagctgggattacaggcatgtaccacgttccctggctaattttgtatatttagtagtagagatggggtttctctgtgttgatcaggctggtcttgaactcccaacctcaggtgatccacccgcctcggcctcccagagtgctgggattacaggtgtgagccacggcgcccagccatgagcttacattctaatagaaatgattctgtatttgattttgtattgtatttttatttctgagatgtagtgtgtggtttgaattatttaaatcagactagcagagagaaagtgggttggagtacatcaaactacaacattcttcctaaagctacatcagaaatggaggtatatttttaaaggataaaagataggcaagaatgtctttggggatagaaatgacatcaaatgaaataatgtatgggagagcaacttgtaaacagtgctttgagttatgtacttactcattaaggggcaggttgtggcataaaagcacaggaagttagtacttgtgtctttcatcccttccctagcttagtagttgtaccttattaccaaattcaggaaaatcgagtaactctaaaaaggtgaacatacacttgaggttgtctttgtcgtagctttttatgctaggctacaggaaaattatagcctttgtgcctctatttatacttgctatagtgccaagttgtaattcacacaaaagaatactagttaaacacttggaaattttccttccttggcaataagtttatactgtgttaatcaatgcattagtgttaaaatggacagtttccagaggcaccttttcacttctgcttgcttatttggctaggtatttaactagtccacacactgaacggaaaaaaatgaactaagagcctattagactgtttaaaaattgctatattatactgatcttaaaagaca

SEQ ID NO: 93458 - DNA, 1017 bp, Homo sapiens
tgtatatgtctaacacctagctagtagatagtgtatgatctgaccatcttgaagagttaaaaacctgttgctaagatacatttatgaaacagataattgagtaataaaaggtatttaatatgtcagaacttattaagacactatgagaagtcaggaggaggaaagactgggtacatgtgtgtatggaggcatgggttttagaggataaataggctttggagaagttaaaaggacttgagacactctttgttgtctagtttagggaatgtgtaagaactggcctgactagaaggtcaagtacatgctgggaaatgatggaatcagattatggagatttgactattgagcaacggagtttgttgagtgatttaataaccgtattgggtttttgtacagggaagtaatttaatggaaatagtgtaagaaaattagtttttcatcaatatacgggaagaattaaagtggaaaaacgctgaaaagatagatgcacttgcctaggcccgaggtaataaatggtttattctctggcagaacataattcactatattaattgaaatatgttttccagtagacattaaacacgtaatgaattgtagttcttgtacattagtgtagctaaggatagaagtgtagcagtatggatacgaatgtttagcttcattccttgtgatgatacttggattgcctatcagagagaaataatagcttatataccacttcaaagattgcagagtatttttatgagcttttcctgttaatccttctgatcaatagtttatgacttcatgaagataatgaacatgttggagtgggatgtgaaaagaaggtcttagggaaccaagtgaggcactttcacttagaagttaaaatgtttaagattagtggtaagaactggcaaaagtggtaggaagggttgcagttgattatgtttctatgaaggccagggaatgattggaaaaaagaatggtagttttttttttccttgggaagtcttttgaaatataaaggaatttcat

SEQ ID NO: 93459 - DNA, 1034 bp, Homo sapiens
ctcagcactttgggaggccaaggtggttggatcatgaggtcaagagatcgagaccagcctggccaacatggtgaaaccccgtctctactaaaaatacaaaaaattagctggatgtggtggcgcgcgtctgtagtcccagctactcgggagactgaggcaggagaatcgctcgaacccgggaggtggaggttgcagtgagctgagatcacgctactgcactgcagcctgggtgacagagtaagattctgtctcgaaaaaaaaaaaagacgttaaaaggaacacttttcagtatctttaatttcacatagtgaatctattttgattaaatgctttttattcggtgactgttaaaatattaaaatttttagctgttagtactatgtctcatctttttatttataggattgtcaccagacctgcaatctatggagcagattcggagaattatgagacctactgatgtccctgatacaggtaagtgtagagagaagtttaattgttttgtgtaaagtgttttcatatttgaacttgattacatttagtggaagtaggattggcttatgtaataaataaaagagcttttttcatagtcaataagccagctacagattactttatttgcagtaatacacaatttttcactttgcactgatcctcaaaatgcggaacctttttatttatagtcataatgtagttatttgatcacaaaaaagattttgctgttgagtccttatacctatttttctaaattccctcattcatactagcattggttatgttcttcaaaaatttgttaaattagacaaaagttttttaattaaaataatctattctttgcttcttaggcaaggatacaactaccttcttttcaaatgtctagtagttttttgttattttctatgtcctctatttgaaatttttagagctttttttcaagggggtgtgggagggatttcaatctgttgcccaggctggccttgaattcctaggctcaagcaatcctcctgcctcttctgagtagctaggggactcca

SEQ ID NO: 93460 - DNA, 1029 bp, Homo sapiens
gaaacagtggaaccgtaaggaaaggatgaactgttgaggaaataccactgggttgtttggttattcatatggagaaactacccaaaagatgaacagccttttccatgtattgttgtgctgtaagtgccatgcacatatttcctatatgtggaaagggttggaaagtactaccttaagaggccatggaagattatatttgtatggtttgtatggttgctttaacaaaagtataagttacataggctggaatacttaggcaagtgatggtcattgtttagtaaaaggtaagagggcaagaaaggaactgaaatttgatgtagatgtgctatattctataaatctgtaaattttgttcttaattgctgtatttctgtcctttaaaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtatgaaatataaaactcttaagctttttcttttttctttcttttttttgggggcagacggaggggcagacagattcttgttctgtcacccaggctggagtgcaatggcgcaatctctgctcactgcaacctgtgcctcccgggttcaggcagttcttgtgcctcagcctcccaagtagctgggacgatagccgtgtgccaccacacctggactcttaaacatttattatttgttaacttcacataagccctctcattttgttttgaggaaacatatccaagaaagctaaatgagttgtacaaggaaagcagtaggagaggtggcagagccagttcctggatctcacacttaacaatctagtgatttgttaaccttttatcaccctaaaagaggaaatgtttagaaatattttggggctgggcatggtggctcacatctataatcccagcactttggcaagctgagatgggtggattgcttaagtacaggagtt

SEQ ID NO: 93461 - DNA, 1050 bp, Homo sapiens
aagaagtaagctcttcgcaaagtcgttcattgtctggttgttgctcatttaattaaggattctgtagttggattataatgccctcatcaaagtaataattgatgtccctctgaaaaacacgtagattaattaaaataaaattaaatttaaaacttaaaaacaaaaaaagtacttagtgtcccagctccctgtagtcatgatgcctattagtatgttttgtttcatggggagccttgcaaatggcatgatttttaagctttcaggagtggtgaatttattattccaattaagctaaattgtttccattatagaaaaggcacaccagttttaatgttctaagcaaagtttaagaataaaaatcacaacttccaaaacaaaacagggtggtttgggggtgaggtggggcacagtctttgccaccttaaccttaattagtatagatggttcagaattacccaccaataaatgttttttcttctgacatttcctttgacaggtggtggaagatggatatgaattttttgctaaacgacagttggtaaccttattttcagccccaaattactgtggcgagtttgataatgctggtggaatgatgagtgtggatgaaactttgatgtgttcatttcaggtatgatgtaaacataaatatataagaactagaaatctaataaaaactattatcagaattcgttttagatttgtgaagtttccttgagcaagtgttgaaagtctgtttaattcagaagtgattaccactcaaactcattagatatttctattttcagtcacaaagtttccagcatttgtggtatatatcaaatatgaccgttttagggaacctaagttacgtcagtcattcttgattcagatgttttaattgttaaaattcctctatgaccttttgaatagtggcttactaaaagaatgtgaatgtaatgaatagtttaggcttttgttttcttttgcaaagtaaatgggtggaacagacactgggaaaagaattacaaactcagatgaaaataaagtaaaatagttccctggctgggc

SEQ ID NO: 93462 - DNA, 3541 bp, Homo sapiens
tactttgtacatatttctatactgttttagttttggaaaatcatgacttttttatgtataatgtaggttaaagctctatttacatccaccagaatgagtgtagtaaaaaagccagactgtatcaagttttggcaaggatttggaggcattagaatcttcatacattaatggtgggaatagagttctcatatgatgcagcagttttacctctaggtatatacccaagatatatgaaaacatgttcacacaaaaactgttacataaatgtgcattattccttatagccgaaaaagtcacacaattcagatgtccatcagctactgaatagataaactgtggtacatccatacaatggactgtacaatgtacaactcagcaataaaaaggaatgaaggactgatacttcaaaactggttttgaaaacctgagtgaaagaagccagtcacaaaagaccacatattatatgatgccagttatatgaaatgttcagaataggcaattctatagagacacatagtagattagtagttggttagagttagaggatgtggagagcaggaatggggagtgactgctgatgggaacaagctttctttttggggtgacaaatgttctaaaattagatttatatcaataaagctgttttttaagtaaaaagatctatttatacataaataaataaggtctgaagggtttgtgacttgtaggttagttaccctcctaagttactgtatcagaattatgatgacaacatagatcttctgactcttaaaccagtgttcttttcctcacaacagagatacactaagttcaaaaagttttttacttaaatctaaggattggatagttgatagagttagtgtacttttgttattaaaatatgagtggaatgacaaagttcagacatttgcacactttaagaaatgtttatggaactttgctattctacatttttattgcatttttgcagtttatgccatttattgaaaatcacaattgtaacaattttcttaacttctgtacatgaaaaaataacattatttgttaataatttactttaagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaatgattctgtaattccagtgtcact

SEQ ID NO: 93463 - DNA, 1426 bp, Homo sapiens
cttgtgtatttttagtagagacaggctttcaaccatgttggccaggctggtatcgaactcctgacctcagatgatccacccgcctcggcctcccaaagtgttgggattacaggcgtgagccaccgtgcctggccagaaacatattcttaaataatgcaaattccaaatgtattctgacctatagattggaaaaccatttcacagatcacaatgaatataaactaaagtcagtggaagaactggaaaacaactgtattcctttgtcacagctcagtgtgtttagtaaaagagccagtgaataccaatggtatcaaatacgaataatgactatgttatagatataggtccacaaagactatgtttagagcattttccacaagttgttcaatgtaaaagggcaatgatgatggtgatttttactatatattaattgaaaatttcagagaatattctggttttaaaaaatatctaagtcacaaagaggagaatttgggataatttatatggaagcattctgaaaaatgtaaaacatgcaatacaaattgaagaggaatactccaagaaatcttggccaggcgcagtggctcacacctgtaatcccagcaccttggaaggccgaggcgggcagatcacgaggtcaggagatcaagaccatcctggccaacatggtgaaaccccgtctctactaaaaatacaaaaattagctgagcgtggtggcacgtggctgtaatctcagctacttgggaggctgaggcaggataatcacttgaaccagggagtcagaggttgcagtgagtcaggattgtgccactgcactccagcctggcaacacagcgagattccttctcaaaaataaataaataaataaaaaaggaaatcttaggcatatagcatgataagtgaaaaaaacataaaaatatcctattaaagtaaaaaacatacagcatttatacaggaaggcctattcaaagatatacataaggttttaaatagcctctgttttaaataaggtgtaatgtatataatagataacacaacaatcacttagtagaaagtatacttacagagcaataaagaaatttatcctggtatgctcacttatagtaaatttagccctcttgaaataaacaaaggtcatagccaaaagatactataaggaaaaaagttaaaaattaatattaatgttttgctttcataaataaaactgctttaaaatagttaactttaaaattttctgatgaataagctaaaacaataaagtgttacttattatagaattgtgtacttaatttttggattcctgtaatccaccatgtgaacagtgaaaagtaattcttgactatttattatatcattataaactagaatggactcctaaattttattattgccaatagtttgagctaaaatcccacttttatctaat

SEQ ID NO: 93464 - DNA, 1884 bp, Homo sapiens
ggttcaagtgattctcctgcctcagcctcctgagtagctgggattacaggtatgcgccaccacacccggctaatttttgtattttagtggagacagggtttcaccatgttggccaggctggtctggaactcctgacctcaagtgatctgcccccctcagcctcccaaagtgctgggattacaggcgtgacccacgcccaaccctatattactgtttaaatcattttttacataaatagtaatataagatgcatattttcttctgacaatctggaagaaatgttttaaaagtataatgtgaacagtaatgttaaattatggtctctgtgtttgtttacttagaattttgtgaaggtactttttatgcctcctaacttgcatatttaaaccctctcctgccttaatttaactatggtatttaaatgtgggcaagaggtatagggaacttaaataaatataatgttattattttagtagaaatgtaaatttttcacttttctgaaagcatcacacaggttattgaacttttagatggaattcgcacctgtgaacttgctctttcatgtgaaaagataagcgaggtcattgtcagagattggttggtttgccttgcaaaacagaaaaatggaattttagctcaaaaagtagaatctaaaatcaacacagatgtacaactagattctcaagagaaaattggagttaaaggtgagctgtttcaagaggatgaccatggtgagcttcagttttactttatgcatgcagtaatgaatggagaatgagttcctgagtatactgaccaatagattataaaaatattcctcagcaattttctatagaaaagtgtgatatttattctgttaagatgtataaggcacagaataatgacttttcctgccttttacttaaaactctgatacctttgaagaattgagctttttataatattcatattttacttgtcacaaggagcttggtttgtgaaataatttaaatgtattaaggatgttttatatttagatcactgattattaatgggacctgataggcaaatagctaatattccaaaaagcaacttctaagatgctgctggaattcttgaaagaactgagtttaggtctttgtcatatatacacattatttaggccatgaacaagttttcaagtatcagttgatttatgatataggcttatccatttggttataaaatcatatgtttattacataatcattgacaaatagtttctgtataataactggcagagtagctctaaaacatatgcaaggaaataaataaagaaaaaacttacaataaagagagtaactcatattttaacagttttgtgaaaaaaatagaaaatattttatgtagcttatagtacatatatttttttacaacagaagaatcgcattctgattttccatatggatcatttccctatgttgctagaccagtacactggcaacctggtcatacaggtgagtaatgttttcagaacatattaaatggtgttttttcttttaattaatataatgactttatgtttttcttctcttaaattagcttttcttgtcaagttgaggaaggtcaaaccacaacttaactgagtactccagatgacagtaactgacttgaagatggaaaaatatcaaaatagaactttatattgaaaatcactgcttccatagattggcatttttagctattactatgacttatataacttatacatataattttgaaaataacaactaaaagatgtataacatagcaaaactgcttaaacatcccattttgacacttgtcttgcagttagtttgacattttgtagttaatgattccaaattggtttagttgggccatctcattcttcacttcctgtaaacc

SEQ ID NO: 93465 - DNA, 1052 bp, Homo sapiens
aagtcccctggtccccctggggcggcttccttctgccgggccttggctcatcagagttctggtttttgacagagccccatcttgggactatctaactttcctctgtctgtgatccggctcatcagttttgcactgggcagttggtatggactagtctgtacttgcttccggaccttccccctcctgccccccctttgggtgccggctcaccacgtgttctcgtccccgtccaggttgtgggactctcaactcttaacttttgcctttcccaggcacctctacattctcagctttttgaactcactgctttttgattttaacatctgctcgcccctcccgccccgctttcaagccgatcacactgctccccacccaccccaatctgaagtctgtattaggatgtggaggttaagtgaagtagtagcttgatttagtgaatgttttatgagtgcagatgaaattacccttagatggaaaactgccgagttaggcagagcttttcattgttagggacccgtgtcaggtaaatgcctttcactgttgagtcactcagctacatctctctaactcagcatgcacgtggttattgcgtttacagagtagccaaaccgaatcactgcaaagtgatttggaaacatcaggtatcctgaggtgtgtgatgtgagctgtttcaatgtggagaactgtaaaagctatttaggatcttactctctctgacgacctgggaagcctgctaaatttttgggttgggaaaagggatacatataagttgctatactttgggcatgtttagatatttttcaaattttaagctacattttcatagtttatcctgttgattcataaaataaacctatcagggcttataagtcaaacataaaactaaaaaaaaaatcagtttttattgttaaaattacagcgctctgcttatcttttattttcaaagttttctgtggttgtattttaacagtcctgtaaagtgatagtaatactaatgctgagagaaatacggagcagtggttaggtaggtgcgtggacccaagctggctata

SEQ ID NO: 93466 - DNA, 1775 bp, Homo sapiens
tgtcatattgagcaagttgttttaattttgaggacctcattgacaaacgagagttgagctacattaaacaaaatttttttctaggtttcagcatcgttttatctgcactgtctccttttaaccacatgactatggaatcccctgaaattaattgcattttaaaaaaactgattgaaaatcagagctaagaaaggtaaatgacttgactcaagccttaataaccaataaaggagtgtggcctctagagtcatggtgccccgaactcctggtcaagtgccccgattttgttactctcaatcttgagtcacagaactgagagagctggaaggaatgtagagacattccctactttgagggtgtgtcctcttggagcatcagtttgacttataaactaaggagagacagttttcttgtattaaaacaaacttgcacatatattatggtataaaattaaaaagtcatatgtactgtaacaagatatcttagaaaaaaaaggcacatgttaaggtgctctcatcttattaaacccttccttttattttacatctttgaggcttagtgtatgaggcatgaaaaggatgttgctctgaacccactttccagcattttgttaaggtcctgctatatgatgacatatagtactctcaaatttgaaatagaggtatcatcacccaccttttaggatcctcaggatcaaattaggcaatgtatgtgactggtgtagtatggcctagtatgtaataagtggcttaataaatgttattattgagtgaatctggactcgttttaccatttaatttggcatttaatatggtaaatcaatttgtaagaaaagtattctatgtttggtttagtaattggcagtttgctacgcaaggacaaagtgtggtgatgataactcatcaatggagaaagattagttagtgctgggtttcttgggtaacgggttaagtttgtggttcacaggtgtttagaaaaattagattgtcacctcttgttggtcacagaatgattacaatactttgcattcgtgccacaatagtttttagagggtttttgtacgttatgtagctgagcattccatttggtctttggagcctgggggaagaggacctttaatgaggacaagaagataggaaagtgcaaaaatacaaatggagggactctatctagatggatgctgtttttaagagttcctcaagtttatgtgtgtaaactgaggcagaaatgttaattatattctctaccaaagccacatagtaaagtgactgagccacctaggaactgatgctgctatttgattgtcttcaaacttttgaaagtcttccgacttttctgcttttccttctctaacagaccttgtctgctattggctatcacagtaaatgtgtttatactgctttgctgtcactgcaattaagatgaccctatacagcttagtacttgttgaatgaagcacatggcatttcagacattggacagggtgtctgagttgggtatctgcattaccatcccttagagatgtagggcagttcacatgtgctgtgcagtggtctgtcttgaggtcttgctaacagttaaacttcctaagaagtaaaggttgcagatagatctgattggcagaaatagaagtttctgtgtattaggacttaattgatttgttataaatactgtatgtgattttttgtaaaatgaatacattttgttcactgttatctgtgaaacacacatgcagtggcagtgagatagatgaagaaatggattaggagactaat

SEQ ID NO: 93467 - DNA, 3022 bp, Homo sapiens
cttttcctgctgagatggtactaggttaatgtacttcccccaactctccttgcctgaaataggtgtttgtatttataaccttatacagaaattatttttgcccctggaatcattcaaaggtagctttagaaattcatgtaactgaaacggggacctagaacactcctaaaattgaggtttcaatgtttcaacaagttaaatgagaccatcagactttgtactttggcttttaattgtaacttctcttttgtgtttattagtacatttctaaggacttgcaagatatatttctaaggacttgcaagatgtgtattatttttttctgtaagtaggttacctttttttgttagactgcatttcatctgtgtccaatgaatcaaattctttaaatgtaaaatccccctaggataactaaaagaaaaaaatggaaagtgctttttaagtctactccctgacactctttatgcactggtaacgttgtggttgtcattggtttttcttgaattaagacagatttttaggtgtcttgggctgtgtgcatgcccatgcgtgctgtagagctaagatcctgcactattaagaagatattctcttttctatggtattggcttgttttacagtgaaagaatggatttctcagaactttatgctaaaaacatataggctggtgagccgtaatttaaaaaaacacggaagagaagttctgaaatcataataaatactcagcattataaactgatgtagtgcttttaagttagggtcattgtctttttgttgggaagacatgagctgttaacatcacttttgaaatgaaagaagtcttgtggcatttgccacttgagtgagacttttgtctctgaagtcactgaatcactgagccagcccttgaccagtcagtggggcaacttctctcttgtgtgctctgagctgctctactagttaaagctatttgttgactcaaattgaagttaatgcacgtttataaaggtaaaaacttttgaggctcttttcttgacaactaagctagaatttgtggaaaaattaggagagataaaggagagttggctgcttagatatggacttacggattcatagatttttgggtatgaatctctttggttggggagtgaaggcttcgcttaggttggacctgtcaggaggggcggcctgtttctgagaagtggaaacagcattgaggcttcttggacctgttaggagagtaccaagaacatactaggttttcctatttgctgccttttttccataggggtgggagacgggggacatagaattacgagtttctcttcccattggagggatttctttttgaagtagtgagaagtaaatcacccaatagcttctctcttccccccttttaaaatgtcttttgtgggctggtgggcatttgtatttgttcattaacgatgttttagtatttgcaatactaaataaaaacattgtttttctttttttccaggaaagtccccagaggaaaaaaaggaaatcagaagctgtaggaatgagtaaccagactgacttattggctcttggcacagcagttggtagcattttattatacagcacagtaaaaggagagttacacagtaaattaatagtaagtgtgtgtatattttatttaaaagtgatgtgacagggaagctgattattagagattattaaaaaaaaaacacttcaaggtatgtgatgggatctgtgcagtagggacagttttcagtctcatctacgtttaaataactgaatagtaatatttgataaaagctataatagttaacagcagtccttattatgggtcagagtatgaagacttattgactaggtttaaaataaggaagggttacaggaactctaaggaatcatagatagcagctgtggaaagcagctccccacctcttgacctaggggaataaaggaggcagttgaaattactgctaacactgagatcttttaggggcaagtgttgtgctgctgttgctgtctcttgaagagtggccccatgggcatgggatcgagacttcaaactgagaaggaggctccagctgcctggtgctagtgtctctgatggagatgatgagattggttctcctagggttggataaattggatattgggttcagctgctgctgttgggcattaccactgttggggtgatgcaaataaagagacaggaaggaacaagtcccttctctctccatccttgtctccctctagcagttgctattggtagaacctatggatcgagctgggaaatcagaaatcaggttgctgagtcccagcatcacagcagaatataaaggatggtttggcattggaagacagtaaccgaactggtctagtaggttcagacaatatctattgcagtgtgtttttgttcgctggacttctgtatataggagtgttttaagttttttgttttaaataacatttgtctataggaaatttgtaactacataaagttgaaaaggaaaaaaatttatacctaagtctgtcgccgagaggtcctcttaataatttgtatatttctttgctttatacatacattaaaaaaatatagttggctttctgttcatctagtttgtatcctgatttttttcattagattacaacataactatcttatatttgtcaataactggttatagagatttttagtgactgcttaaaatcccaacaagtgggatagtccattatgttacttaacttgttgaccatttaggggtttccagatttttaaattgttgtaaaacaatttctttttcttacatggattcacagaattactaacctaaaattagtgagccaaagggttgctatatatgtagtataaaaatactttctggaataatttttactaatttatgcttaatatcagtgataggagataagtactttatctcagcagtatcattaccactactgaatagcccaacaaaacagcaacaacgacaacaaagaaacagctaatttggtagaggaatattttaatctgattttaagtttgcat

SEQ ID NO: 93468 - DNA, 1035 bp, Homo sapiens
agcgaggaaggaggatcatttgagcccaggagtttgagaccagccttaaattttttttttttttttaatctacagagtggtggacatgacaacagagtcaactgcatacagtggcatcaagacagtggctgtttatatagttgttcagatgataaacatattgtggaatggaacgtacagacatgcaaagtaaagtggtgagtaacattcatggtatcaggaaatgcaatagacgtggataaatgctggacttgtggggaatgcagacattaataaggttataggttccatttacaaagaacttttaatcaaatcgagcatgcaagattttaatacataaaatactaaaacacataaaatacataaaagctaaaaatggtacaaaaataaagcaactgtatgagagatgtcacaaggtagcatgtgactatttgtcagccgagtacagtagtgttgggaaggcctggaggaggagaagggatttcagttggaccttctaggacaggtaagatttggatagaggagggtgggagaatgctttcaagggtggagaaaagaagttggggagatggcaagaacaaatggagggagacaggaatgtaaaagattgacttggcacagagcaaactaattcagaggagggacatactaggggataatggatggcagatgatatgggtcaaaggatcctaagagcctggccttgtgtcatagataaagattatagaccattgattatagttcaaccacctgatcctgaggttggccgtataggagatgcttagtaaatgtgggctgttgaatatagttccacctactgtgtagttgaggaccctcatgaggaaaatgatgcccatggtcctgcagctgccagagaagggattctaatgctgctctttttagttctggtacagttgggattttagattctgtctggtatgcaagagagagccattggccaagtgcagtggctcatgcctgtaatcccagcactttgggaggccaaggtgggaggattgcttgagaccagactga

SEQ ID NO: 93469 - DNA, 1056 bp, Homo sapiens
gagctagttaaaggcagagaaggcagatagattgttactgtaatctggttgtaggatggtaagtgtgggaagttaaaatgggaatgatcgcaatcattgagttgggatattgagtttagttttcagctttgctaactaggcaagtaaaccaatttagagggaggaggtactagggggataatgcatggtagaggatagaaattatggtcagaagagatacatggttttggggtttttagacaagttggctttgaaataacattatgtgaaagataagacccagcagacagggtggtgctagaggcttagatttaagtaggggtttggggttggagatgcaggtaagtaaaccatctccctgatggctcagtgagtatttgtgctccatttacttgtagcagacacagtagtttctatgttagtaacctgttagaaatgcctgcagaggttctgatccagtaggtctggggtagggcctgtgttactgtattctggatgagaggtcacaaagataggtccttcacatagggactagtaatgttcaaagagccattcaacacgtgtgcgttttattgtatgtaatcataagcctgtgaggtgaactttagccccactttgctgttttgaagtagattaaacaagagcctgacctctcatacactaaactgtgttgtctcataatttcattatgtttccagcttcatcgttagcattcttacgctgccgttacttggattttgttttctgttccagacgctatgtattgattttctgttgtggaagatgaggatttagctcttaccttcttttcccccttccagttctctcaatattgttgtatcacagtgtttgataagcagaatttgtttacattatgactagttaattattgttacagctgagccttagactttcctatgtttaatatttttttttgtacaaaattttgcttttcttggggtttataattgcttggttttcatttcattagttactaggtcattctctattagtggtataaatcttctcagttgtttctggacacatcagtcagtc

SEQ ID NO: 93470 - DNA, 1430 bp, Homo sapiens
tgatttggcctcttttatgtttaaggcatccttcaaatcactggagatcctgagctgcctgttgctatttggaaacaaagcattaaaaagctgattggtggctgggcgtggtggcttatgcctaaaatctcagcactttggaaggctgaggtggaaggattgcttgagcttaggagttcgagactgtcctgggaaacatagtgagaaccccctctctacaaaaatgaaaaaaattagccagatgtggtggtgtgtacctgtagtcccagccacctgagaggctggggcaggagggtcacttgagctcaggagatcgaggctgcagcaagctgttaccttgccactgcactctgcctgggcaacacagtgagaccctgtttgggggaaaaagtattgattggaaggcttggttgtgagtgtgtgacttttcaattgttgtgcttcatttatagagtgattgggaagccgtcaaatgccaatatgtgtatatcattccactggaaccagttacatttcccagagaggaattttttcatctagtgcttcttaaggcttaaatgtacatacatcttaacttgtgcatacagatctgatttagtaggtgtaactaggttagagcttgagagtgcataattctcacaagttcccagatcatgctgatttatgctttgagttacaaagctcctgagggattagggtgtggggaggatagaaggtattattagcctaactagcattttcaatactgagtggggaagtagatgaaggaagcttatcagcctcgtctaggcaggatggcgattgtgtcttttatatatgtatcaacgtagtaagtatatgttgaatattgaatgtaaatgagaattgaagctgtgggaatcgataaattggcaaaaatttcagaagctggtaagggtaaaggaaaagttctctcgtacattatagctgcatttctttgattatcagtgaggttgaatttcgtgtttatcaacaatttgtatttttcctatgaattgcctgtttagttgtttatatcctttgtctgtttttattttgagctctttttcttattgatatgaaggagctatttgtgtattgtgagtattaatcctttgtaatatatatttttgatacttttttctagctttttacatatatatacagataacgtgcgtgtgtgtgtgtaaatatatatatatatataattattatttttattttttttgagatagggtctcactccgtcacccaggtggagtgcagcagtggtgtctcagctcactgtaaactctgcctccggggttcaagcaatcctcctgtctcagcctcccgagtacctgggattgcaagtgtttgccaccagccctggctaatttttgtatttttagtagagacaaggtttcaccatgttgttcaggctggtcttgaac

SEQ ID NO: 93471 - DNA, 3301 bp, Homo sapiens
acaggcatgagccaccgcgcccagcctcttaataacctcttttgttattcaggttcctactgttacttgccttttttttttggagacagagtcttgctctgtcacccaggctggagtgcagtggtgcgatcttggctcattgcagtctctgcctcctgggctcaagcgatcctaccatctcagcctccagagtagctgggactactacaccatgcctggctaatttttgtagtttttgtagagtcagggtctcgctgtattgcccagactggtctcgaactcctggactcaggcgatctgcccacctcaatctcccaaagtgctgggattagaggcatgagccaccatgccctgcccctgctgttacttcttataagtgaatagccaagttccctattgcctatgacagcattaatatgagtaacaaacagcaaagactccagcttctaatcatatttgaggtagtgaaaaggagtcatttgtacctaattaatttttacctgtcagattggggtacattcatgtggatttagggtagaaataacctttttgggttgcaactttagagaaatcgtttgtgttattaagggaattaattaaaggccagccttccagagaaagcgagaattgaggtagggttaggatgggcttggggaggtctagccagtatggaactttcctggacattcgcaaagttcatctcctgggtcacaggatgtacaactacccattttacattcttatcactctcactcactcattttctgatacttgttgagaatctttatcccatgcctgccaaagggagattgtgctgtgttaaggaatgcaatcaatgaagcttttatcacagtagtatgtccagggttagttacctgacacaagcttttagggaatgtaattgtcacaggacctgaggcgatatttttaatgattgttcagtttgtttttttgttattttctgctctgagtaaagttttctctcatgtattgagatgcttttttttctcttcacaatatagcaaatggaaaggcgacaatagcagtgtcagttccctatgtatcagcccagatggaaagatgttgctttcagctggtcgaacaatcaaactatgggttttggagaccaaagaagtctacagggtgagcgaatcaaattatttgtaagcataaaaattatagagtaaacacagagaaaggcagaagtttgaaccataagatattattttaagaatacaaattcttcattgtcaggtacatcaaatagtttagtggataaaagttagcctcctaatctgatttgttgatgttaaagagactagacatgtctacttcaaacgtattggaaaaatgaacagaaccaatattcaagaaacaagatttttttttttttttttttttttgagatggagtctcactctgtcacccaggctggagtgcagtggcgtgatctcggctcactgcaagctccgcctcccaggttcaccgccattctcctgcctcagcctcccgagtagctgggactacaggcgcccgccaccacgcgtggctaattttttgtattttttagtagagacagggtttcaccgtgttagctatgatggtctcgatctcctggcctcgtgatctgcctgcctcggcctcccaaagtgttgggattacaggcgtgagccaccgcgcccagccgaaacaaggtttttttaaaatttaaattttattatatacaccaactatgtatccacaaaaaagaaagttaccttttaaaaaacaaaacagattttgacacagggtctctctctgtcgcccaggctggactgcagtgacgccatcatagctcattgcagccttgacctcccaggctcaagcgatgtctcacctcagcctcctgagtagctgggagtataggcgcttgccaccaggcctagctcaaaaaagattttcttaataaaaaagtttttactatgtgatgattatggtaattttgatttctagcctacatccagcatttagtccacttactgtatttgactgtggagatttagtattatatttttggaggaggaaaaagctttcactcagggcttacggaatatttggtgctgtgatgatgccttaatattgtggtttcgactcactgagagtaaaatgaggacctacaattccttggctgtgtctgagcacccaaagtatgccttttaaaatggatagaattaagtgaatctttaattcaagaatgtaagaaacaaaggtgcggagtggtagggtcatgggagttagaaggaacatctaaattttcagtattttcagatggatttttttaaaaagtgggagaattatagcacaaataaccttatttgcttagaattgaattgaacagttacttcatcgtggagctctcctttccgatatgtatcacatatggcttgttttgataatatatactattaatttttgtccctgctttgaatctgctctcctaactgagatttaactttctctagcatttcacaggacatgcaacgccagtttcgtcactgatgttcactaccatcagacctcctaatgagagccagccctttgatggaattacaggtctttatttcttatctggagcagtacatgaccggttacttaatgtctggtatgtagttcttttggatttgggaggtagcattgaaagaatctgtcagagcttatgtagttaatgtaaattatgaatatgggactttatttgttgtatctaatgttggatttacattgagtcataataaaaaattgagcctgcctacaaaacagatctttctgagaaaaaattaagtgcattatgtattaaagcctcctgtggttgtttagtgatacagtggactgaacatttctgtggttgggcaatttagaatatcttttaaaaaatttagaaagacctttgattttgaaatatatggcaccactgggttaatgcagtagtgtctgtttatggagggcataaaattgcttggctgtctcagaatttccagtaactcctttttgcagtagctgctattaactagttccctttgaaacctcttttaaaagtaaaaatcaggccgggtgccgtggctcatgcctgtcatcccagcactttgggaggccgaggcgggcggatcacgaggtgaagagatcgagatcatcctggccaacatggtgaaaccctgtctctactaaaaatacaaaaattagccgggcatggtggcgcacgcctgtagtcccagctactcgggaggctgaggcaggagaattgcttggactcaggaggcggaggttg

SEQ ID NO: 93472 - DNA, 2934 bp, Homo sapiens
gggatggaggaagagaggcgatgaggtcttacaacaccccttcctagccatacaggcaaaatggctttttctgtattcccggcaagaggggcatgtcagctccatgttgccagcctttgcacttggtagtaactttgttcatctaacttggagggctcattctccttgactgttctcttcttggcttaaacatttatctagaatcttgacaacaccaccactaatggttattttgacagaggtaattatttttaaatggattcttgctgtgtttttttttttttttttctggttgtgtaatggggtgggaaggacagctgagttttcataaggtagattggggactggagtatgttatccattataatacgttggttacatttttcttttagcctgtcaagttggctgttgtttgcagagatggtcaagtccatctttttgaacacatattaaatgggtaagtaagaaattttccaagtaagaaatttgtttctttccctgacttgttacttggtcatactcccacctggttattctttgcatcatattactattcagccagattattttgaaagcatttttctttatccacatgactatatacattgccagttaaaactgggtgtcaaatttatatatttgtgattaggagattggctttttatgatgtatccttagtacatgttggataattctaatgatacatttcagaagaaagtggctaagctggagagattcacttgtgaaccttgatgatgttttatttatctttgagcgtgctttacttccccttgccagtgctgttgttttgatagacaggggagtattgttgtcaggttgtgtagcagtcatagaccaggagtcagcaaaccggcttgcaggccacattcagtggagaccatttgtggtctggagaacctgaaatttttattattttgcccttttcagaaaacttgccaaaccttgtcattatactgtaaacatggtctgagactcagttttgcgcacaaattttgttaagctttaaaatggttttaacctcttgttgtcagttggcacccttcttttaagataccagtataggaatttatttaaatataaacagattatgaaaaaagtgtatactcatttcaaaacacccaggatgcccaaacacttgattttaaaacctgagtctccctccattgagttctgctcctataggtaactgttaacattttagtgtgtaactcttgaagcttttatttatagaaggatgtgtgtacctggaatgtataattgagactcagaagaagtgggacccaaaggtagctggccacagtgaggactacctgggcagtggcaaaccattgaaggatttcaagcagaggattcgatgagctttggcctgagttttaagacagtcgttcattgagaatagactatagagggtgaaaggctaaagtagagaccccaaatcctgggtttagagatagttgtggagtcaggatgataggaggagtaagttggaaagatagggatcatgagatgcttacacctgggatattatgcaggatgtacacttgtggagaataagtggtaataagatgcgtagggtgtgaggagtttgtggctgaaatacagtgaggggcatgttcatttgagaaaggagttgacagatcagagtgtcaggagtgtccatcaacctggacactgggtgtggaaaccactaagaaaggaattcatttagagtaatgttagaagtaatgacctcaagccactgaaatctttacgaaatgtggatggtggcagagatcattggatgacggcaggagggagtggtagctggtatctggtgacaacaattgaaaagattttagggacgaaaaagggatagactattgtcttgaagtgtcagtgaagagcagggaacttatttatatcatgtccaaggcccctgacacaaatggtatgggagagaaaacaggtacaagttgggagtgctgcagggacaagccagggtagaggaagaatgtgaagagagcccctagagaagccattgaggacacaattttgctgctggaactacactccagaggcttgctgaggcttttgggggttgggagaaactggagacgggactgactggaacagggcttggacagaaccatacaggacctgaagtacagggtggcaagagaacgtttggcagcttggggcttcttggcggggcctgaaaaaatgggacagagggggaagtaggtctccagtctgattttggtggtgaggttttgagtataggtagaggtaggtgaggtcttgaaaggagtactcatgctccggagacccaggtgactcctgatggcagtatagaggctagaggggggtcacatttcgtgacttgatgtcagttccagagagttagtatgagacgttttttcaaattctttaatctcatttccccctccatttccaggtactgcaaaaagcctttgacttcaaactgcacaattcagatagcaacacctgggaaaggcaagaagtcaacaccaaaacccatccctattctagctgctggtttttgctcagacaaaatgtcattgttgcttgtatatggcagttggtttcagcctactattgagcgagtggtacgtagctgctactctggagtaaagcaatatagcatccctgtgtccatggaagagagtgattttaaaaataacaacattggtctttaagataaataatatattcttttttaattaaaggatttcttcatggagtggtttattttaattttgagagctctatatccaacataatttaacacctggtcagtttaaagcattgtttgagttatttatatcagccctctcccttggtactatgttttaaaaatctggtgtgtattttgcacttctagcacatctcagtttggactagccacatttcaag

SEQ ID NO: 93473 - DNA, 2805 bp, Homo sapiens
cacacaagcatacgtgcatatggtttaattaaaaaaataaaaaaaggagaaaagtgttaagctgtaaacatggctccttgccatatgtgaattccatccctctctgtttgcagccattgttgactatttttttgcatctttcccgatattgattaattacatgggcatatagaattatgtatcactttaaatctttattggtttgctgcatctgactcccccgatcctatttaatatcgtgtcaggacatacagatgcattttgttaatcaacagtgctacctttgacttgcttatggaaaggacaataggagagttaagagtagaaccatttactattttgagcagactgtttcttaaaaggatgatgaactgatacgttttctttaaaacctgttacgtttaaaaattctgttgaactttaaaaaataaatgtgaaaaattcaagcagttcatagctgaggaaagtaaaccttggtacccaatgtcttcagaattaccatttttcttaactgccgtcagtctgagtggtgatcgtggttaacaattgagtgtggaagtcttccatactttttaatattttataaaaatgcacaagtagtcatttatttttcattttgttcttattcccagttgctttgtttgacactcttttttttttctttcctctcatcttcccctttaaaaaaaatatattttcaggctttaaactccagagaacctcatatgtgtttagtaagagatatttcaaactgctgggcccccaaagtagaaacagctataacaaaggtgagcacattacaaatttgaagttttaagaaaaagaatatttctttgggtgaatggaactgttacttagtattatgattaaactgagttttttattctttaatatctttattctcttgtcttataaattttgtgggattatggttttagatgtcaagattgtactcctgatttgttgagtgaatgaatgaatagaagactagcagttgaagaccttggatgtggttcttccctgcccaccatgcatgatcatctgggccaggaagaatgtagggataaatatcaatatcagatttatcagtagatagtttttatcaatctcagtacttaaaagagcattactttgctgagaggaatgctgtatttcagggtgtaataaaaccgtcatggggctagaatataataccacaaaagcataggagcatcatcatggtgctccattttgcatataacttggtgtctacatgtaggggacgtgtttcgtggtttagtgagaaagggaaagccaagacatgctatgatgacatccatatggtttcgctgctggctgagtttcagagatgacacctttctcttggctgtctgagcatttctggcagagattgaattctggaggtagttgtaaaatgtgtaacttcactttttaaatttttaaaaatcattgtgtctttatgtaatctgtagttttttaaagccagttgaatttagtagtgggggcttgtataccaacgttagtgacactaaatatttaataagttctgataaccaactactgtcaggccagtcggattttactcttatgtggtattgtaagctttaaattcacagtctttcagattgtcacttaaaaagtttgtcaacattcaatttaaaatatatcttaaattgatatcaagttaattatattgcatttttccaatagaggagccctttaaaagctgttttctcattgaggatacttaaggactaaggtatgatttcctttttcacactttggctattcctgttgaacaggtgaggacaccagtgatgaattctgaagcaaaagttctggtgcctgggattcctggtcatcatgcagctatcaagcccgctcctccacaaaccgagcaagtagagagcaagaggaagtcagggggaaatgaggtaatgcaactgctttgaccatatatttgagtttgtgatttaaaattactgggaaattctaacaagtgtgttggatagagccaaagttaaatctttagaaatttactgagatttctcctgttatgctctcttttatcttcaccatcatagatttcataattctagattgtcatctttgtttaacagagaagatggaaccttcagtaactaaagagggtgctgttttggccattagttagtagttagctgggtaacataaaatggaataagtcaagccaggacttgctgtgatgactatcattgggtttcgcatgttgctgagttccagtgatgcctcttttctcttggctgtctgagcaatcctggctaacctagtgccagttggtctctaaaagtgatagtcattataactgcctaagtgtttatgatcttcattttttcctcagttcccaaaatcctttgtggttactgtacatgtctgtgcagagttgttttttatcttccattcacattcttccctcttacataaggaatctggaattttaactgtttcattcttacagaaatactaggtttctttagctgattttactttaatttgtattctttttttttctttgtccaatttttgaaggataatttagctgattttaaatgcgtttattgggtggtggggtggggataacatagcttcataaaacatgttcataacatgttcataaaagttattcctcagttacatgatagctgactttaaaaataaagcgccaactttctttggcttggcctagtttcaactttttaatttccccatgtcctttttaatcttttttgtgttaggataaaccaagcacatctgtttgctatgtta

SEQ ID NO: 93474 - DNA, 2142 bp, Homo sapiens
gacacttagttgtagtatagcatattctagctaataaatcatcatttggagctcactgttaaaaataggaagacattttaaaaaattgttttgggaacataacatttctttatgcccttttaataatattttgtttcctcctgcagatctgagagtgacaccaagggatagttatagtggggcaagcttctgtgagaataggtcttaagtcttgtgttctagaatcagatgccaggtccttgccttttctgaatcttcatttagaaggatttttatgaatgaacattttcaaactatgtgcttcttgggccgttgtttttttcactagaatctggaagcttggattgcagatgtttgtctccaacattggcattatggtaatgaggttctcttggaataagaatgagcatattagtgttttctagggttgaggtgtaaatctattttattttattttattttattttttttgtctccaaactactttaagtcttgtctggtaacacattaacaatcctttctgttctgtaggttagcattgaagaacgtctgggagcaatggatatagacacacacaaaaaaggaaaggaagacctccagacgaatagctttccagttcttcttacccagggcttagaaagtaacgattttgaaatgctaaatgtaagtatatagcaatttttaactaaattaacatggttaatatttcttagaaaatgattgacatagcacattcacagctgtgagccatcatgttacagagccatttggaatgtaatgttttatgagtttagtcaaacatgtatcacttggtggcattatacagacagtcaccaacctacaacgggattgcattgagttattttgaacctggaatgcattttctcatagaaatactgttctgaattattaggttattaggctttagttcataaaagcctttataaacatagtgtagctgaatgataatactcagcattctagatcacaatttatatttttttctgtaggaaaatgcgttcctgagtttttactctggattccagaaacttatttccccctggccgtgagagggggcagtgaggtggaaccttggcaatgggtaggaggtttgggggaaaattcaagagggttgggggttatgttgtaaaatatgtagaggtaaaagtactagaaactttgtataaagggaggcatttatgatttctgtgtaagttggtgactgcttgtatgaagttactcagtttgattctcttaaattctacagtttgacagcattctatctagaatatttaagtgaaaaacagttcgattcaagtactgcctgatcagattaaagcagtttacatttgctaatgcatttattcttaatgactcatagcagtgttgtgatttcagtgagtgtcaatgtgactttaatccataacctatgaatagtgtgtctcattttatttgatccatttttttagggtacattgatcctaaaattacttttaaaatagtttgtgaatgtgtgtattgtggaggtagattttagtttaccatggcatagaaacctgggtgaagatttggtgaaaaatctgtagaaaacaattgacagtgtttttgaaatggaatataacttaactgccctcattgcgttctaattatgctttgaaaccttcctcagtaggtacaaatgaatcaagtacaaattttttctttttcttattaagaaacagttcaaaacatttagaatagtacagtggaccatcacgaactcattacctagtttcaaaaattatcagtactagccaatcaactgttgatttgttgatagtctcacttgtctccccaagttatggtgaagcaaatctcagatgatcacatatcattttatccataaatatgccccattcaacttaaaacatcctttaaaaaaataaccataatccattgttgcacctcaaaaaagtaattctttaaaaattatcaaatatcattagtgtttgtatttccctgattgtctcaaactttttttttatttctgctttttttttttttttggagatagagtcttgctttgtagcccaggctggagtgcagtggcgcaatctcggctcactgctatctctgcctcccaggtcctggttcaagcaattc

SEQ ID NO: 93475 - DNA, 1489 bp, Homo sapiens
aaaatggatctcagttttatctcaccttacacaaaaatcaatgcaaaatagaccatagacttgactgtaaaacctaaaactacaaaacttctgggaaaaaacaggagaacatctttgtgaacaagagtggggaaagatttcttagatatagcatacaatgcatgaaatgttaaagaaaaaattggtcatttgaaccttatcaaaattagaaacttctgttcttggaaaaacagtgttaggagtataacaaaacaagctgagggctgggaacaaaatattagcaactcatgttagacaaaggatttgtatctggactttaaagcagttggtaaaggtttgaatagacacttcacaatagaattcaaatggccagtaagcacatgtaaaggtattatgcattattaattatcacagaaaggcaaattaaaaccacagtgaaataaagcttgcacacaccccttataggttgataaaaatgcgaaagacagacaataataccatctgttggtgaggatgtagagcagctgaaattcaagtatgttactggtgggaatgtaaatggtataactactttggaaaacaattagtttattaaaaattgaggatgtatccacatatgatggagccattctgctgctagatatttaccaggagaataacacacatacgttcatacaaagacttcctcatgaatgttctttgtaatggccctaaactggaaagaacacatatgtcctttaacaggtgaatggagaaacaaattgttcatctagcaatataagtaatgtgttattaatagaccagtagtattcatgaatctcaaactaaggctgtgagaaagaagccaagcaaaaagtaatataaattcctatttatataaaaattctggaaaagcagaccaatacatagttcagtagctgcctgggaatcggggtggaaggagggatacatttaaagggacccaaggagacccgagggtgatacagtgtttatttttatcatatcatagtatttgtttcatgggtaaagagtatgtcaaactgatcaagcagtacactttaaatatatggtgtttattacgcttcatttgtactgcagtaaagttgtaaaagaaaaatcttgtcttcaacaccaccttcttagtagttataactatggcttataggtttgtttctttacatacatccttgatggaaattaatgaggctgactcctctgtttattatcatttcacttagtttgggataacgtatttttatttgctgattttaaattagaaaatcattactaattactgagaccaggaggtcaaagctgcagtgagctgtgatcatgtcagtgcactccagcccagacagcagaatgaggcccctgtttcaaataaatacattaataggttggaaactaacttcctctatttttgccttttggtgccactgctgtttctattctgagcatatttatagcaacaaccatcaccaacaaatac

SEQ ID NO: 93476 - DNA, 1071 bp, Homo sapiens
ccaccatagatgtacgcttaaagggttttgattcaagctctcattatgtcatcttttgattggcataaaattttaccaaaattttgacacctactttaaaaggatttcttgctttctaagtaattttactgttttgctcactctagggtggatacagcccaaatttcataaaatggaggtttgggaacatctttaaagtggcatatgtctgtattcaaacgtctagagatgttttaataaaacacaaagaagtaaaattacttcagtaatgaagtaaatttactgatacccaaagactgtgcttgtctgttaagcacaagacgtaatataacatactccattcagtccctccaacctttatttttgctaaattcagtttgtagtttattgccttggtcttaaatgatttaaaggattcatttttacagacttttttttttctgtgatgtccttggtttgtcagtatgctcatcttaataatccttttattttctcacagaaagtacttcaaactaggaatgtaaaccttataaagaagactgtattaaggatgcccctgcatactattattccgttgttacaagaggtaactgactgcttttttcatttcagcatcctaatgccatgagttaaatggaaaattcagtagttagagaaatggatttgtaatacgtaaggacacatggcatttagagtgagtaatggatggaggaaagtactttagacaaaaaaaaaaaaaaaaaaaaagtgaaattaattcctggggcaatgaaaggaaatgtcattggcagttttacctttattctgctaatggctattgtgtgtctgtttacctggaggcacttggaacttgtggcacagaatgctgtatgtacaggatatcatctacatgggaataattgttgtaaacaccccaaacataaagctcccaaattctcattttggtttttcccagtatgtcctgtgaggtaccttaacctaacaccgaaaccatttttatatgtattgattttcttaatcacagtttggttgttaatctctgtgactggcagtatggaattggaggtggga

SEQ ID NO: 93477 - DNA, 1026 bp, Homo sapiens
tgttgatatcgtaaaactgctgcttatagtacctgccgaacctctgatagctgcttaagactctgtaaaaatatgttttagctaaaagactaaattttgtgtcttttttcttgataatctgatcaaacatttaaataacatgacatcttaaagatcctaagcttatagtatattatcatcagtatctagatagtaaaatatgtagtttttctttaaaaattttttttctcgtggggtgcattagccttctgagctcacaaaagaggaaagctaaataattcattaattatgacttttttgcacatttttggtctatatttgccttttaatgttaatggaggactttgctattcttgacagatttttatgtttattgttaacataaaatgcaaaaccagtcgaactcaatttggacgaagattactgccctcatatcagttaattatgaagtaaagcacgggttttgctcttgaactgttttagaggaaggggttttgtcctgttttctgatgtggcccccaatccctgcccaaggtctatgacacagagctcagataatctgaaagaaaaaacggaaagtgatatatacacagtgatatatttattacagtcattttcacagagcaacatttatagaccttcacttgtctgtctgggttttctaacagctcagttgaatttacttttgaatttgtgaacattagtttacttggatttttttttccagtgctgtgctaatggttcagtggctaaaatgtgtgttaacagttcatgcatcatacctgtccacggtgagtcttttcagcttctgttgccgagtatgaatagtttggctttgataaggattgtaaactttgacaagtatggctgaacaaaaccatcctttccccatctatccttcagccgttagatgcttcctttagagattttgttttaccccgggtgcaatgacatgagccctttcatgatgtcactgctgtggctttttataaattggtcttcccctctgccccccggatgtaaaaa

SEQ ID NO: 93478 - DNA, 2300 bp, Homo sapiens
cagaggcaggtatttgaaggcagtgggacaggaagaggcttgttctggacttccaaatggcttcctttaaaaagaggcatttaaatttttccagttgctttttatagttgatctaggatagaaaaattatggccatcatggtttcctttcatattgttaaaaatgatcaaggggactttaagattttatgagaaaggcaaattaccattgttttattcctcagtgaacctggaggagccagacctttatcagtcgtgttgtgttccaaatataacagctatattctcaatacaaaagactctgatgagagcaacatgggagcaaaaaagagaatgtcctactttcattttttaaatatgtttcagaggactcattaacaggaagtatatttaaaatgcaaaaggtcaactttgtactttgttctactggtctctgggagctgggaaaaggcttctctgcctctttggggccttacagtaagggtagataatatgctagcatcagaggataagattcagaggaaagcctctttagcctggagatacgtggtagaggcatttttaatttcctgtctactttatatgggatattggccttatctgaaatagtttgatcaatacagaaaagtgccaccttgcagtttcactctcttgcccttatatcattttttttataagcctattattttttcctcctaggacattgagggtcttctgtgaaaattcgtgatgttgttaggctatgttgcaggtagccactgccactgggagtacttgtaagcagatgtgtgtggtgcagtggctaaatactgaggcatagctgagcatgatttgcgtgttcgtcatctctaatacgttaatagtgccaaatgatcatttttttctctagttgcctgacctggtaccccagctggggacactctaccagttaatggaaagcagagtcaaaacttttcagaaactttcacaccttcatggaaagcttattcttctaattacacaagtgagtaaatcatattgttctgggctaaaacttttggacatggtaggaatggagagaggaataaggatcattttgagacagggtcttgctctgtcgctcaggctgcactgcggtagcatgatcatagctcactgcagcctcgctcaagtgcctcccaagtagctgggactacacggatgcaccaccatgcctggctaatttttaaattttcgtagagatggcattgcctaggctggttttgaactcctaggctcaagggatcctaccaccttgacctcccaaagtgctggaattacaggcgtgacccaccacgcctggctgagagctccctgtttcagtaagaaattggtaaatcaggatctagtctttaacttggaaagcttatcagtttgacagtaagaaagtttagttgtgtctgtttcaacttttactcaaatctttttctcaccattgtgtttcagttgttatacagttagtaagttataggatatttatacagttaaaattttggcacagaaagatattctaatcacctcagagtttttcagctttacagagtaattctttccctcttgtatttgaaggacttttttgctctgtattgtatgaaggtcctccattatggtggtggagggtgagttagcagcaagcagtggggaaggttgggtatgctggtggtcgtgatacttgggatatgtttacactctacttcagaacagtactttatcttcttccaggtaacagcatcagagaagacaaagggagcaacttcccctggacagaaggcaaagttggtgtatgaagaaggtaaagactgggggaatgggatggagtctagaattataacattcagttttcagtgactgagttctgttatctttttgaaaacgtcaacataagatcttcctttggcaagccttctctaattaaaataggcaagtccgtggcaaaaatctgtaattcatcagataagaaaagaaaaggcacaagtataatacagtgacaaaaaagggcattagttatggaagattttttttttcttttctttttttttttttttaagacagtctcagtctgttgcctaggttgtagtgcagtgctgtgatcacagcttgctgcagcctcaacctcctgggctcaatgcaatcttcctgtctcagcctcctgagtagctgggactacaggcgtgcaccaccatgcccggccaactttggtatttttttgtaaagacagagtttcactatgttgcccaggatggtctcaaactcctgggctcaagtgatcccaatgtgcttgga

SEQ ID NO: 93479 - DNA, 2421 bp, Homo sapiens
ggcagaggttgcagtgagccaagattgctccactgcactccagcctgcaaaaaaaaaaaataataaaataatgttatttcttagttggatgattgctaaatataaataatatttctaaaagtaaattcaggaatctggttctgcttaatttccaggctgtaccctctgttttgttctaaaattaaggctgggttctttctccccttacagagtcttctgaagaggagtctgatgatgaaatagcagataaggattctgaagtgagtgatttgttccctgtatatacatcggcctttatatcctcatactctgtaagaatgagaccttcatgaatgctttccttgttggtatttcgactaggataattgggatgaagatgaggaggagagtgaaagtgaaaaagatgaggacgttgaagaggaagatgaggatgccgaaggaaaagatgaagaaaatggcgaggacagagatacagcaagtgaaaaagaattaaatggagattctgatttagatcctgaaaatgaaagtgaagaagaatgaagacagcaaagcaagccggtcaaactatataaactctggctcaccttgcccagtggtgagggctgcctctgtgccaggatgccaaggaccgctgcacatttccaaattcacagcagtggatcccatgccactttgctgtcctgagcaccccagacttgactgtgtaaataagagtgtttcattcaaatgttaataaactttacacagtatatagacacattttctgcaatgtactgacatcagtgtccaatatatggtatatttttataatataatatcctagtatgattggttatatcaagaattgacaagtgcagataaagacctttcccataggagttcaagaactggactgttgtgaagaagtcagctcttatctcaggttggtatctttcatcaaatccagatgcaaagcagcactagtgaaaatttttttaatttagtacatttaatttggtacattttcataaaatatgaagggataactacaaactggagtaaaaatgatggtaattaaaaaaaatcctcagtatccctagcttgtctattaactgtgataatctgacttgagtcagattgaatatttggagtgcttccccagaataaccacttatttttgaagctatcatgtgaagtatttttttaaaacaaaacaaaaattatggtcattaaaaaactagagaattagccatattaaggatttttcttgactgcaaattacttctaaagaatcatcagtgtatagattagaagtgctcattacctgcaacttttaaaaaaaattcagttatagctgcttttgaagaggtttccatttttatttaaattactaatggatcaaagaacaattgtttattttttctctttggttttagatattaatgataaccttgttggaattttttttccaaagaaaatatttttataattaaataatttaatgtttttcttccttttcattacctactcttggcagtgttagggtatctgtttacctttaaaatgataagtctcactcaagattttttatgtatgtataaatattttggtgtgctacaaaagcctttgcaaattatcagtagtagtttttttttttttttttttttttttaaagaatgagccgatattggcttagtgctcactaggggacatgcacatggaagctcacctctaagaaagggctgggcagatggatttattttttcccacctgtgaatatgtaaaacaaaaccattatctttgagggagtttttaataccaatgacagaacagagatttgtgtgctcatcttaagagccagagccatataagcatcttgggaaagcaagtttgaaccagctgctggtgtaatgtacagttatatttgtctataaatggagctgtttatggcaatttaataccattctctttgtaaagtgaataaatattcatctttacccagtgcttgtcttgtggtatatgtagaggaatacagccacatgtttgggcttgtggtgtgaaggtttttaaaaagcagttttgctcccctggcattaaataggtaaatgctttcaaagcttgtggataacctagaatttgcaacgaagtgaaagaaccaagacatttgtgttagtctagtgtcagctatagccagttgattcttcatgcattcccacttggctgggttgtgacttcacaacccagggctgtagtgacagtaaagaaagaggcctgtgctgataatttcagtcctttactggtaaccaacacttggcttatgagtccggtttcccttatacctgactctgcctaaagaagtaaatgatgacaaccatatggtaatttctaattatttttttggtttagaaaaatctggagttaaattagtgttgttacaaaaag

SEQ ID NO: 93480 - DNA, 1092 bp, Homo sapiens
acctggccaatttttaaattaatttaaatagtcacatgtggctagtagttagctggtcagatgccacagctttaacttattagtctccaggaagccttcgttgaccctcttgaatctgtgctttcataggactcagctgtccttggtcatagcacttactactttcaactttctggtaggaatcaacactaggctgtaatttatatgagggcaaggacagatctggtttctttacctttgcatagcttagaacttagtaagaaaaactgaataaatatttgttaaatgcataaatagctttttcagggcaggtatttcaatttttaattctctctaaggccaactaagtgttcagtactgtaaatacctgtttagtagattgtacagatgttatgtaggtagcaaataaaaggatcattggagttatgctttaaatacttacgtggtgagattggaatctcaggagaatgatgactcataacaaagtattacaggaaattgaatgaaagggcctcatgattccagctaatgtagacacagctttggtctcctattagttgaataactcaaggacactcttgaaccatatctcaaatctgaagtctcctggcttcagtaaggcccttttatggggtccagacagtcctgaaccagcctgaagatgctagtggacatccccatttattactgctctgtgttaaagcatggaccaaggagtcttggaaaaaaaatcacaaggtatttgagccacgttatgtaagatgcttttgctaacagctaacttggagtgatgagtagggtgaaattcctatagaaatcagagtttggggaatttgattctagctattgttagtatcagaggcacctgttctgtagacagttgattagtgccaattttttttttttttttttgagatggagtttcgctcttcttgcccaggctggactgcagtggcgggatctcggcttaccgcaatctctgcctcccaggttcaagcgattcttctgcctcagcctcctgagtagctgggattacaggtgccctccaccatgcccagcgaattttttgtatttttagtagagatggggttt

SEQ ID NO: 93481 - DNA, 1054 bp, Homo sapiens
ctggtacttatgtgatggagcagatcccattctgcctcataatctatagttattagtggtattttattcaccttaatagattgtaaactacctaagaagcatggaccatctgttaactcatttttgtatttgctgaaacatctagaatagtgtcttgtatatagtggttccttaataaatactcattactgtttggaattgatagtatttgaggaagatcaccgctgctctataacactaattccatgaacttgtcattttcctatttatgtggcaaggttaatgtcaaaatgcttctaagtatttggtggtaagtaattttagcatccaagaaaatgtgaataccttaaaatagtaacaactggattaggttacctaatatataacatctatatccatataagcatacgatttttgaggaaaaagaaagcctcctactttttaccagttcctgccagtattaagaaaacatgaatcaagttaggaagacaacagtgagctcaatgaaatgactgttttattgtagtggggaactgatggtaaggataattgagttagatatagggttggttaagtagaacagagcacacattaagtagtagctagtatggtgttgtctactaccagatcaagccattgattacctatttttattctgtgctttctactgaaataatctaaactcatttttcatttagttttataatgttttgcttacattttaaaaacaggaattcatgatacttcagatagtaaagatcggatacaaaagaaactggaaggcttttagcttcataagtttggttttactagcagtttctctgctttctacatcatttctgagatgtaggctagggtgtagtacaaagtctaatttagagcaaatttattctaagcactcatgttttctgggaaaaagaggtaatataagccatgtgctttaaaaggcatggcttccatctttggccaggatagaactcacatacctcggaccttgttaagttgaacaatcttagtaaactcttagatttgtaagagggatatgattaatttt

SEQ ID NO: 93482 - DNA, 1225 bp, Homo sapiens
taatcaactgggcttattttcagatataacaaaatcagttatgcaggggaaaccttgaaccttgtgcattgtaccttaggtatgatacttgtctcactccatcttgacttctaattgtcttattttctttcctatattgtagcgctttgggatggagaacaatcattttatttttgtttatctcaaaaaggctaatatagtcatttgttattagttgctcaatgattgttgaataaatacattgaatgaaaggtaataatggatattgacattttgcataactggaattaaacgttgaaaccccgtctctactaaaaatacaaaaattagccaggcatggtggtgtgcgcctatattgtcagctactcaggaggctgaggcaggagaatcacttgaaccaggaggcagaggttgcagtgagctgagatcgcatcactgcactccagcctgggccacagagtgagactttgtctccaaaaaaaaaaaaaaaaaaaaaaaagcattgtagtcttagaattataggtttttgtagactcttatgaacctttccccactcacctccctgtgtagacatcatattttcaggatctctgtcagataaccatttaacctcttgcatgtcttcaatagtgggaaactaacaaaatagttaattttattgttaaaaagctttagttgtaataaaattgttttcgtatgttgactcaaaattggtctccctgaaattttggccaagtgattctagtttgatacatggcacaaattcctttataggatagcctttaagtatctgcagatagtttgaacattttaacttagcctgaaactccttaggctacacatttctgtttccttcaccagtttctcattgtcaggatttctagacccttttcatcgtagctgctttcttggtacactgtggtcagtctccccttgaaaagcggcatatataattgcatttattgagcaagtatttattgagggcctcttgtgtgctagggactgtcctggatgctggagatatcagtgaccaagacaggtcttctatagggaagaccagtaaacaaacaaatgaatagacaaagcaaaaataggtcataatgaattctgtggaagaaagaaacagggtgctgtgatagagaacaatgggggcaaggcagctgctttagatggggtggtcattcggagaatcagaagaggctggctgtgagaagagcctgggaag

SEQ ID NO: 93483 - DNA, 1050 bp, Homo sapiens
aattcctgcttggatattgagtttcccaacatagttatatccctttttttttttttttttttttttgagaagagtctcactttgatgcctaggctggagtgcagtggcacagtcataggtcactgtagccccgaactcctgggctcaagcaaccctcctgcctcagcccctgtagtagctggaactacaggtgtgtgctactatccagctaattaggattcttatgtcttcttggaaattgactcccttattattatttaatgttctttttcatccttggtaatgttcctggctctgaagtgagagcaaggaacattaccaagcataaaaaggtaatgttgagagagcgaatttttaaaattcactttgagagagtgaatttttaaaaactcccatggtgaagtaaagttgcaagagtaggacccttggaattactaataattccccaaaattattctggtttatattttctttaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtaaggttgatattatttaactcggtaagaattaattaaaaataatcaagttttactcttttacagttgttaaataaaacttttctcctgatttcttatgtgataaatgaggggcatgtggatgtagggaggactttttaaagataggagatagttatatttatttacactgacgagaggcgacgtgagagggagaaatggtggttgcaggagagaaaggggacatttccaggaggaaagtcctgaaaaacttgaaagggaaaaggatttcagtataagagttagccttgcattagatcaggcgcagctttccactatttatttatttgtttgagacggagtcttgctctgtcgcccaggctatagtgcagtggctcgatctcggctcactgcaacctctgcctcccaggttcaagcgattctcctgcctcagcctcc

SEQ ID NO: 93484 - DNA, 1018 bp, Homo sapiens
ctagataatccataattgaggaagttaaatgaagaatttcagaaagatttgccttgacaagctgcttcttggtccacatcttattttccaccgtttgacacgttctttatctgttacagttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtatctatggctttttcaaccaggctttcttggtgttttttatcttggtttgtttgtaagtagatttgctctttttaaatgtgtagaaggaaccctttacttcaatcagattgaactacttttactcttccccacctcccccgaaccttaagccttaaggtctctttgttttgccgtctcagatataagactttgcatttattttcatgtaattcattcttagtggttttacctcatctgaatttagcttcttcacaggcctttgtgtcatcttcatatttaaaaagcatgctttctgtgtttttattcaagtgattgttttaaaactatgtttgcttaaaacctaggagaaggtcagagggtcctctcccaggatggcaataccagccagttttgatatggctttttaactagccgtgaacctgcataatctcactcagtccacatttcttcagttatttgtaaagatacgtaaaacactttatcagacttcttttcgaaatgacatagattttgtctgttgcagttcacttatttgcctatatagcgaacttgtccagaaaggcaaaagccatcttggcaaaatacgttcttcatgaacctctttattaccagattctttttttagtgcttctattaatagttcttgtagtgaaccaacattttattatggaaaatattcatgacagatttctaaaaaaatacttgatgggaagaaacctccaaagctctcaacaataacattgacataataa

SEQ ID NO: 93485 - DNA, 1141 bp, Homo sapiens
gaacagctttctagatcatatttctctaggacttctatgtttaatagtgggcatttcaaggtttagttttgaatcaggttgacagggcagtggttttgttcttaataacaaaatcactttaggataattagaaccgtatagcaatttaaccttcaaatcacactacttttggctggtcacagtggctcatgcctgttatcttagcactttgggaagctgaggtgggaggatcactcaagcccaggagtttgagaccagcttggtcaacacagcaagaccctgtttctttaaaaaaaaaaaaaaaaaaaaaaaagtcaaatcacatgactttttatataatttacactgagtctaagtgaactattaatactataattctagtattttagtagaatagaaattgtcaaactatggcccatgggccaaatctgacctaccacttgtttttgtaaataaagttctttggaatgcagccatgcacatttgaaaaaaatatattgtctatatctactttcatgctgcaacagcagagttcaatagttgtggcagaggtggtatggctagcaaatcctaacatatttactgtccagcaatttgcagaaacagtttgctgtgacccctgttctagtagagatgctgcaggcaatcttggaagagttggtagtttaccagggatcaggttttgtgaatttcccatggcagtaattttcccaggaaactcttcacatttcctttgagcagcttgacctcacatgtgagaaacacaactgtagatgacttatgtgatgaaaggcatcagatatcaaaatcaccaactaactagactagttagaatacctagtgtgattttttggctaatgtgctttttgagtttttctccctttgttttttctcctcttttcctgccctgcccctgtatccctccctgacttaaacaggtttgaattcctcagcaacatctacagcaaataatagccgttgcgagggggaactccgcctcggagagagagtgttagtggtaggacagagactgggcaccattaggttctttgggacaacaaacttcgctccaggtaactcatctgcatattttcttaacttgaattctttagagtacaaaaggtttaaaattttacatgta

SEQ ID NO: 93486 - DNA, 1046 bp, Homo sapiens
gtaaatggactactagatacttctaattggtcttgaggcaccctcaattagaaaatccttattttaggattttgtgtccatttaccttatattgggtaaaaccacatttaaagcaaccttgctactttaattttaggctgtctagaaaaggaaatcctgttatttccttcagagtaggtccttttaaatacaaaaagtctttaaaataattctccctattagctaacctaaaccttttcatttaggtaaaaaaaaaaagatttttctttttaccttgggtggaaaaaagaaaagaaaaagcactcatcatgatgtctagtggtattttctataatatttttgtccttctttaattatttgagcactgtttgtggtgttctaatgttaggtgagtaagatgaaaagattgcatgttcattttatgatttttaaatctcaatattatgtttcacttctttcactgaaacactatattaccaagtcaagaacagtttttcactgcagcttttagatatattttggtcatatactgtttacacaattgccaattcttgccaaatttgtgtttgtgcattttattttcctcctttaatgtactgctctgcaattatgcttgtaaaatgtttttcctgttcactttttgaattttcaaagtttacaattttataatttgaaatcttaatgagtatcatgatcttccctcattttggtcatttatggaaatgttaaaacacctcgactttggttttgtatagtagcataagagttttggataaagtacagatgcttttgaaatgcaatattcatgttctaggatattggtatggtatagagcttgaaaaaccccatggcaagaatgatggttcagttggaggtgtgcagtattttagctgttctccaagatatggaatatttgctcccccatccagggtgcaaaggtgagagaatgaaatttatgtttatttacagaaactttttgtaatctgcagtggttaatagagacactaattttatattaaagatatgctctgattgtagctcatgtc

SEQ ID NO: 93487 - DNA, 1002 bp, Homo sapiens
ccgtcttacctggggtcactaactggttggttaactgagctaagaatagactgtgggtctcctcacttgtggcccagtgctctttctgctatacaaaatgtctaatctcagatttttcttctgctgcttgactgcttcatctggatgaactacaaaaaacccatgattaaggtttatgaattcaagtaataattagattttttttgcacagacttacttaacttccttattggatatgtttgtaacacataaacacaaagcacttttcaaacatgatgcacttttatctttgtgaataatttactgtcctttcctcctgggatatgagaaacattttaaaaaacgtatttaacagaagagagcaaataaagatatatcaggaaggatgtattagttatttacttaaatgtttataatatctggattttttttgttttgttactcatagaactggtgttgtttgctgtttttatttctctaattgttgcagagttctgcctgttacaaagctacagaactgtattgtttttattttccttcttgagcacatgttaacaaactaagcttcacattagagtgatgtcataatgtaaaatgtttgcattgtggttaggtattgaagtttatgtcctgtctgtgtaaagattcatcttttattgtaaatatttagactttaccacagaaatattggaacagtttgctttataagattaaaaagcatccttcagaatggagcttgccttgtgcttagaaataatatgttgaactattttgcaatatactattttaaatctaaattctgtcacttcgctgcctttttaaaatagtgtggtatttcaaatattgctagagctattttcctgaaatacatttgcaaaataaggctgctttgtaatcaaggaatatttttattgattgaaggaaatgactgtactgcgattcaaaagtaaacttattttattatacagattatttcttaaaaactctatttataccttaaca

SEQ ID NO: 93488 - DNA, 1062 bp, Homo sapiens
caaatacagtggttaatacaaaactcacgttatcgtgtatatttttagtaattgtttagtatcccttggtacacaggccttatttacaaacaatgtcacatatactgtttgattataaaataaacattcctaatgaaatttgtgtatgggctgaacaagttaagctttcaggacatgttaatagtgtattataagcagaatatgatgcctttgcataggcaaaaagattttgttctaccatattttttttgctaattctcctttttatgagaggaaaagtatacgtggtggaatttgagtagacgagcacatattactgacattaatatcgtttcattatgtgtggtcaaatgaaactttttgttttatagctctcccttgagagcagcctcaaggtgtaagagaagctttttccgtttatctttttagaatgtcttccagtgaatagaatgttcatgacaataaatcagcagcaaatttcatcatttactatacctttcaaatagggcaagcgtagtcgtcatggtggtgctgagaaggggcagggcattctgaattattaaagatatttcaggtgtttaaattgaggctgttagctgaaaacataatctgttcccaaggatcactggtgtcattttttaaatgctcataaatctggtttaaattcggctctaaaatctcacatgaacccagatatgtgagtttgttgctaccgtaaccccaatagactcctgtgtcaggagaaatttggtctcaggattagatatgtagtcagagttgtttcaactggctacataaaatccaactgggatcagttgaactgagcaagctaactatcctgtactgaatttgaattttaggcatttctaaagcatggaaggtttaaccatccaagtgctgtgttcttggcctgtgtccatctggtggaggttaagttctttcagttccagcccttcatgactttattccacgtagacagacttaccttattgaagactgaactaattattatttttcacctaacaaatcaaatcagactgacatggagatgaatcaggttaa

SEQ ID NO: 93489 - DNA, 1034 bp, Homo sapiens
ccaccattctacctgctgtctgtatggatttcactacacaaggtatctcatgtaagtgaaatggcacatttgtctttttgaaactggcttatttcacttagcatagtgtcttcaaggttcatccatatggaagcatgtgttagaatttatttccttttcaaagctgaattgaggaacaactatattgttttccatatcagccacaccattttacattcccaccaacaacacacaagggttcaaatttctctatatctttgccaacactcattattttctatttctatttttttatagtaaccataccaaatcagtcatcttcttgtatatttcggtcatattcattgaaggaatcaagtgaaagataacacattcaaaaaatgcccaatacatagtaggctgaatattattttcgttgttgttatttatccttcctgcctgcctatcatccagttttccttcttcattaggtttctcccaatcttgtggttctgagaagttcagaccctcacatgagaggcttagaaaagaactaaaaactaaaaaatacaaagaggttcttgactcctagccatagcaagtgatcttcatcttttcataggggactctacccgtttccaggtttctttgcctgaactgtacctatcaaatttgataacaccaaaccttcttacatttcctccaaggacaccctgcttcctctcccccctagctggaagaatggcccatccactgcacactgctaggttggagtctgttttgcacttggctttgtgcctagaatgggaagcactttttttttgagagatggagtcttgctctgttgtccaggctggaatgcaaaagcacaatcatagctcactgcagactcaacctcctgcagtgaaggctaaagcgatcctccctccttagccttccaagtagctaatactacaggcacatgccactgggcccagctgggaagcccttgctgactgtctcccagcctctcgctactcactgtgaatcagccatcactctcctccatgtatggt

SEQ ID NO: 93490 - DNA, 1051 bp, Homo sapiens
gttccccacttccccctacctccaaccccaggcaaccaccactatactttctgtctatatgaatttgactactctaggtacctcaaaaatgtagaattcgatggtatttgtcgttttgtgattgacatttcacttagcataatgtgctcaaggttcattcatattgtaacgtgtgtcagagttttcttccttttttaatgctgaataatattccattgtatgtatataccacatttggtttattcattcatctgtcaatggagacttgagttgctttcaacatttgactattgtgaataatgctgctataatcatggttgtgcaaatacctcttcaagaccctgctttcccttttcttggatatatacctagaagtggaattgctggatcctacggtaatttggcttttaattttctaaggagttaccatgatgtttccatagtggctgcatcattttacattcctaccagcagtgcacaaggattccaatgtctctacatcctcactgatattttcacctcttcctttaagtgtctttgtcagttacaagctgggtcattccccagtgtcccacccaaaacactgtttcggtcttctttaccccatccaaatcctgcttaactttttttttttgttttgtttttgagacggagtcttgctccgtcacccaggctggagggcagtggcacaatctcggctcaccgcaagctctgcctcctgggttcacaccattctcctgcctcagcctcctgaggagctgggactacaggcacccaccaccaggcctggctaattttttgtatttttagtaaagatggggtttcaccgtgttggccaggatggtctcaatctcccgacctcatgatccacccgcctcggcctcccaaagtgctgggattacagacatgagccaatcctgctcaacttctaaagctaagtctcatattttctaaaaagtgcaaagcattatcccctgatgagctcaccctgtttatacctgatcatgagtgtctcattctctaatcgccttctattaccccactagagatc

SEQ ID NO: 93491 - DNA, 1054 bp, Homo sapiens
tatatgtggttttattacacatttgtgtgacaaatgtttctatgcatagacagaccactttctttaagaaacattgtagaaaagagtctgataatgaagctaaagtatttgtagagatatttttgatttcacaagttagtattattaataaaaggagaaaaatcaaaatttggaaatataatttactacaaattgtctggaggagaaatatttacagcttatgacacagactgaatagtgtaagcttataaacaccaaatggaggctacctcatggcccttgagggctagtaataagccttgagaaacctagaaaatgtcatcagtatatacctgtgcaggtagaatattgatcagaaaaccctaagctaaatgtcacttccacatttaaatgaaacctggatggttctcacaggccccactaaaatcaatagcaaaaccctaaggcttcttgataatagcttctgtatttaaatgagagtgaattcatgaaatcacagtggccacctttctatttgccctgccttacctgccaccattcaagtccttatatagagactacaaccttgagaattgattcttgctacatttcttgtatccctcgtcattgaaagttgtcttgacagtaacacaaatcctcaagacagtcttgtttgcaatagtaaggactgtgatgacaataataacaggagtgaacagttcttgaacccttgctgaatgccacacagtgtgctaagcattttacatgggtttcctccgtgagacttctccatagttctacaagagagtcctgtcactgtccctatttcatagacactttagaaacgctacatgccttgtcctacagtaagatcacacagcaagtaatggcagagccaggacttggcataggtggtcagagctctgaacagtggggaaataaccccctaggctgcggcatctcccagataggctctgcagatactagttgggctatcacaggtacaaattcctgatgccaggtttggcttggggtgcattttgaccatctcctcactgagggggcatacagatgc

SEQ ID NO: 93492 - DNA, 1130 bp, Homo sapiens
gttcagatgtccacacactatatgtggtaaccagtttgcctttgcagatgccattccctttcctggtgatgtatcttgcttcccagtaccagccctggaaactttaatacctgcccatatcattttaacttttcaatgcatatttcaaacccaccatgacccccaagaaaccattattatttttccccagccaaaaagattatcttctttggctttcccccataccattttatctctttggctttcccccataccattttatctctgtctcttttaaatcttcacttcttactttctattaggtgttattattattcctaaattttaaatctctaataaactctgagctcccagaggaaagaggcaggttggatttaatctcacatagtatgatacttggggtaccaaactatgtaggtgctaaataaaagttggtggaataaatgactaaatgatagttactgaaacaattcctgaagacagtaggcaaactgagtttaaattcaagtagagaagtaaatatggaaagagattgggatttatccatgtagtactaatggaagaaattataacaggttttttgttgttgttgcttattttgatttgcctgtttttctttttttaaagaagagctgaataggtgagagttgagtctgagacaggagagaaactgcagaacacagctcaggatgagaaggacccagtgaaaaaggaagctgaaagagaggaggatatttaatgcccctgagaagaaatttatgccgacccagatttgaagtcaacctctgattatctactatttatatattttaaagaaatatgcaggagattttagtgcttccttttttgtttgtctctcaatatatgcatgagccagcacaattcaggacttgatttacctttgctgattcggcttcttttctctgagcttatttatggctgtgagagaggcattctgtccttgctgataaaggacaaccgaattgcattcaaagctcagccactgagttgctttgcttctgctagaaagttggtttcttctccaatggccaagttttcctgaactataggaaataaggtgcatatttgaaaggtagagtcctagactagaacttctcaaattttaatgt

SEQ ID NO: 93493 - DNA, 1081 bp, Homo sapiens
atgtgtatgttttaccttaattttttttaaaagaataagttacttgcttaaagtcacatggctagttaatggcatgctcaagattggagctcagatctgtgtcttcagcccatcatcctctttcagaatagtcctggatgagaaattaggaagttcttctggatcataaggtcatacatgaataattgattcagttatcaaaagaggtctcagaatctcctgtttgggagacactgagtaatgagtactggtctagaatggtttagaaaggagatgagagccttgaggagatacaagggcattgatcaagtgacttctgggagctcctttcttattctatgactcaacagagtaagaaaataccatttttttgatagtttcaaattaggtagctcattttcaaagcagtggggagaaaaaaaagggaccctagaaacgaccatctagtaattcaatccctgttaatatagtggaacaaatattaagaggaataaaatactatctaggataatggaattatgagcaataagcattataggttttaaaagaacaaatcatgccagacaaagttgattgcttttttgatgagtagactaacggaatagagtagatgtaatacatcttgatttcagcaaaagattttatagtgtctcatgaaattttactcaggaaattaattgaaaatggcctagagatgagcactgttgcgtgaacttcggcatggtggcaggacagcagaagggaatgagaaacacccatgcatgagagtagggagacatggggcagggaatttcaggtcaagggttagttctatttaattatttcattacttctcaggaacaagaggaggttgatcttacgtaagtgaaattcatggtatatcttatctgtgtgctttaatgaaaaaaaaaatcatttgaaagctagcaagtctacgtaggttccaatcccaggcttaaactcattctgggtcccaggggaagccctgttgaagcaaacaatatcaagtaggccaatacttaatttcaactctaattctgaatgatgaagtgggtgtaatgttcttagccaagagctctgc

SEQ ID NO: 93494 - DNA, 1441 bp, Homo sapiens
ggcctgttaggatgggatgcatagctggaggtgagtagcaagcaagccagcattactgcctgagctccgcctcctgtcagatcagctgccgcattagattcttataggaacatgaatcctattgtgattataaaaacgtgaatcgtattgtgcactgtgcacacacacagactgtgcatgcaagggttctaggttgagtacttcttatgagaatctaatgcctgatgatctgaggtggaacagtttcatcccaaaaccatccgtggaaaaattgtcttccaagaaactagtccttgatgccaaaaaggttggggaccattgctctagagcatgtaactaagagtggaattgctgggtgagagggtcagaacatcttccatttcattgggtaatgccaatctattttccaaagtggttacaccaatttgtactccctctagtaatatattggtattcctccccatggctttacatcctcatcagtattgctattgtcaggctgtatttttttgtctgtctggtgaattaaatacagcatcccattgcagcttcaattttcatagaaatctgttttatttcatttttcataagtttcttggatgattctgaggcatagctgggcttgtaatactgttgacttactcccattcagacttactcccattcagccacccctaggactatctccagattccaacacttgacctctagaaacattttttttggtcgttacaggttttttaaaaatttatattccaggagtggaactgtgattacagttcagtgagatcaagagacagggacaagtggaaattgtgttctttgtaaattccacagatgttactgagtcacacatgataactttgaaagtttgtgctttaaagaaatgtttttaaacagtgccaataaattgtacatttcacttggtgacctgtttctcctcctccacctgtgatcgctgacatgcgcacaatacactgagtgctatgacaaaacaaaaaagaagggggggagaggagggaaggaagaaaataaataaatttttacttctcagcattctttagcatggaaacatatcaatgcctttagtttttatgaagctggatcccaagggtcagtgcacacactgaatgtgaaactttcccattagatgaatcaggattggaatatctgttttttttaaagtaaatgttgtcaacttccattgctctgaaaagtcatcactgttagcatcaggtagtagttagcaatactaaggatggtggtgtgaacaaccatagcaaaagctgctgtggatacaccagtctcctttaccaagctctttcatgaatggacacatccaaacataacttaagagaggctcaccactgtcagaaacttctgctaatttgtctggggtctaatggagtggtctgtactcacacagcatggatcagtcacg

SEQ ID NO: 93495 - DNA, 1509 bp, Homo sapiens
tgtaatgttcctaatccctagcacagtgactggcacatatttgaagaataaatgggccaggtgcggtggctcatgcctgtaatcccagcactttgaaaggctgaggcgggtggatcacttgaggccaggatttcaagacaagcctggctaacatggtgaaaccctgtctctactaaaaatacaataattagccagtcgtggtggtgcgtgcctgtaatcccaactactcaggaggctgaggcaggagaatctgccgggaggcagagattgcagtgagccgagatcgtgccactgcatgccagcctgggcaacagagtgagtgagactctgtctcaaaaaaaaaaaaaaaaatcaatgagtaaatgatctactgtactttgctaaggggcttgcttcagagtcatggaaatagttataaagacatcaacacagtatatagaggattgactacatgctgagacagggtagtgaataaacagacagggtccttgtccccttctgagtttacaacctagctgggaaggcagatatgacacagatacttaggactgacaaagtataaaatctgaaaagagttgttaacaaaagtcctgggagtcttgagagcatttaaaaggtccggaaggtcctcccgggaaatggacttttgagctgagccatgaagcaagaccaatttagccaagtgaaaagggggaagaagagaattgtagtccaagggaactgcatgtgcaaaggcctggaggcggggtaggcccagaatgttcaaggagcataaaggagtgcagggagcccaaggatgtgggctccttgccactgtgtgtagaaacctattagtcccgctcagtgctcgggctttttgtgttctggcttgatgcttacatcagcacaactgaggtgcatctgggccaacggcagcctccttgcatgtacttattaaaacttgggtttgttattcttttcagttcatttaagcactggcagaaagggctgagctgacaggtctgaagactgatggatggatgggtgatgcggcacaggtgcttgaggtgctgcgactcttttttgccactccctgtttggcagtgacagccccgcaggaacagcacagccttgagtcagccctgggtgtcctctcattggcaagctctatgagcctcaatctccccactaacaaaatggggaggtgggtactaatatgtgcctcgtaaaaaacaagataattagaagggatataatgtgctcagtttgttgcctggcacatgcaggggaccccggaatggtgagcctgtctctcattcctccctcttcaaacccagccttcttctactcagcggaatccattccagagaaggaagacttgaagctaacgttttccatcctgggccctttgaaattccggttacctgagatagtctgcagaaataggtgctgtggtaaaataggtccgtggagaattcttcccctaaaaccgcaaggttccttcttaaagcaccaaccaggggattttcc

SEQ ID NO: 93496 - DNA, 1077 bp, Homo sapiens
gcttgagtcttgggcaaaatgaaaaagacttcagcaatctcactcacattccagtttgtttcttctgaaaggtaattttgtgtttttatcgccaattttcttaaagctgagtctggttttcctgaagcaacaactgtgtgcctgctgtttgcaggatatcggtatgttctgctgaaatggctcccacctccccactcccctcatatataccaggaagtgcctgggacagaactgtcctctgcttgtgtctaactccttgtacccatgagcttacgtgcaccaggatatcagcagtgcttagaggcaggtaggggagagagggcagagtcctgtgagaaatctgtggccagagtgtaggcccagctctccggatgtctaagccagtacttgtccctctttttgctatgctgtcccccacagcaggatccatcctgaaaagggatacttcttgtcagtggttcagggcagctcgacttgatcctcccttctgtgtcagaggcacattcaaaactgctggtggaaggagatactgcctctgtggatttctcgtaggtcttctagttgagccatgctttataaactaaagcagaagagagcactgcatctcttgctaaacaacagggagaatggtttaggaggcactataacgtaataacatagtgcaaaggctaggttggattcctgggttcaatcatagcttcaaataattagcagtctgaacttggatcagttctttgttgttgttgttgttgttgtttttgttgttgttgttgttgagacggaggtcttgctctgtcacccagcctggaatgcaatggtatgatctcggttcactgcaacctctgcctcctgggttcaagcgattcttctgctcagtctcccaagtagctgggattacaggtgcctgccaccacacctggctaatttttgtacttttagtagagacagggttttgccacattggccaggctggtcttgaactcctgacctcaagtgatctgcccgcctcagccttccaaagtgctgggattacaggcgtgagccactgtgcccagcctggaccagttctttaactcc

SEQ ID NO: 93497 - DNA, 1024 bp, Homo sapiens
gcctcttctatgaaacagaatagtatgcctgcctcctagggttgctgttaacatttgcagagtgctcaaagtattagctatttttgttattttcttcttccagggacctgagtctgggctgttgcaccccaggggaggtcagccccaagtttctttattccttgtaccactgtgggagaaatcaggccccagactttggaagagaggtttaaagagatagcctctcggatgttactgaaatatgaacttatcctttctttctctccttaagtttcttccagacatgacagccatggacttaatagaattcaattcactaaaattctattcattctggatatgaatgatagaaggatctttcccaggaagctgcttatgggactgatgatatagatgctatttgccacacaattgtgagttacggggttccacaaggagaacagactgagtttagatgagacacttggagtcggcagatgtggatgctgtagagttcagcatcgggtccgggttacaagctgatattactacagtgggccattatttgtgcaaggcagggcctctcattttataaagaaacagacacccatatccctgtaagttctaggaaatttatttttatgcctcttcttttttaatataaataatgaatttagcaggctgtcttgggggagacagtgactccttgcttctggtgtaacaagaatatgcaaccttgagccctcaacacagttatttccttagcctgctttccctcctcctcctcctccatccactccctaattcccctcaaacccccattcttagtgctaagagattctagcttgtgacatctctgctgcatctttcttgggcacttactgcccagactgaaatggatgtttggcctttacctaaatatgaggtgaggacacctggaaaagacatttttgaatcttctttggtgcctggcacagtgcggaacctctagtagatgggctcaggaaatactggctggagaaaggcatgaatgtgctgtactctg

SEQ ID NO: 93498 - DNA, 1039 bp, Homo sapiens
gcagtggcttagagggtgggtagctaaagaagtgttggggcagccagaccaggcttcctggacgaggaaagggcttgggagaaagcacaggggcagagatgagcaaaggatttctctgtattcccggggaacagttcccttgggaagtactacaaaatacactgggaggcacagctgagaccagatggtacaaccaagtctagggagaggaaacacccccgagcctggctgcatagaccccagactatcttgaccccaaatgaagctatccttgaggttgtggccaaggtcccttttgggaggcctcatgcaagggattgaggcctttttctgcagttgccaatgagaattccctgttcagtctctttatcaggctctggggcatccctgagagttgctggctttgcccttgtttttaaacctttttatagaagtataacaatcatagaaaaaattacataaaccttaagtgcatagcacaaagaatttttttcaaatgaacacacctatgttccccctgcctccccacatcatgatcaagaaacaggacattcccagcacccggaagtgcccccgcctctgccattcctcatctggcactgccctccctgcagggaaccagtcccgacttctaacttgctgctttttgtcttctatgggctctttggtttctagcttcccagcgtgatgtttgtgagctatgtccacagtgttgcctgtagttgtagattgattcatcctcattgctgtgtgatattccatcaggtgacgtgtatacactgccattgatttgtcttgttctactgtcaatgggcattttggtagtttgcagtttggggctatcattttgttgcattttaaactttgacctgggtcttccttttcagtttgctcagattccccttattgtcactaatttcctctcctctaaaactgttgtactctgttgtatgtgtgtttgacaatggaaacaaataaaaaaagaatactaaatgaaaaattggcaccacgagattggagggatgaggggggagggcac

SEQ ID NO: 93499 - DNA, 1015 bp, Homo sapiens
cacaaggtttcctgagtgaaatgactagtcttattttctaatatttaaatataagtgttattgaaatatagtgaacttgaaagtcatctaacaaaacaggaaaaaataaggcattattgaggggggagaacaaaaatatatccttaaaacgtactgcaaatgaagacctgattccacaacaggacatcatttgacacagcaaagtaaactggtcacgtactgcaagaggaaagcagagcttgcttgtgtcactgaaaacttagcttgttatatattttgcacaaaaattggaaagttgattgtatggatcaaactgttttcccatgtagattttttaatagcgtttagtcacaactcagtataaagagttgatgaaattacaatagcagtaagtgctgattattatagtaatcaacccagcactcttaaaagttatttgggtttttatcctttgttttggcgagggaagagattaaaaacgagataggaaagctggcttccacgggattccattttagcagagtcattgcgaaacaaaaccacctctgcaaggggcaggttcctttaaccctttctgcgctagatgcctgcatactcagttccctgcagcagtctttgtaccttgcctttgtcccatcttctgatgcaatggaaaacccactgtggtctgtccaacactggggatctggtgaagtgtgtattctatggaaatgccctgaggcgatggtttcatttactaaggaaaagtttatctgtgaactgggtgtttttccgtcagaaggttctatgagatgcgaatagatacctaccctccctggtatttttagggctgggaagtggtgcctcccttgactaattccacttaccagggttgaaaccaaactggattattaattatagggacaacaagtacctattttaagacccagaactgtgacatgcttcagaaggtttctaactttcctccagcttctgatttctatcacctggttgcttagctttagcataattagca

SEQ ID NO: 93500 - DNA, 1058 bp, Homo sapiens
tagaaatgggcggcacatgcctttgaccatatttttgtagctctatgtagcagaaatgaagtggtacgtatgaatgtatgttgggtttaacagtcacactcgctgaccctgaaagttttatccggatgtgaggagagtttgaatctaatacagtgatgaaggggagggaggaaaacttccaaaagtgatttaggaagtcttgttaattttgcagttttttaaatgacttactagggtttctagtttaggagagtttgtgattgcagttggcatcaaccaagatagggaatacaggaggaacagcatggaagcaggaagggctgatggtaaaccctgagggagagagtaaatctgatagccctctaatcactagagagataatagaatgcagtggcttggccacttctggaaagtcacagtctctttaattcatctataaaagtgaggtgataaatacctactttaaaaattgtcaaaattaaatgcggtatgtaaataccaagtacagtgtcccatacagtgtagatgctaaataattattaggtctaaggcagagttcaatatgttattcaggtccagagaagcctgattcaagtgttatatcttagtatcttagctttttaatgactgtcctttgtttttttttttttttttttggtttttttgagacggagtctcattctgtggcccaggctggaatgcagtagcacaatctcagctcactgcaagctccgcctcctgggttcatgcctttctcctgcctcagcctcctgagtagctgggactacaggtgcccgccaccatgcccggctaatttttttgtatttttagtagagacggggtttcacagtgttagccaggatggtttcgatctcctgacgtcgtgatccgcccaccttggcctccccaaagggccgggattacaggtgtgagccaccgcgcccggcctttgtcctccttaaataagtggctgtcttagttccttctggctgctctaacagggtactatagactgtatggcttataaacaacaaatttatttctcccagttctagagg

SEQ ID NO: 93501 - DNA, 1055 bp, Homo sapiens
ttttaaattaaaactgtggtatattcttgactatatctagatctttaagaatactgtttaggataattagttatgatggatttaagaacttgcatatagtaacttccctaacttttgaatgttataaagtgttaccctagtttcagacatatgtttcaaacttacatcttttcagtgtttcagcacttttatgatttattgaatcagtaagatttcttaaagataatcaagttatgtatgggaaagcttatctttcccttattctgttctcattgctttagccttatgccagcctggaccatcttggaggcagtgtaggatcatggaagaactttgaattaggtgaattgcattctgtacttttctgtagttaacagctttgtaacctttgaccagttaataacctttttagccttgacttggatgatctgtgaagtgatggtaacaacctcacagagctgtgacaattttgaaataagtacctagtaacagtgctccctagacattgacttaaagttagtcatcacctctatagttgtagatgcacctggtgatcacagacctactcactctgtgttctcaaaccagactactctcttcttgttttctaattgcccctttatctacttgtatcccactgaaacctcacaattcttttctgaaattatacatgctcagaacgtatacttaacatttatgctaaaccttttttctcacctctctgccagtgctttacatcattcattttctgaaattccactttccattttctttttccacaccagccataagagaagtgacactattctttggccttggctaataggtttacttccttggctcactgctttaaaatcttcttagcttaggcatgcctgtttatttgttcagtgtgtgaactttggatctttttgttcaggatcagctatttcacacatcgagtactacaaagcagagattacataaatacgtatacaaattgttctctatgacaccccccaagtaggtgctaacatgattattataatgcatttgttatccttttctatttgctc

SEQ ID NO: 93502 - DNA, 1043 bp, Homo sapiens
gcaatttccagatgtctgcctgccccagcagcttctaataaataagtcttgcgtattataggtttgactaaactaacaagttctttctccttttctgaagttgctgttgcattaaccataatattttgtacatacttggcaaataactaacatgccttgcaattttgattttccttgtcccttgttaggtagttaacctgcagtacagtgaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttctttctttctttttttttaaattttgtattttccatccaacagcagtgtgtagagagaatattatgcagatgccgttaattttttaccctatgtttacatcttgaggcagcagagtctgtctgcagctatgtggtgagctatgtaaggaaaaaaatctgggctgttagagtgaaaaagtgtgttttatgtcaattgtgaaaggaaaatgttaggagtatggtttttaaacttgggcttcattttaaacttttttttttaaacccagttatttcacttgatttgctagcttcagagaagagatccgaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaacttttt

SEQ ID NO: 93503 - DNA, 1346 bp, Homo sapiens
attaggctctacagacttgtcaaaaaatcaatgcaaaactgagggggaaaggctgaaatgctttgtaaagcagtatttttagacaagttgcttcatttcccccttttctaaaacagatgcagattaaatgtttttttgcatgaatgcacattgacattctgttcaactgttttctaaatgcaacactgcgggtttcaacagtatgctttcatttaaacaaagaatattatatgcatggtcaatttagtttaagagatgaaaaaaaactttactactatgaaaattgcttatcaaatactctcctcttttataaggtgtttttaaaagcaacacaggaccaaaagcatccaactattactttatttatattactatgcttaagttacatggaaaaagacaacccagcagttctgtcccatctcagaaaaagtttccaatcaacaccaattatgtggtgacaaataactaggaatggtgacatctttgggccaagactgacaaggaagaatgggctctggtgctacggttcatctccaacaagaatatggcacaccggccagcacaagccatgctaacactgagcctttagcgctgggcacagattcggatctcttctctgaagctagcaaatcaagtgaaataactgggtttaaaaaaaaaagtttaaaatgaagcccaagtttaaaaaccatactcctaacattttcctttcacaattgacataaaacacactttttcactctaacagcccagatttttttccttacatagctcaccacatagctgcagacagactctgctgcctcaagatgtaaacatagggtaaaaaattaacggcatctgcataatattctctctacacactgctgttggatggaaaatacaaaatttaaaaaaaaagaaagaaagaaagaaaggttccatcttagattctcacaacctcttgttccgcagttcattaatccgactctgatgctaaggtgacagtgtatgtaagtagatttttgttttcagtgaaggagacctgggaaaagatggatttctctctgtatcttcaagagttatcagatggtacatgctcctcaaagccctcactctctcgaactagagcacgttccaggatcacgcggccttccttatatcgctggctgtcttcagtggcaaactcatagatccatcccagtttgctattgcagtttttgcagctcacatctcgaaccatgtggcggccagtgagcatgacccgatcttgaacttcactgtactgcaggttaactacctaacaagggacaaggaaaatcaaaattgcaaggcatgttagttatttgccaagtatgtacaaaata

SEQ ID NO: 93504 - DNA, 1048 bp, Homo sapiens
ctcgcagaagtgggagaggccggcagcctgcaccgagaggggctttcctctctcttgctccccgcttcgttctgttttggctgcagagagtggttcatccatactctcattccctcgcctccccttgtggacgggggtcttgccttttcaattcctgtgttttggtgtcttcccttatctgctaccctgaatcacctgtcctggtcttgctgtgtgatgggaacatgcttgtaaactgcgtaacaaatctactttgtgtatgtgtctgtttatgggggtggtttattatttttgctggtccctagaccactttgtatgaccgtttgcagtctgagcaggccaggggctgacagctaatgtcaggaccctcagcggtggagcctgctggggggacccagctgctcttggacaagtggctgagctcctatctggcctcctctttttttttttttcaagtaatttgtgtgtatttctaactgattgtattgaaaaaattcctagtatttcagtaaaaatgcctgttgtgagatgaacctcctgtaacttctatctgttcttttttgaggctcagggagaaactagcatttttttttttccaaactactttttgtcactgtgacagttgtaaataaagtttgaaaatgctttccactctggtctggtttcctttttcccttcctgttccgttggaatggagtgagctcaggagcaagaagaagtcctgcaggaggctgagctgggggagtcccaagagaggctccttatgtagctcacctgatggcttgtctggggagaattcactggggagatttaacccacagccaaggtgtgaactacccttctaaaggaagaaaaacccaagacatatctgaaggtcattcacaggggctggagggtgagtgggtgggcatgtggcaagctcaggctatcatgcaaagcatttactgagcacctactgcttggcaggcattagtaagaggtcaaggtcacaaatggcaatggccctggttctcatggccctgccttggtgaaaaattaaatgacgaat

SEQ ID NO: 93505 - DNA, 1044 bp, Homo sapiens
ggcggagcttgcagtgagccgagattgcgccactgcactccagccggggcgacagagcgagactccatctcaaaagaaaaaaaaaaaagaaaaggattgttgcaataagtagaggtgatatctagacacatttatctgtgggttaaaaggagcttgtcttattctcagttccctctctgactctctacctgaactttaacattgttttcttttcctgtgtcttggtttccacatttataagctagacttgtaccaagaagaaaccaatacataattggaaaaagaaaatgctatgtaaataatattagaggttctcctgctgtttgcttgacagcagttcacttggaaggttcaagatccttttgatcttagatgagaggcaccagctgctgagagagatgaagtctgatttaatccagagttaaccttccagaatatctttgtcaataatttgtgatgcttctttgtagtctaaattcaggataaaggaggagaatatgatttgtggaattggtaatcactataaactataatttctgatcaaaccgttttattttgtgttgtttatgtttcccacatacgcccttctgcgcagactcaagaaaccagtatctggacagatacttaggaactcgcaaaggccttttatcctgactatttaagcaaaaataaacgatagctcaagatatcagaagctacacaaaattcagaatggaaagtatgtccagcacttttgactcctgattttgagaggctttaagataatgtcgctccacagagccaatatggagaaaggctcattttggttggggggggtggtggggggtcacaaaacgtacttactggactacatacaactgtctccctgcaatcctccctcacgtctccacagccagattggagcagcctgtggaaaaaattcctgtctattttcagaaacagataaaagcattcagattatgcagtacaaatctcagcctgaaagcagctggaaaaatctgtttcttgccactgtcactgacccccctgacccttgcaagtaat

SEQ ID NO: 93506 - DNA, 1073 bp, Homo sapiens
gattagggattgaagtcactttaagtccaagaaaagtattgaagatatgtgttgaaggcattaccaagatgaaatatttattcatatcattaacttatttgttcaaagaaacgtcatctcatgaagtataactacgtgggttagttttcaaaaaactgacttgatgaaagccctttttgtaaaacatattttttgagagtaagtaaaaatacatcatcactttttcgtttaggtttctgttgcacattgtactttgatatgcttgatatgacagataagcataatgttaactgacttttgtttttggtagtaggcttgattttatggagtagtaccttgttctgtaactgagaaaaacgtaatagcgcttgtgtttcagtcatcaatagctgcaatctctggagtgccaactatgtgtcagtttctgtgaaagctaggcttctcctactttttaatttgaacacatggtcgtctgcatctgcccccaccaggtctttaggctggctgttgctgacaaccaggaggaagcaatggggaaaacccaaaagattcttccaaactggatccatggagatttggtcagtttgtcctggggttgaggttatgggtggattctagtccaaactctgccacttaaaaatatcttagggtaatcatacaacttcactattggtgtcttatctctaaagtgagtatttcttattcaaacaatctcattgcactgttgggaggaaaaagaaaagacagtatgtgtgaaagggctttaaaaagttaaaaaaacagtgaaaatatttgaaatttattcctctgcattcatgtactctgccaggcactgaatccggggacttatatgtgccaactcagtcatctagcatcactgtgaggcggatacatttattatctttattttgcagatgaggaaactgaagcacattgaagtttaagtaatttgtccatatcacacaattagcattgtgtttccagcctgtgttcttactgtcttactaccaccatgcctactatcttcctatgacatacagatgtgttatgtattaaggggaaacattaattca

SEQ ID NO: 93507 - DNA, 1101 bp, Homo sapiens
ttgaaaaaaaaatgatttgttgtctctgaatatagttgatatttgtgtaccatatatccatggcctcaccagtcaggagagagatttccatcttggaaaatagtttgtctggagtgaatgtttctgattaattcattatgtgtataggaaaattatatatgtatgacagttacatatgttagacagttatatgtgtctaactgtattacatatataactaccatatgacagttgcatatgctattatgaagacatatatatgtatgtgtgtatacatatatataaagttctgaacaaggagggcgggttgtatgcttcttatagtaaaaggaatctgaatctattacgatctttcttttaagttagtgtccttgggataaggagagcaggtagacggaagagaacctggtaagcttaaaagccacctgattctcctgatttgggtcacccgcatctggaacatcctctttaatttggttatcaacatgttttttcatccctttatttattctataattccttataatcgtgataatttatgaacctaaacaaagactttttgtgttgatttcttcagtgacataaaaattaacctacttctgtggatggatagatgaacatggatgcgttctatggagcagagtctaccaaaattatttttttaaatcatctgaaacaaattgtgctattggattgaccattttcctcagttgttttaactgtttacagggaatgaagatgagtgggcaacaggttgtggttgctagagttcatgtcttcaccattatctgcagtctgaatattggctctaaaggttctgaaacctggtttcctagttttatgcagtgctaatttataccagtgaaatttataagggattgattttcaaaacccaaaggcttgtttattagtttacatgggcagtggacctttccagtccaattcactgtttggattgtttttgtgttggtatctgagtatcaaacaacatcttaccaataataagaaaactgtgtaatgtgttaaagataatataatgacttatgcagctatgaaaatacatgtgttaaagaaaaactcataatcagggaagaaggcaaa

SEQ ID NO: 93508 - DNA, 1021 bp, Homo sapiens
cacgcgccaccatgcccagctaatttttgtatttttagtagagatggggtttcctcatgttggccaggatggtctcgatctcctgacctcgtgatctgctccccttggcctcccaaaatgctgggattacaggcatgagccaccgctggaccaaccccctaaacttatattgtgttgtttctttgtagtcaaaccatctccctacttgtaatctttgccaaccgctgatctgtttccttatcctttgggtttgccttgtctggaatgtcatataaatgaaataatccagtaaaagattttaaaatcatatcttttgagtctggcctctttcattcagcataatacatttgagattaactcaacatgttgcatggatcagtagtttgtcgttattctgagtagtatgccattgtgtggatgtactacggttttgtttatccattctccctgactgacatttggctggtttccagtttttggtaattatgaataatgctgctgtgaataattacgtataggtttttgtgtgaatatacattttcatttgtcttggatattcagtagaatttctgggttttattgtaagtgtatatttaggattttaagaaactaccaaacttttccaaagtggccatcccattttgcattcccaccagcaatgtttgcaagttctggttgctgcatatccttgtcagctcctggtattgtcagtggttttattgttttaaaatttttttttttagctattccaaataagtgtatagctagcataatttggaaccaagtttgtccatcaaactcttgagacttggaagaagataaagaatagggctggattaaatgcagagtcacataggagctcataaggaagagatggagagaccatcagatttgtgagagctttgcaatttctgtcatattcactgttgtaatccccagatgactaacatagtgcctggcacacggtaattgggatatctttgtatgtttattgaatcattgaaaatcaacaaatgattga

SEQ ID NO: 93509 - DNA, 1006 bp, Homo sapiens
tacctttccgggatttttttttttcccctgtacccagtgctaattctttgactgttctttctagaaaaaaaggtaataatgttacatatctatatccttaaaatattacacagtagaatattgatattcaccttttatactttttgcttaataagatatcttgatttcaaggacaatcagcattttttaattaggacatcacagaagcttaaaatagaaatagtgcttgatattctcattcttctagataacctcaccactcaattttttattatagaagcaaggatcatgggaaatactaacttttacatgttagaaatcataagatttatttatagggcatgataaaatttacctatggaaaatcataactttaatttgctgtatatctgtattgttttcttaggcattattggagaccatgtttggtgtaaaagtgattataactggggatgcatttgttcctggagaaagaagtgtcattatcatgaaccatcggacaagaatggactggatgttcctgtggaattgcctgatgcgatatagctacctcagattggagaaaatttgcctcaaagcgagtctcaaaggtgttcctggatttggtaggttattcacacattattttaagtggttcattcattttagatgtaatgcacccactgtaaaactgacttaagcattaaagcgattccatttttttcctcactgggccaaaaacaatctctggttcttttgtctttagtggatctgctatggcagatgactttattttaatctgtttttaaaaaatattactctgaaagagaaaataaactgttctcaaggaaatggatatatagtatctgaggaccacagcattgaaggatatgaattaatagtttagtaactttttattgcaggtagtacttgtgatttcggccagaaactggtctgtgctgataaagtacttgacattgactgattcattcatattcatgtagtaagtattaattgaatatgtagg

SEQ ID NO: 93510 - DNA, 1053 bp, Homo sapiens
tgtgttattccacatattacttaataactaaaggtcagaagtagtattttactaatcttaacagtgaaccactgtgatgcacacatcctatgacagagaatgaaaataccagatactggctttctcagcctcctgtcagcagggatggttgtttgagccagtctaaccaaagggtcttatgggagtctgttggagtctctgggaaagatactcctccttaataagatgaaagaagtcaatgaaggtccagtgccactcttttctgcttgtggacagtattgtgttagcacatgaggcttggaacttttgcaggcattccctcaaagagggggaggtcctcagacatcaggaggatggcatagtagagtgggagatcctggctcctgaactagcgttggggccagactttattttacgtgagaagcgtaaacccaaattgtttatatgacttttagattggtattctgttatttatagccaaaagcatcctgatgtaacttgctttcccctatttcaccaagccataagaaatgtatccattgtttgatttactcgttcagtaaattttattaatgctagtcatgaatgaaaatttttatgaaaaccatcaaataaagtagaatatgttaaacatattttagttctgttgcctggaagacacacatacatctctgcttgtttttagatatataacagattatttcattttagcaattctattggtatttgaaacataaagttttggtaattgttgattttgtagttttggttgccagcattgcttggccgagatgagttttgatgcatggccgggagggtggtaagtagtggggatatacgtttgttgacgaaaagaatcgaactctgtaaaatatttgaagagatttattctgagccaaatgtgattgaccatggcctgtaacacagccctcaagaagtcctgagaacatgtgcccaaagtggtcggggtacagcttgggtttatatattttagggagccacgggacatcaatcaaatacatttaagaaatacattggtttggttcagaaagg

SEQ ID NO: 93511 - DNA, 1052 bp, Homo sapiens
tggtcttgaactcctgggctcacgccaacctcctgccttggcttcccaaagtgctgagattataggcatgagccactgcgcctagcctgggagtgcctgaaggttggctcttatgtccttttgacatactaccatcttttttcttttaaccacttatttttttggcactttaaattctccaggttcatcttgtatttttccttgccccatccctagactcagcatttcgctaaggagccctagatcccttttttttatgaagaatgatgtgagaaactaaaatctaggcacttactatgctctgtatgagttttccattgcagcttatactacaaatatagagtggtttaaaggacacaaatttattatataacagttttagaggtttgatgtgggttctactgggctgaaatcaaggcattggcaggactggtttctttctgtaggattgctacgggatctgtttcctagccttttctagcttctaatggatgcctacattccttggcttgtggccccttcttctggcttcaaagccagcattggctggttgagtccttctcacatcagtactaagtcatcttgtgcctccctcttccacttaaaaaaaatttatttttaattttcataggtacatagtaggtatatatttatggggtttctctcccacctttaatgacacttatgattacattgggcccactagaataatctaggctaatctcactaccttaaattcgtctgattagcaatcttaattcccctttgctgtataacacagtgccttcacagttccaggaattaagatgtggacatcttttgggggatgattattctgcctaccatatgttaattgctactgggatgtctttgattataggtcctctcagtgtgcaaagctaggaatgtacttaggaatcagttttgcaacaggaagaaatatctcagataatagctcatttagaaaattggtcaaatttccaatctcatataatatgaaagatgagtttggtctctctcatgttaacatgaaccccaaaattgtaacatga

SEQ ID NO: 93512 - DNA, 2326 bp, Homo sapiens
taagatgggactttagaacactagttcactatcttctcagtttgctggctctctgtttaaaacctgctttccctcccaccaaacttggcctcttgtgtttggctttcgagcagcaaatagccaaacctgggtctggttacataagtaggtctgggatcttgataatggaccatctgcaatgtttgtatcttctcatttgactcagtattcagtaattagagaataattaacagctattttttatcaaaaaaaattctgcacttctttccttaccttgtttatttccctttagtttatgatttataatggtccattgttttgtttagaaaacagcaagtctcgaagtaatgcatttgctgaaaaaaatggacttcagaaatatgaatatgttttacatccaagaactacaggctttacttttgtggtagaccgtctaagagaaggtaagcacccatttcaaaatgtactttttaataaaagtggcaaaaattgctaagctttatatatagccctttagagtttgtaaaggattttttactactttgtctcaagaaatgagatattgtatttttattccaagttggcctatgtactaaaatgttttgccatgtatttgttagagatatagaagagatctctgtaaaaaattctttccccttttttggaacagacataactctatattacatatatatatatgtttgtatatagagagttaggctataattccattttaggatatttctccaagtggcaaaaatgtctttctttcttttttttttttttttttttgagatggagtcttgctctgttgcccaggttggagtgcagtggtgctatctcggctcactgcaagctctgcctcccaggttcccgccattcccctgcctcagcctcccaagtagctgggactacaggtgcccaccaccacgcccagctaattttttgtattttcagtagagagggggtttcaacatgttagccgggatggtctcgatttcctgacctcgtgatccagcagcctcagcctcccaaactgctggaattacaggcgtgagccacggcgcccggccaaaaatgtcttaagagtatcttgtcacttaatccatttctctagtaatcatgaatagcaaaaaaaaaaaaaaaaaaaagagaaaaaaaatcttatcacttaaactaaccatatgtttggctcttagggtttgagaatatatcattctcttactattttaagctatagagaaatataacgatctgaaaaataattttactttaattatttcactcagtccaccaagtaactggttggtaggaaggcaagtgccactacctctactattttatagttaaatagaactggcatccagtgcggtaagtacattttcacaggttacttgagtcagggatagaaccttcttctgcttcctaatttgtggctcatatcacacttctttcaaactgtgtctattcaggggcatatatgagcagaaagtgattccgttgatgatatcgcacccatttaaatgcttaggttttgatgtaaataaaaaccaattgtactttttaattatagttctgcatatttgcaagtttatatatttatacacatttgtacatacaaataacacatatatgaagaaaaggtaactattcggaaacatactgaagtgttaattttataacagttcaaagcccacagtcaactaacagaagtgtgtttgcacatttctgctcttcactctgatttccagtaagccatattgtgtaatggtgatctctgtgacaaatgtcaccttcatctggtaactgatatattttcataaaactgttgtgcataacatgaaaagtcttgaaccattatgtaagaaaaggtatgaagttctttccctaaatggcatcactgttgttctctttaggatttaatatactttaagataaaaagtataacctgccaagatgaagcatatttataaccaagtacccatgatttaaagaaaggttcacaatcaattcaaaatcacatggtatggtaaaccaaaaatgttattcatattactttggtttgcttttgcaattccgtgattacaactaatataacatggacttgtggacttgatattcatgttgtatgtgattagtgagtgcccatctacccgtggaagttcatggagaatacagttcttcatgcctgtggaatggggtggagaggcacgaagacattcaagcagtgatgcttttttttttaatttgataccatttactatggcatgtaacttagactcacccttctcattcaacaatgtttttctattttacagtatttaat

SEQ ID NO: 93513 - DNA, 1087 bp, Homo sapiens
tatttgttagaaacataaaatgggacttgtatactataataataaaaataaaaaatatgatgaggataactataatagtatagcagctaacgttaactgagcatttactatgtacctggcattatgctgtgtgttttatgcctatgatcaattcatcttcacaacaactgtacatggtagttataaatatttatctcattgtgcaaaactgaagcagaaattgaggtaaagaacctcatcaaaattattggaatacagtttgtctaactgaatagctcttgttctttctactgtaactagttgctgcttgtatttatagtatgattttagttaacaaaatctccagatcattaagcacctttctaacactagtgagctggaatattttctttaagaaagagttaaataggaaaagaatttaaaaagaggctaaatggccagaacacggagagatggtagtcaccaggcaggtggttgtgatgctgcctgagataacgggggagcagagcaggaagaggctaaggaggcatcagttggggagttgagggcaactctcatttctgggggttcaagtgaataaagagagaaaaagtttcattagtgattggaggtgaggaggatcttagaggtcatctagtccagagttccttttagaatgggaatctaagactcacaaaggggcccagcctggctttctgatttttaagctcatgtattattaagacttgagatcatcatatagatttatttgagttttaggtttgaaatacttgtttttgaattcaaagaaagcagtttatatttcaatccatacttagctcatatgcttaaattctgaatataaaggaatgaaggatgtaatctttccactattactctagggggatacagggttaaccacaaaatagaaattaaattcccactaggtaatttggatcagcacacctgaaccaaattcttcggtttgtattcagggagagagaattgctgacttaacatgcaggttacatatatagtgtcagtagtcttgtttgtgggacgctcatgtttgtctacaatagttctcatgtgctctgagaaagttgat

SEQ ID NO: 93514 - DNA, 1013 bp, Homo sapiens
aaaatatatgttctttattagatgattatcattttcatagatgagtgaaaattatatacagttgtattttactcatgcataaggcatgtctgtgcctaaatattggtgccctgtataatgtttaatatattttttaagaatgacacactgaaaaatgctgataactgtgacctttacaaaatgtgtttatttcaaaattcagaattttggaagcagcttttgtgagtaaaatttgtggaattgcctttgagtgatgactttcggtagactttacactgaccataaagaatattgttacatacattgaaatatttttgtcggtttcccattggagggcaaaagtgagagatagaaaacaacttctgaaggtgtgagtagctgtgtcaatactatttactcattgtgtggcagatgggcactacatgtttatgtacttagaatctcgtttgcagtaaaatagagaagataagtttcagtgagtatgcaaaatgtatgtaacaatatactttaccttcctgttcatatgaaaatcaaaattctcagcaaaggtgagattttgacctgagtctaaaccctgtggacctttgaatccagaaattcatcttaacaggagcttatgcctgccttttggttttatatagtatgcagtttcattgtgaatgtatatgcttcttttttgggtttgtccaaaaaaggtttaccttgtttcttctttattgttgacatgtgtccatttcattatttataaagtctgtgccttttcttttagctttatagattttttcttcctaattcaaaatattctgtctgcatttttctaattattagaacctttttttgcattttttcatagttgatatttgtgttgagtattgcaaagtaatattaaaacagtactcatttgctggagtatatgtgtgtacacatgcaaaaccaaattcatatacctcacttgtaaaaaatatgaaactaaatacagaaattgtttacttattaatgttgaaaattatttg

SEQ ID NO: 93515 - DNA, 1039 bp, Homo sapiens
ataggactttgaatttgatctggaggaatggcaggatttgaattggtaaagaaattgggagagtgtagtcagggttactcagcagtggagaccagcctttttatgtggcaagaactaagttagagaagtagtcttagttgtcatgaagtctcacttctaacaaactgtatagaaaagaaagggaattagaaagagtgggaactgtgaaagttctagtatttatgactataaatactccaaacctggtgagtacattgttcccttcttagtattctaagacagtttattatcttcctaagcagtttactacttgttctaagataaaataagacctttagaataaggctttagcatcatcatagttatcccaaaatagtatcttattttgagacttctgcatgaattatgttcagttaaaagagactcagtaaaagtaattatacctcatgttttttacaactcctttgatccatgagcgaggtatttacagactatatgatggcatatagtaggaaaagactgtgattcatcccaattacaaagatgttttctaggaaagaaactctggagaaatgtctgtgtctttactaatggttttgggacttaaacaaataaatcttgtcttttctgtgtatggttgtaaatggtcgtaattttatacttgcaaatatcaatttgatctgaatcaaacttttccagcatagttggcctatttgtaaggttggatatccacaggctgaaatggatatatgctgtctaaggtatcagcggtttatctggattttaggtactagtaacatctttgaacgtaaaatctgagaagtatcctttgggtgcagcaactataatgtatttgatgaccttagagagggaatagtttcacaggaacgaggcaacaggagccaaatgtaagtgaagagtgatataagtggagatatgtagtttagatgactgctacagggagtttcctgatgaagcggagagggctggggtgtagacaacagaaaggggaagctgcctcaaggatgaatagaagagt

SEQ ID NO: 93516 - DNA, 1058 bp, Homo sapiens
atctgttatgtccataagaattctggatccttctgcttaggaaaggccttcattttaaataaacgcctagtgatttgagaacatttgtgagtgaagatgtgtcttgaaatatcacttaaaaataatttttgccagctatttaaacttccatcattgactttaaaatactgtaactagggcttttgatagatttttttttttgaaattggaaacaatagttgattagttattccctagctgaaacaactttatagatggcagggaaatcacttgatttataaaaagaagtgaagaattaattagaaggaataaaagattttatttaccctaccaaaaggtagtaaacctatttattacccattcttatgtgaaggtggacatattttatatatatatatattatatgtatatctattattatattctgggagtgatgaggcatggcttttacagggaggacggaaatgaagaagcaaattacatatttactttggaatggaaacttgacattaaaacagatcatcttatgtttcactgtttgaaactcagtaagagtttcagaaactaattatttagcagcaggtagtggcatggaaatatattaaatatacatagaaaactctgatacttgagcaaggaaaagggctaggttactttatttttacacaaataaaacaaagttcaaaggcgttaaatatcattaaaataaatactaagtactaataaccagcaaagaaatgcctagccaagactagatatcacagatgaaatacactgcatgatttgtaacatcaaagctgttctgatgtcctaaatgttccctcttcagtccttcaacttcgaggtaaaattggagagctgatatatgtattgtgacttttgcagtttagggcattagaaaatcagtttgtataactgaaattggaactaaatgttatagctattgaggaaaataatgttactttccaaactagagtatagtgattgtgacttttgcagtttagggcattagaaaatcagtttgtataactgaaattggaactaagtgttatagctat

SEQ ID NO: 93517 - DNA, 1029 bp, Homo sapiens
acttggtacttactaagcactccatatatgtgaatgaatggatactgtcaacctttttgccctcttcaatctgtttcccatattccaacatgcacctttgaaagacactgacagaacatcaaagaaatgaaccaaaactcgggcatggaaaggaaaattgaaaaaccaattcacttgataggaaagcattatttttctttcctaacttaatattcatagaccaaactgggcaacatagggagaccctgtctctacaaataataaaatattagccaggcatggtggcacatgcctgtaatcccagctacacgggaggttgaggtgagaggatggcttgagcttgcttgggaggtcgaggctgcagtgagctgcaattgcaccaccatactccagcctgggtgacagagcaagaccctgtctaaagaaaaaaagagatatattaatgtatagtaaagtcctattaatgtcagtttctcgattgaaaatgaattatgttgtttataaaactgaactgagatatcatataattatttcaaagacagagttgctaagcagagtaacaatttgattaaaactgctgaagattgtttaatccattacatacattttagtagcatctatttaaatatatttagttacacattgattacaaataatcatctacttattaaagtaggtccaataggacctgttatttaccaatctgctactaacacttattttaaaaattgttactgatatgtaacagttgtatgtattttggggggcatatgtgatattttgataactgtatacaatgtgtaacaatcaactcagaataattggactgtcacctcaaacatttatcttttcacattagaaacatttattaataattcttgccttctagctattttaaatatatgcaatacattattaactataatttctctaccatactagaacttactccttctaactatttttgtacatcttaaccaacttctctacatccctcccgactttccccttcccttgccagcctctggt

SEQ ID NO: 93518 - DNA, 1106 bp, Homo sapiens
tcttccaggaacagcggaacagtaatttacagcatggatttgagaactggaaagaattgagttagaatcataattccatgtcttattagctgtgtgacctagggtggtatatttaacatccccttggtaaatgaggataataaagctttacctaacattcttattgtgctgcttcagtgaaataatatatctaagaaatttagcatcaatatataatgcaacatatgtaagaaatttaaaatatgtgtggcacagtatctggcacagaataaacattcagagaattaataaacattcagagaattgttttctctttgccacagagaataaattagcaagaaattattcaatgaataattttagaattttaaaaaaacctagcgtgtctagagatacaatacagtgaacgaaaaagacagatcataatcatcattaaatttcagaccagcaacaaagcaaggatcctaaaagcttccaaagagatcaaaacttagaatgctgtcacattgtccaaggcaacactggtagaaaaagtggaggaaaccttcaatttttgcttttttttttttgaaggaaaatggtttccaactggagaattctgagcatactcaaattctcaatcaaatgagaggacagaataggcattttcaaacattcaagatctcctttgcacctttcttggggaactgttgaaggatgtattgtaacaaaagagtaaactaaaaagggtgatagagaatttaggaaacaaggaaaacaacatatgaatagaatctccaggattattatgttgaaggaggatccaaggatgacagctgtgcaacatgcatgtaagattatagtcctgatcagagtagggacatgaagggttccaggaagaatggccccaagatgatgaaagcaatagatcatctgacatatttgaatgtatgggaaggagatttgtacttctagcagagagtatggggataaattagtgacaggtctctagaaaattaagcaaagagaaaaataaggtaattattaaccagggaaaaatgatttgtggaataagaaatgtaattgctactacataattatactgtgaatatttacctggctgtata

SEQ ID NO: 93519 - DNA, 1831 bp, Homo sapiens
ccaacaatattcagtacagtaacatgctgtacaggtttgtagcctaggagcaacaggccataccatatagcctaggtgggtcatagactatatactgtctaggtttgtgtgagtatgctctatgatgttcccatgacaaaaaaattgcctaaagacacatctctcagaacatatccccgtcaagtgacacatagttgtatgtccaagagtagaactgctgagtcatagggtttggtaaccttaatttgaccagccccaaattatactacataatagatactcccctctaaacacccactggcaatgcacaagggtgcctgtttcctctcattcctgtgaacacttggtattatccagctttctactctttgccagtcaaataggtatattttaatttggttttgtctgattacaaaggattttcacatgcctgatattttctgggtttcctcatctattcattgcctgtttatatcttgtctgtgtttctattgggattactatagtgacttgttaattcgcactagttcttatgttctagatataatcccttgttgaattttagacattgcaggtatgttctattttattacatattcattgaacagaaattcctggtgtaatcaaattaagaagtttttatcttacgacctatgctcttgaagtctggtttttaaaaacctttcttgttacttggtctccattttcttttgttaattgtataattatgttttacatttcagctttatccatctggagtcccttacatgtgttgtttggtgtgaggatctggttttatttttctccaacagtgtgtacttaatctgttattctccattgatttgtgatgttacctttatcatatattaagtccccatatattcatgagaatggctttgaactctattctgatacttgtttttccacaaccacttgattcttttagaatgtattttccatagtgaagacccagtttcttctaaatctcaaggaactagtttatgcatgtgttataccaggatagcctttttgtgtgcataactgtttaggcatttcagcccacagtgatcctgtcctcctttgaactcatagtgttcattctctactacactcacctcacttctcttaaaattttctattaacttgtattcgtttcctgtgttattacttaacttttcacatatttatatgttgtacttcaactagattataaacttctaaaaggcaaggattgcttccatgtctttaaatctcccatggtagctgtagctagcacaggacttaaaatcattatcataagcatgatttagtgagcaattattaaactctttattgatacttttgatgtgatgaatgcatgtcttaacataattttaagcacataaaggcaatgaccgatttttgaaggatataggacaaatatgcagtttctacatgtacaaattgaacatagccataccccctgcatttttctaataactagactttgtcacatattacttcctctatttcttaaaaggttttagtttactaattttttcgttccttctttagtaattgcatttttttttttaggtttccttaataaaccctgtgaaaagcaatgtgctaaataaattatatgcagggcaaagcaatacattataattaggcattccattattgaattgatgcctctggcttctcatggtctctgtctaatcctgaaacaaattctttttgtggacaaatattagcctataataattattcatctaagctaacgcttttcattaaatctccttctgattaagatagctccataagtacagactgatttaatttaacatga

SEQ ID NO: 93520 - DNA, 1076 bp, Homo sapiens
tactttgttactgctcttgttttcacattgaattttgaatgccctgtctgaaaaatgataatgaaaacaaggtatatgaatgtaaaggattatgagtacatgaatttacacatgtatatatgttgtatacaagtctttgtgattttctcacgtgtgtagattcatgttttcgtaatcctttaagctcttctgtatttatgattttagtttactgtatgtaatcttaaatacttatgctttttcccctcagtcagatccatagggtttaagtatcttactcatcttgtcaaataactaacttctgcatttattttttagttttattatattaagtactgctttttatctttagtaattttctctttctctttccatttgtattcttttttttctccctctaattttcaatatgagtagtttctctttttcagttttcctctttagtaatgaagcatgtaaggtcataaatttttctttctattgcagtcttcattgtatcctatagattctctttttcattgctttttagataattcgtaattttccttttgattttatcttttatccatgggttatctaaactttttttaaaaagaggaatattttattatttatttttatggaatcttgatgtgagaatgtgcatcataaagtctcagtttttacaaaatgtgtttaaattgtcttgccactaggtaagtaatcagattttttataaatgctcatggttactgatacctttaaaatatttttgagtatcagatgggtctgtgagaaacacactcacccatccaaacccaaagaatggacttagaggcacaaagaacagcaaaagtgagacttattttaatagcgatcttgcaagatggggtgtctggtgggcaggcacacccaggccagctacaacagataatttatctcctagcacacaagtccctcccccagttccccattggtcgagtactctggggttacaatcttctctgatgtcacctaagtctcattatccgccttataaggttataccctggtccccttccccacttaagtttcgatttcccaataacgaaactttc

SEQ ID NO: 93521 - DNA, 1024 bp, Homo sapiens
tctgtgtccaggctctgttgaaaccaggcctgcaaagaagaatgagaacaggcatgttcaccagcaacctctctcctatgtagtgaaacaggtactgcactaaagtaaatataagagagcctgggatcgtcctcatctgtcctctgtcgccctcagtgtatgtgcctgtctttgagctccctggtggcaagaaacttatctcttctttatccccactgctgggctgggcatttcagcctctcagtgggcgttttcctaaatggatgattgaaaaactattccttgtctgggacaagtgacattatttatgttttcctacccttataaagtcacagaatgcaggtggtgttgggtgtttctcaaacacccaaaggaatgggggcaaaggaataaaggcctcagccccagggggacaaacacacctcatctcagcctattttgatgtggcttagttgtccccctggcctccctcttatagccaaagcccttggggtgataacgaagagtcaccttaaaggatgtggagggtagtctgctaaaggagatgggatggttctcatgtgagctgctgtgcctgtgtcttaaagcctccttagtggaaaatggaggttcaaaactctgatggtgcaaataggaatctctacaactgtgcagagttatccaaatgctctctagccactaacctgagggtgatgcagccaaagcaagaggagttggggatttaaaagtgagcaaagcagccattctgaacctccaccagttcgaggcaaagctgacaatcactggatgggatagtgacattctccagccccagggatgcctttgcctgcaggtgtgcagcagagaatgtgtgtagccaagctttccctggctgtctgatgttttggtagatgctgaatgagagccctcagtcaaatccgaatattgagtttgaatgccaaaaggtagtaacctggactagcacacttagtaggtcaccagtagctgtgggtgaaggtgaaagtttgtcaaatgctatcagcct

SEQ ID NO: 93522 - DNA, 1024 bp, Homo sapiens
tgtcacctccatggggacagagagctctctcccaggaagttggtcccattcccactttatgttttatgtttgtgtttctctttgcctttctggccctggaaattagggaaaatggaacatgatgaaaatgacccattcattttctctttgtggctctggcctctgcaatgtgtgctggaagtgcaggacttggaaggaaatcctaatttctatttaggtcaacatagctttttgtttagtaatagatgtgcatgaatcacctcacccagggccttgctgaggtcacatcttcgcccacctgatcagactccagtggaagcccctgtttaggatgtacccgtggcagcccaccagcggtttcccatcttcctgttaccacccaggagcagcagccagtccctccctcctggacaggtcgctgtacctgctggtttccagagctcagtagaaaccgcctcttcgggtggtcattcaagagtgggcatgtgagtatacacagtgtacaaggccacagaatagacctgagtcacaattggaacagtcctggttcagaggtattacaacatgtgacgaggacgctggagtccagcaggcctggttcaaattccctttgctagttggagtgagttcctcagcctttctgtgcctcagtttcctcattagtgaatctgtaaaccagtagcagcctcataggattactgtgagcagtaaatatgtgaggtgctctgcgtggtgcctgctgagaaaggttcaatgagcagtagtttaacagctttccaggaggtggataccgtcatcactgtaaaccgggagctccaagcagcgaaggttcagtcccagtgtgtcccacgccacgccaggcctgtttgatttccatttcattgtgctgtgtagttgcctgaccttttcccattctctaactgtcttcagactcccgtctgggatgccagagcccacctttaagattcggagccattgtcaattccagagaagccagagcggcttctctttgacactgacattt

SEQ ID NO: 93523 - DNA, 1029 bp, Homo sapiens
ttccactttgactcaaaagagaaaagacagctatccattttgcatttcctcccaccatgaataattggtggaactaagaccggacgtaggatgctagagccctggcaggagtgccactggggcagttggcaagcaggaaagatgggtgaactccttggaggtttccccctttgagtgcctgtcaagcatggggagacagagcgggcaaaatcacctgccccaggtcactggatcaagtttgtccgaacatccggcaaacccatatggggtgctgctgtgtgggaagccctgtgtaggaagcgggggtgaattctgagggagtgtggagtgtgtagcagtggctctctgctggcccctccctcaccacttctgattcccgaacactgtgttcctcttagatgtattgctgtattactggaaagatacaactgtgtctctggggatgctgtttaatggtggaaggaactgcaaaatggatagctgtcttttctcttttgagtcaaagtggaatgtgaggccaaggggaagaagagaatctttgccggggtacatggggatacaagtttgagacaattgcttttaaatttaccaggcgttgttctgcatggttgaatttcctgtcctgatcatgtcactcttccgttagctcagaaaactgtggttgaagtttaatctcatccttaaagctgtttcactaaaataggaaactgttattccacagggctgcttattagaagaagaaggatttagggaggtcttttaaagtcattttagtgatttttttgaaagaagcatttgccgcaatccacttgtccccaaagcatctgctgtttcaaagcataacactagtggaagcataacaggaagggaaagccagcatcaggatagggaataggctgagcaacccacttttatttagtcagttgaggacacctgtcgtgggttctatacgttttgggcaccatggaccaggtagcctatggatcaactgcaacccctactttctccactgtttttgtatggcctgtg

SEQ ID NO: 93524 - DNA, 1066 bp, Homo sapiens
ctcggtccttccctgccacgtttcgggtcgccctgcaccccccacccaggctcgcttctcttcgaagcgggaagggcgccttgcaggatcctgccgcccctccaaccggatcctgggtctagagctccccagagcgaggcgctcgccaggactcctgccccgccaaccctgaccgccggggggtgcccccgggacgtagcgccgcggagaggaagcggcaaaggggaccatgcggcgcctgactcgtcggctggttctgccagtcttcggggtgctctggatcacggtgctgctgttcttctgggtaaccaagaggaagttggaggtgccgacgggacctgaagtgcagacccctaaggtaggcggcttgccggcgcgctggcgctgagcggtggcttgcgggagggcgcgcagcccgcgtgccgggtttgcgggctcccgggaaaccagggcgagggtctgggtgctgcgagcaggtaacagccgccggatgtggctaccatgtgatgtttctggattttaaaacgctcgggggcatctccggacccgcggtgtgcatgagtggcagtgggtgtgggtggtgggcgcgcgctcgcctgcggagcggggctcccaacttgagctgcgcgcgagggtcccggggcggagggggctctgcggacgggcggcccaggggctggcggtctccgggcgctgccagagagtcgccggcggtcgggtcgggccagcgcccgggcgaagtgtggcggctgcgctgacctccttcccgcagctgccaggcccgacctggggaggccggaggccgggtgcgccgcgcgcgcctgtgcgttgcgggcgagcgccttgcagcctcccgggcggctgccacccctgttctctaactgttcccgaccctctcagctgcattggaagttgaatgtgcccagaacaccacgaaagagcctgtaaaaacagacgccttggtattggcggggagttgaggaaatgggaatccaagtggcttttccaactcctgctcagtcagttcctgtgagggagccagaaggttccccctataggctcactc

SEQ ID NO: 93525 - DNA, 1383 bp, Homo sapiens
aggctagtcttgaactcctggcctcaagtgatccacccgccttgacctcccaaagtgctgagattacaggcgtgaaccactgtgcccagccaatcctatgtatttcatagtatacagtgataatcttagagtgaatatgaaaaaaagcctctaaacttccttaacacagactatcaatcatttaatagctgaatatttggtgtgagtgggataatacttgatatagcattctttgggtatagaccttaagtttttcataggttttctcatgattttgcatgtgaactaaactgttatatctctatcacattcattgagaatccattatgtactagacatttgaaaaggagagtaaaaactggtttagaataactagtctggaataatttcaacaggttctttgagggtttaattacaaaggtttgattgcaggccgactcaagaaattgaaaggggagttttaacaattttaaagttttacttcagtgacataagcaatagtaaagttgacaatccttaatccaaaaattgaaatgctccaaaatctgaaaagtgtttgagcaaagacgtgacaccacaagtaggaaattccacaccagacctcatgtgacaggtcacagtcaaaaagcagtctaaactttgtttcatgcacaaaattattaagaatattatataaaattaccttcaggttatatgtattaggtatatataaaacatgaatgaattttatgtttagtcttggatcccatccccaggatatctcattatgtctatgcaaatattccataatctgaaagaaattcaaaatttgaaacatgtctggtcccaaacatttcagataaaggatattcaacctttagacgcagctctataaatgcctactgagagtatcagaaagatagtgttaacttgcatggtctatttttgggttgcacttatgaaaatctcttgggcaaggacaaaaccagacctttataggcaactaagacttaccttcatacatgtagagatagatatacatacatgtgtataataataactattataatataattgtataatataactactataataactataataactattattgctaatgttagtggcagtagtagatataaatgatgatgtagacaccataacataaaaagatgtctataccagtagaatctattcagtgagtttatagtgtaatcatgggctaaatcagactgatataaattctatcatgtagattataaaatttacataataaagtttgcaatctacccatctgacaaagggctaatatccggtatctacaaggagcttaaacaaatttacaagaagaaaacaactccatcaaaaagtgggtgaaggatatgaacagacacttttcaa

SEQ ID NO: 93526 - DNA, 1354 bp, Homo sapiens
ttaagtttctggatacttttatcaaagagtattctgtgatctttgttaaagcaaaactttttgtgattttattaaagattaaggaatatggaatttataaattgaacaagctctacactaaattgattacattgttgtaattcaaaaaatgaggagggtatgcagtcagttctgagttggtttcctctatggagtattctgtttgaattttttgttgcttttgtctgcgtttcttacttgcagctttgataacatgtttttaaaattggaaatactggtttttatgttttctaagaatcgatgtgggaaatgtgtatcagttttcttgtttcttttcctgtgtaaaaattgtgatttagtgtctcaagtatattttttatttatttggtttttgaggtggaacatagatgaaactgaaggaagcttatagctctatttatagagtcactctaagattagcacacacaagcattttcccataagaacaacagatcatttaaagaatatatttaattagttaccctgggttcagtgcggtggcttacgcctgtaatctgagcactttgggaggccgaggtgggcagatcacctgaggagttcaagaccagcctggccaacatgacaaaaccctgtctctactaaaaatacaaaaattagccaggtgttgtggcatgcgcctgtaatcccagctactcgggaggctgaggcaggaaaatcacttgaacctgggaggcagagtttgcagtgaatcaaaatcatgccactgtactccagcctgggcaacagtgtgagactctgtctcaaaaaaataataataattagttatcctggttataaagtaacatctttaaacatatcttgctctctatattatatgtatctatatatctatgtatatagatatatattggtgtagatagagtccctttaattaccttgttgtaccttcaggttctgctatgttctcttgaatatatggcaggacatttcttgacctttgaggttgtatttgttagaaatggtcaaagatcagctgtgtgattagattggataataaggtttaagggaggaatatgttagttataaagaattaagttgcctttctcctgggacatacgtgctttaaaatgtccctaccccaaagcgccacagtggcacattggaataagcttacagtctaagtaactgttaatatcacttatactatcgaaaattaatcttgttgctttttagacatgttatatccaaataactacctaatttattactaaattcatagttacttgacatctcaaatatctcagtatggtaaattgaaaatctgtgtaaaaaccagagacagtttaaaaaatgt

SEQ ID NO: 93527 - DNA, 1057 bp, Homo sapiens
cctgtaatcccagcactttgggaggctgaggtgggaggactgcttgagtccaggagtttgagaccagcctgagcaatatagtgagaccgcgtctctacaaaaaaaaaaaaattaaaattaaaattaaaaaatgagccaggtgtggcagcatgcacctgtactctcagctactcaggaggttgaggtgagaggatcgcttgagcccgagaggcggaagttgctgtgaactgagattgcaccaccacagactccagtctgggtgacagagcgagactgtctcaagaaaaaaaaattattatcaatttgaatttagcacagaatagatattcagttgctgtttgttcagtttcaatgaattgaattttgaaggaaggagaacaaaagataatcttcatgtgaagtgttttctaaaggtcaggaaagcataaaccttttcactggaagcatcttttaattggcttttttcattttcaatgattatggaaatcattgtcctcagtaactttaaggtagggtagaatttaatattcctaggctgtatatttgatgctaaatgaaataaattgtaatgtaagttatctggtacaattgaacctgttggcccatgattcctagctcatatttggcaatgtccgatggtgtttaccattacttgaaggtgttgaaaaattttttaaagttaaataaaatgtgctttagctgcatgcccaatgacatgtccagccaactctcaagtaaaaagatacttatggagtgttagaaattctggactagaatctgtttacaactttgctggtgagttgctactggtttgctagaacgagtcactcttcctttctagattagagtttatttctttattaatgtgagttagaattgaataatattacttctaagggtctttccacctttgactttttaggacatgaatgaaaacaccttatttatttaatgtattgtactttaacatttttaaatctgtttcacaacatttcccctgctctgttaatctcaaggattacaggccagacattgttaccttaattttactgttaca

SEQ ID NO: 93528 - DNA, 1042 bp, Homo sapiens
gcattagaagtattcagataaaagctagattggtgattatcgaagtagagtccctggactatcaacatcagtatcacctagagatgtgtaattatgatcaccaagctaaaaaaagctagtatacaagtaaaatggaacttatttgtataaaactgttgagaagttatttttaaatcaaaattgattttgaccatttaacactaactttaaacacagagattataaattgatgattattgctttattgttactagggtaacactggtgtaccagttactgggggaaccttagaataattaattattctgttttagttaaaacatttaaatatagggcagagttctaccatttcctaaaataaagttggtctttgaatgaatgactcaattaaacagagctgctttttcaatctaaaacacagccatatcagttggcagaaaaggaacttgaaggactggtttttttatacctattaatgtcaaaatattaggataacctggagcagctgtcacataagacgttttcctatctacttcctgttctagtatcccaccacataccagtacatacagctgagtggcatggcatactgtcatctatagctatgctacacattttgacaaagctctctcaagtaatgctgataactggaacctctacctctttaaagtcactgttgaggatggatttgtttgcctatcctgtcttcaagtattcattagtactatgtaaagaactttggagtttcagatttgtcatttattctagggttctctgatgattccagagtggtttgtatccaggatgtatcacatttactgtgtatgtgtgtgtactctgtgtgtgtgtgtgtgtgtgtgtgtgtgtgcgcgcgcgcgcgtgcgtgcgcacatgtatttaattctaatgcaaaattttggcaatcactataaaaataatgaaaagaattttaaaagccagtttgtctgagtttgaaaggtatgctataatgcagttgtttttttattattaattgtaaattatgttcaaatgaacatttctc

SEQ ID NO: 93529 - DNA, 2957 bp, Homo sapiens
aaaatttgtattataaagtaaatgctgaaccaatcgacaattaaagtaaaaatcctagcatataccttttagatttggattttaatttgtatacatttcaaatttagtcaaagtcagataaagactccgacgtcttaagacagaagtggccagggatttggtttatacggtaaagagaaatatatttaaaaagttaaaaagggtttaaaaaatggccttattacagggagagggagggtaaatgatgactgatacttaattatcaaaaaacaagattagaagttatttgagaaaatgataaggaattcttttttttctattttaatatgatgcaacaagagaaattcaagaaacaaaagagcaaaagagataatctaggcttcagctgtgaagtggacaaagtcaaaccgcaaacacattgagtgcccagttttttatgtgatgtgtgtcctaaccaaatttttcttttttctaggctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaatagtctgatttaaacttattgctctgtggtatatatgaaaattgttttttattaattccatctcagaatttttgttaaaaatggtaaacctcagctcttatgtaaaaatatattaggatgtattttatattttatatatttgtatgatttttttaaatcagaaattagaatcatatgatcttaaagttaactttttaaattacatgcagtttgcctttttgtctgtgacatccctttgtgtcattactatattgtaacagaatatatattcaagattggtaaaagaacgtagatgtaatccttgacttcaaagatcatgtttgatagtctgcaaatgaggaaacattgaagagtgttcttagtgtttttcaaatcattgcagaccttacactgctgtgcttttttaatgctttaagcagtttgactcttttacttgaatttttagccagagatcattaacatcatcaacaacaacaagccactggattttcttatggttacacaattttttttgtcatgatttttggtgcggctcttccaactaaaataatggtatgatgttgtatttctttctttctttagcatagaccaattctagtcactttcgccaaaaaaaaaaaaaaaaaaaaaaaaaagatataatttagttaataattcagttaccatgtatgtactgcattatacctattttaacctaacagtgtctacattatattagagagtgtttatatctccagtgttatgccagagtagcacaatttttagatgccttgcaccaattttatttaaagatttatgtttcttatttattaaatatcaactttctatactcgagtgaaataaaataatgttaccttttagattcaaagtcgcccacctatgtatgtgtggaaattatattcttacacattagtgatttattttccgtaatttagatacactttttagtactattaatatttatttcttgtttaatatgaactataaaattttaaaatggacaacagtgaatttttaaaataatgttttctgagtataagactaatacatgattattttagaaaatttgaaaattactgaaaagttataaagagaaaaaattatctgcaatctcactacccagagataaccctgttaatatttttctgtatttcttttcagtctttgtctgtgctatttctatgtatgagtgtgtatacatgtgtttgtgtgtgtgtgtaataacaaacttgagattatactgaccatatagttatgtaccctgttttttataacctaacttcatacatatttacccatgtctatgaaaatgtgacttttaaaaatggctgcctaatattctattgtatgaatatgccacaatttaactacttctctctttggatattaggttgttctaatctttcaccattataaataatagtgggatagacatccttgtttgtaaaatttcatctctatattagactctttaggatatactcatgtacatggaataagtggtttagacagtgagaactttttaggctctttaaaatatttccaagttataaccctttagaaagattgtactaaattaacaatgtatgagtacccatcattctgccccttcaccagtatcattatttttttaatctttgacagttggttaacataacaatcggttgtttctttgaccattctaataagagttgctttataatggccgggcgcggtggctcacgcctgtaatcccagcactttgggaggccgaggcgggcggatcacgaggtcaggagatcgagaccatcccggctaaaacggtgaaacccc

SEQ ID NO: 93530 - DNA, 1231 bp, Homo sapiens
taagaagagtggtgtgtataaaagaggcagggagctgataatatagggtaataattgaaggtaagaactttatataagtacaataggaagtgaaatgatataatttgaattatttttaaggtcactgtggtagttgtgtggcaaatggattacacaggagggtcagaggtagcaacaatggggctgggggcggtggctcatgcctgtaatcccagcagtttggggggccgaggcgagcagatcacttgaggtcaggagtttgagaccagcctagccaacatgacgaaaccccctttctcctaaaaatacaaaaattagtcgggcatggtggtgcatgcctgtagtcccagctactcgggaggctgaggcaggagaatcgcttaaacctggtaggtggaggttacagtgagccgagattgcaccactgcactccagctctggggacagagctgagactctgtctcaaaaagaaaaaaaataaaggaagtagcaacaatgggccattggcagaagttcaagggagagatgatagtaacttggactgtggtgatgttggtggaggtagaatgaagtggatggaggtcagatcttttcagaaataagagtcaaaaggactttgctaatgggttgactattttggtttggaactcaggaaggctttcaattggactagagatgtaagtttgggaggtctcagtagatcattaaagccaggacagagatgagattgcctactatagtaatcattaaccttatcattacaacagaactcacttgtggtactttgttgaaatttgctgagaccctgtctcaaaaaagaaaaaagggaataaattgtacagtagaaccacttagcccaggttgacttctaagtttgcatctgatttaccttactttagatatcccaaattactggaacataattttaaaaattttatttaaataccctggaatatgatttctgaataaatattgagtatttgcttcatattaatatgcttgaatttaatatttgattttaacatttggacttggagtttatttctgtggtccatttgttgagatatatttatttatatatagaatttttaaatggctcataagtgttctattttattagtatattgttgattcaacttataagtcaattctgggagttagaatacatgggtcaaaataataagacccgtgtatggttagctctagacataaacttaggtgtgtttatatt

SEQ ID NO: 93531 - DNA, 1157 bp, Homo sapiens
ttgaacatctagataaaatggtaagtctttcaggtgtgggattttaatgctctaaggctttttctttaatttcagattagtaattcaagacttaacatgttgaaataatatattttttccctatctttaaatgtacaaaatgcaatgtgtcatcatataaatactgactataagaataatccctattctagtaggaatttccgtcatcataattttgtttgattaatgagaatatttaagaataatatatacggatttaaaatactttctagagaagtactttagctttaggaacagtaagatactaataccattatttactgttaagcagtaataaccatagcagatgatgggataccttgactctaattcctgtttgtttcacgactacctgaaatatttttttttgagtccttcttttgactccttctgaacagcattgttgttttttaaaatttattaaataacttagtatatttttagttttgatagcagaccaaattactgttcttaagtgatgatgaagattttatgaattagctaataaaaatctgtattctgttggaggaattatatgtaaacttgaagtaaataacctgaaaattttagactgaaagtctttattttttaaattattgcccctttacctctggaaataaaagacatcatagccttatgatgacagtgtgcaggaattccaatatacacaaaatgtagctaacttgaatcttgtctgctatgctgaagggatttatacatatactttattttaaaatttaaaatttcaggcatgtttgttttgttttgttaatttatttttattatttccttggaccagcagtttgacctgacagaggcatatttattttggaactactttttttttccttcaaatttttagaagctctcaaaatctaaaattcagtggaattaatattttaaacataataaactcacatcattgatatatttctgtaaaatatcctgtaaatcagattgttatatatctaatttcatttttgttttgatttgcatttcccattgatcttaagcatgcatattaagatatttcttttttcctttttttaagagacagggactcattccgttactgaggctggagtgcagtggcacatcatagctccctgcaacctgga

SEQ ID NO: 93532 - DNA, 1034 bp, Homo sapiens
aaatgaatgaagtgtttcagttctatgatgtgtggtttttcagaaaaggacatcaaagagggttttataattttgcactgcccatcatttacataatttttttagtaagatgaacagaaaacttaaaaatcttaattatctagccgaagagttccatgtcttcaggtgtgagggtggtaactggatatatcaacattgctctgaacgtgaagcacaagacacatgatgtgtgtacatgatttgtatggtctaattcctttagaaatgcattttggtcaatctttaacattaaggaaatacaaaagtaatgagttcttagaaaaaaggcactgctaaaagatttaggtgtatctgaaatacgttgcagtcagttgagtaatactccccataattagttaagaaaatttttaacttgattttcatgtaactagtaggaaacagaatttattttctgagacttttgttttctgttttctctttaagcttctttcattttaccttctctattctttggagaatagccaaaacattgaatgttctatgcttataatcttattgagattttatgtcagggtaggaatatttattatatttatattatatttacccttttgtgtattctgttcacgttgcataaggcacttgtattgatccttttccaagttgtgcaaaaatgagataatttttaaaaaatttacttcataaaagtcacacaagtcacagtatttgcgacctcatggtttttttttttttcccccgtaatagagatcaaaactttgtacagcaaaagctaaggcttttagtgatttgttataccaagatagttttcttaaaccaaatattcttaagtaatattctttgggtttactttccaatatagactgataaaatgtttaacaatgcttctaacttttaagctattttgtttccttaatcttgtatttctggtgattttaaggtttctacaatttgaaacagttcttaacatcataaaacattggtgatatcatttctttattaccttcccaaatgtg

SEQ ID NO: 93533 - DNA, 1049 bp, Homo sapiens
tcttcctttctgtcagtctcttgggtataaggctgttgctattttctaaatagttaaataggtttgagtgtaagttagctaattcttaaaatgtaccttaaccaagccatcatatttgtcttctcaaatatttgtacatgcagattttacatatttagtttttgactttttgcagatttgagataaggctaatacttatacattagcacttcagattgaaagcatgatcgtatttagcttttaaaagagattaccttatttgatgctacttacataatatttcctttatgaaatacattttttctttggtagtgatttcaattatgaatgtccccaggttgggtccttagtatagaatggcctaataatttatctcacaaggttgttgtgaggtttaacttaaatatttgaaagtggcttagcatataaacgatgtgattaagtaaatgtgtgacagtataatttttattttatgtatctgaaaatctatcttattgactgatcttttgggggctttatagatcaactttccaaggtcattatttatttttgcagttcagtgcatagcttaatgttgaggtatttactgttcttttaccttttgttttaaggtacttaaaaagtagcattggttcttgtaccattcattgttatgtttgtcctcattagttgattgttgtgtgttaaacagacatccctggagcttattctccacactctgtgaatccactcattaatcaccagtcacctttggagatgggaaaattacttacctgtatttctttttctcagaaagcgtgctctggaatggattcacaaatgagctaccctccttccctcaaagagtaaggtttctgctttacaggatttttttcttgggttatttttcctctcatcttttgaatttgaaaagaactgagggaaggcacctgaagaaactactgacatactcactaggggagttccaaagcttgtgctgcccctaggggcagtgtcaatggctcttaaagctagaaagctcatacttggagttgaaacaggggctcaaa

SEQ ID NO: 93534 - DNA, 1010 bp, Homo sapiens
gttagccagtgttctttataaacatgatttattttcttaaatttattttactttaaagatgttcatctttcagatgccttgtagcttttatttagacttgaaaagagacattagagaaataaaggtagacgtactgaagtactctcaagttttctttctagttgagttaagccaagggagagacaggaacctagattccattatcccccttctttcaatcccctcatttgagttccccaaaaagaaaccctgcatttcagttcctgccttttattgcatcaccagtcttgtacatatagaaatgccagattatatttctcaggcaacacttaaaatagtttcacctcatttcatcctttctgttactagcaggaagtagattaagtgaaaagacatttgccactagtctgtgtgctttaccatggttaaataaattgttccaatactttttgtgcttattaagttctatatcctataggatggctccgtatgagagaattttgtctggacctattttaattttttcagttagtagaattttcattctgttttctcaagtttcagttttggccttcttcatatatgtgattgatatttgtgttttcctgaccttcctgaaatttatatttctaaatttagattgttggcagctttcattaacgtaattttcacttctaagaagtttctaaatgaaattggatttagtgaaaatatatttttcaaaagtggagttatgaaccgggtatggtagtttgtgcctatagtcctagctatgtgggaggctgaggcaggaggattacttgaatctagcctggagaacaagtgagacctcatctctaacaaaaaataaacaaaaagtaaaagtggacttcatgctttatttgatttgccttttatggtggttttacaaatcagtttagataagtttacttggtgaatatttatgacatatatttttttaaatatgagaagtttactgtagtcttttcagcaattttgaatttttatgc

SEQ ID NO: 93535 - DNA, 1043 bp, Homo sapiens
gctgctaaataaacatcctgcagtggcacaggatggctcccacatcagagaattaccaggcccaaaatgtcagcagtgctgaggttgggaaacccagatttttaggatatgcaggtagttgcacttcctttccaaccccccagagaagctctcagggttcttcttctttttttaaatctgtttttaatattcagggttctttaattactgattttattggttagctggtttgctacctttggcagaagttacattttatggatataagtatactacttagatctgaaggctaggtagatgcttaaaaggagtgcctttctgtggaattttgaaatgtaataagtgaccttgaaaacttaagtatcattactgcaaaacagcatattttccttaatattgtgaatttgtgttggtaacaaagcatgtctgtatgttttgaaaattaaaattcttgaagcaagtgtcccacacctccttcatttttaaggctcttattaatcacttgatttacataattagttcccttgatattattttttagaacctgggctttctctctaggttggcaacctgtgcaactgtaacataaattcacataaaacgtcagtaaacatttcaatattgctcttttctgtggaatcatcctttttacctcattaataaagaattctaaagtaaccaaagcctagtccactgctatatgtaactacagtggctgagagagaaacataaatttgttttaccttctacctagattcttagaaaattattgaggttgttttgtctcctgatttcttggaaattttggtatctaaattgtaagataggatttccaggtgatagttacaaaaaagagctcaaaaattttaaagactcataaataatagttataagaattatccagagactaaaacattttttagatttatgtttggtgtttaagtagtagaacttttcaagtgttcattttttagtatcatcatcattaataatactcattaaatgttttctttgtacttatggaaagcaccgtgctactactt

SEQ ID NO: 93536 - DNA, 1335 bp, Homo sapiens
ttataataggataggattaaaataggtgaggaagagtttaatggtcttttataatcacagaaggatttggcagatgactgtagccttgataagtacttgaaaagaattgaattggtgctcttctgatgggcttgtttttattttttgagatgttattatacctggtagtaaaatagctttttttacctaaagaggtagtatatatttctgtagtttaaatggatatttttagtattctgtatgactcatatttttaatcgtacccttgtaccctttaaacatttaatttatggattttaagaattcatcaataataattacatatgttatccttaccactattaatacatattccactttctaatgccaacacatttggaaaactttcatttaagcatcttaaatgacattttttttttttctgttttctttaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtaagttctagattttaacatatcatggtagatgttatatacttctggttaaaggtatcttttcattctaagctctgattttcagttttttatcactttccttggaaagttttacttctggcagcagtgtttaaaagtgaataaaaaatcttttgatcctttaaaaaggatcagattacaatagtggattatgggtacatttccaaaggcgactggtataattggattcacactgtgaaggcatccttgtttagacacttatttagtgggagttaagatcttttaacctcatttccaagtaggtgtgtatggtagattctctgaagttagttttggtggataaatccaatgttctttagagtatagaagagcactgtgtgctgtgccagtccttttccacatttccttttttgtaattagtcttttttttttttcccctttggtgcttagtttttactcacaattgccatcagtttaaagctaccctccaaagattataaaatattggctattaagcactgtggtcatcattggtaatgtttttataagggtaaggactcttgagtgattttttgattattgtaagagcaaggacacgtcacagtgagtacgttgtaagagaagtgagctgtttgtggatgcctcttttagtaaacgttgcttctacagtctttggatgcagtttgctttcctttatccattactgtcccagaatatttctaagttttgttcgttttaggacatctctttgacctat

SEQ ID NO: 93537 - DNA, 1753 bp, Homo sapiens
gtgagctgaaatcattttgctgtccccagcaaaatgctgtcacccagcctggcctgggtgacagggtgaagccctgtctccaaaaataaataaataaatataaaaataaaataataaaagagtccatttgcaagaaaaaattcttctttcttatttttggcataagttttcataatttgaggctttaggtatcacacaatattagcaatttgttaatgcgtcttattaatgaaatgagtatttctaaccttacttcctgagagggttttagggaacacattttacttttaaaaccttgttggggcattcagaaaattttaattttgggtagcttgccagtgaagaaatagagaattttttcaagaaaagaggtcatacaaccatttatttctttctttgatacaggtaaacccatttaaggatctaattataaaattggttctattctatgctaaaaatattcttatacatattttttacatgttaacttttatctttttcttgttccacaatattcaattttaagcacagttcatcagaaaggcctgaattactaggtgttttaaagttgggacggtattgtggcgaatttatattttgatccatcctacaagcttaattttgaattttcaggaaaatagcattagtgagaattttctcttcttggtatggcagaaacctcaggtgtgaaataataccacacattttattaaaaaacaaaactcagaaactgtgcttttgacctcatgagttaaatagactagtggtttttccatatttcagtaggaattctaattatgttcttgctagcatgtactgattaaagtcaaggaaaagcctagacccgaaggtgattttagaaataatgaaaggagctgatgaagaatttaaattatcattttttatataactatgtaacatatacaaatgatgagtaagtctttacacgtattactgttttacctgttacataaaaactagttctgtttttttctctttctccttactctccctccttcctttcctttctttctattgttttgttttgttttaataaaaatgagaatattatatggtgtttctgtctcttgccaaaaagcatgtagttttgtgttactgggtggaatctcacaggataaggatatacattaatatatttattttactgtattttgaaatctctttagtttacggagaactgtggaagacaggaatgtttgaacgcatgtctctgcagacagatgaagatgaacacagtattgaaatgcatttgccttatacagctaaagccatggaaaggtatattgattgatataagaaatccccaggaaatcatagacattaatttctttggtaatttaaaactagtaaatcctagtaattatcagggtaaggagattaagatgtgagataaaaaattgagacaagaatgtcttaaggtggattgttggttttgaatagtttgcctatgaaggctgaacatacgaattgacatgatggttttattaggtggaagtattaaaaaacccatgggtatgtgagtgtatgtgggtatgtatatatcttgctttgcttgtattttattcattagacatttctttatctcagaataataattacattcttttatggtacaatgctataattaatcgtaaaattttaggcttgtatttaatgttggaggtcatttatttcaaccttgtgcaaggtacatgaatctcttttatggtatgctcgacagactgttacgtgg

SEQ ID NO: 93538 - DNA, 2209 bp, Homo sapiens
ccttgaacttaaagtaaaagttaaagaaaaggataatctgtttctgaccagaaatggcctgtggatgaagtcttaatgtttgctgtatgtgctgtcttaaggaggttttgggactctaaactgagaatcacttacccacaactttcttttttttttttttttcatagcagaacaacttaatatccacagctttatctcctccctgcaatttatgaagtaacatataaccaataattggttaattttcttagctgtaatagaattttatgagaataaatacattgctaaagcacacattccctggcctgcaaatttttgacagaaaagaactagctcatctctcagcttttgttcattaattgagcaatcagtaatacttttctagctacatagcatatcatatattttcttctcatagttttggctttatgagtctgtaagttttgtatgtgatgtgggaaggttggttcatatgaattttggagaacagagaaaattgatagttttggaattcagattgtagggcaggtttgggtatttgacagaatgagaggaaattaacattactcttgatgtcaagataaagagattgtaaagatttaagctacactttagctcagttcttttctttagactacagtgcaaataacacataatctagtttctttgtttttgagaatgacttctacttgaatgggaatagagaaagcttattatatagaattcttttcaacaagatgcctttttcaccctaccatggaagaaatatggaaatagctttatcagaatgcttttttataatggatattttgtatagatatttagaattttatgctattatgcatttttattaaaatcatggtggatcttagaaggttattttagaatgtgttagaattttgaaattttagtagcttaaatgcataaaatccatttaataaaatacagcttctgaatacctgttgcatccttgtcattgagagtatagagattattttatgcatagtgggttggtttactgtattaattgataactggtatttccaagtattgaatatgattctcttaaaggccatccaacaaagacagaaataaggaattgaacttaactgaggagcaagtcattattaggtgtattagtttgctagggctgtcataacaaaataccacagattaggtggtttaaacaacacaaatttattttttaacaattctggaagcttgaaattcaatatcaagtttctgtcagggttgggccccttctgacatgatcatatctctgtgcaggcatacttctggtgtctctttttcctataaggacaccagactcattggatgaggtccccactctaatggcctcatttgaacttaatcgcctctttgaagaccttatctctaaatagcactacagtctgtgctactggggattggttcttcaacatgtgaattttggaggggaacacagttcagccattaacagttggtaattaagaaggaaaacaagtgatttgtaagaattacttttttctcttttatttaataaggtttgtgtagaagtgcaattgttacgtgtttttttgttgtgtatctcctagccggagaattttcatccttgggccttctcatcatgtgcccctctctcgatgtgcactttccagtgtggatatatataggacacctctgtatgaccttcgtattgaccaaaagagtaagtatatagaaatattatagctttcaaatagctaatgttcttttaacaggacttgtaaattaatttaaaaacttatgaatatcataagtaatatctcaatatttaaaataaaaattgttataactaatctgcataaaacagcaaaaaaagaaactcttccatatccctaaaaggcaactagtgttttttagctagctacagaaatctgtcagatctgccagtgtgcagattgtagtggttacattaatattcagaaaaatgccatgtactcagtgtaccaggagacaaaaaattagtacccataccaatttcataaagattctgggcgtgttaatttacttccatgtaacgccacttttctcactgtaaatagataatgctgataatatctttattttctttcaaatgatttttatgggaaaaaatgagcctttaattatgaaactctgaaagaaaggtgctatataaatgataaatatattttatttttaaacatgc

SEQ ID NO: 93539 - DNA, 1020 bp, Homo sapiens
atgaaccaccgtgcctgacttccattcactttggggaaatcttctgccagctacctaaattggaatagccgtaatttatctacagttgtcttttgaagtaaaaattttgttccatgaggaaaatgtctggttcagcttacaactcaaaactacacaactgctttttcctgaaacatacttccatatgcagcagaaatgttttatcaccacagattgaatgcattttgtcatatagaatattaaaaagatacctactcgagagtcaagatttaatgaaattaggaactcccttttaaacttagtgtgagtaaggttaaaaaataggactgctagtgcatgttgatgatactgctttgatctttgttctaatgggccagtggttttacgctcccctcacctttgcaccataagtgcaaatgaaaaaagtaaataacttccttgcattcttatgaaaatagttttaattttatggactgctgcatagggtcttgaggaaaaccagaattccagagttcacagtttgagaactattgtggtagaccttaagagggtgacttgatttaaattgtgggaaaggtattggggaaagtatctccgggaacagattttttttttttttttttttttttgagacggagtcttgctctgtcccccaggctggagtgcagtggcacaatctcagctcactgcaacctctgcctcccgggttcaaacgattctcctgcctcagcctcctgagtagctgggattacaggcgtgtgccaccacgcctggctaattttttgtatttttagtagagatggggtttcaccatgttagccagatggtctcgatctcctgacctcgtgatccgcctgcttcagcctcccaaagtgctggcatttcaggcatgaggcactgcacccaaccgaggaacacattttttaagccagggtagccaagcaatggggaacaatagcatgggtgaaaagtttgaagtaggcaaagttgttggtgttatcaaggaactgcaagaagacc

SEQ ID NO: 93540 - DNA, 1111 bp, Homo sapiens
ataatggtggcatgcgcctatggtctcagctactgaggaagctgaggcaggaggattgcttgagcctgggaggttgaggctgaagtgagccatgattgcaccactgtattgcagcctaggtgacaaagtgagactctgtctcaaaaaaaaaaaacaacaacaaaaaccaacctcaataatcgtgttacatagcaacttcaagtaaacttgaacacctctaaatttgtctttcagacaaaaaaaaattacaaagtatttttaaagtttagaattggaacacagtatagatcatgtgtttcctaatttcttctagaagtcacatcattaactacattgttatttaacatatgctctcaattctgttgtgtttaccataggtactgtatttatttcaaggtttttctttctagaatatcttgattttgaatctgatgattaagtttaaaaatattttgttttgtagccatgcaggatatacgtactgtgggtcttgtgctgcccatgcttataaacaagtggatccgtctattacgtaagtaatgtagttttgttttaagtcggagaagcttgagaatttattgctttgttatagaagtaatttgctttttatacttattgttattatgtactcaatttcatgagggatttgacttttgatgaattttactatactttgtataggttactgaaaacttcaatacttcttttttgttgttgttggagcatttgatttttaccttccctttggcatgtaaaatgtttagttatgaaggttaaatattttgttttttgatatttctttgaaaacccagagatgagcattcttaagaaaaatgcaaagccctctgatctgttttaatcatttcgtaatttaagattctttattgtacttgttaaaattgtggttactgaaaggataatttctcgttgacaggataaggtatttgaaatattttagaatctgacagtgaatttaatatggtgtttgaggcatattaactcttaataattcaatgacagctctgaaattagcttagaaaaaaaaaaacttcctgggaacttgagactcttttaatagtatactactctgtaagaaacttgtgaacttaca

SEQ ID NO: 93541 - DNA, 1021 bp, Homo sapiens
ggatgacagttactgaaatttaaattgagaagatttggccaggcctggtggctcacacctgtaatcctagcactttggtaggctgaggcgggcggatcacttgaggtcaggagctcaagagcagtctgaccaacatggggaaacactctctctactaaaaatacaaaaattagccgggtatggtggtgggtgcctgtaatcccagctacttgggtggctgaggcacaagaattgcttgaaccccggaagtggaggttgcagtgagccaagatcacaccactgcactccagcctgggtaatagagtgagactctaaataaataaataaatagagaagattttacttttcatattgaagtactttatccaaagtaacttttgttattatatcttaatttattgtaattattgaatattagttacaaatagttcttaatcatattttgtgtgttagcagggtacagtgtaattattttcatgcttgtgttttgctacagtaaacaggatagtttagaaaggctataattaatagatgttcaaaagttgctttgatgtccttagataaaagctatgcttccaacaccaaatgctagtatttttaattatcattctcctttttaatttgaaataatggcttgagtactgtagtgctagctccaggattcttagcctgtattgtttaatgtgaatgtgcagaaaacattttagaattttttttttttttttgagagaggatcttgctctatcacccaggctgcagtgcagtggcgtgatatcgactcactgcaacttctgcctcctaggtccaagcagttctcatgcctcagcctcccatgtagctgggactataggcatgcgccgccacacccggctgatttttgtacttttagccaggctggtcttgaactcctggcctcaagtgatccgccctcctgggactcccaaagtgctgggattgtaggcatgaaccaccacaccaggccagaaatgattaacatttatctttcaaaaaatgcactttt

SEQ ID NO: 93542 - DNA, 1056 bp, Homo sapiens
tctatcttgcctcttggttaaggtctaagtcccctcataacttgccatcttcctatctctatgaccgctttcccctaccccaacccagttttggttttaccctccttaagtgacatctaatagttgttcattgtttctttaaatacatcatgctgtttcttatcactgtgctcttgcacaaactggtccctctgttgaaatattctttgttgggataattcctactcctcttttgaagactcaagtgttaacacctccaagaaacctaccctggtgctttgcctccccaatgtggtttttgatgttacctgtatatgaggtaagccaggtaccatgtcttactcatttttttgtaccctaagtactcagcataggttttgtacatagtagatgctcaataagtatttaactgaatgttaaagtgcttggcatatagtaggcgtataattagcaagtgggaagtattggtagcatatatggacagggatacaaatgtttacattctgaagagcggtggggctgatatgagactgctgccattcaagtctctgatcatggtatagatgaagcatcttggtggtaggaagggattaccaatcctgttctgccagttagggatccagggagtgtaagatttttaaagtatgacatactttaaacaagttcagctagatgaattaagtacattcacataatgagtattcaactcaagaaacacatcagtactggaattcccaccaaatgcccctctccccattccatgttccttgtattttaagaacagaaaaattttgtctgttttccaattctttatcagtggaattatatagtatgtattctttgagcttcttttttttttttttttttggtgacagagtctctctgtcacccaggctagagtgccgtggctcgatcatagctcactgcagcctcaacttcctgggctcaagcagtcttcctccttcagcctccttaagtgttgggattataggtgtgagccactgcacctggctcctttgagcttttgctcggtgttacatttgtaagattaataca

SEQ ID NO: 93543 - DNA, 1105 bp, Homo sapiens
gtcctaaaaaagtgtgagtaataggagatggagaggtgtttgtggattgtcattctgtggttcctacagcattcaagttgcgtccgtagaattaatgtgtttaattaccgacataaataagggtgaaaacacatttgctttagttatatagctatttcagaaaaaaagtgtgtgtacatatataaatattacatatatacacacacatatatcttctttttgtttatcccttgttatatgctagatccatttatagagagtaacaaattttttcttgccctcaaggaattttcagtttatttgaagtaagtaagaacttttagggcagcaaataaatatcaagtaagttgagatgtgcttttaggactactgaggagggtagaatcattttggggtaggatttgaattatgctttgaaggaagagtatttgaacaggtttggagcagggaggaaggaacattggattgggaaaccccacacagatacagaggcaggtaaatgtaaatagttcaatttaataagaatggaaggtacacaggggcatagttcatgagcctggagtagtaggctggtcctagagtacagatgcctatgaatgctaggcatcattgggactggacttactcagttgagagtgaggaccaatggaggtttcttagtaggggactaatatgatgcaaatagcattttaggaaatttaatctcataggatgattcattctcacttctttttttttttttttttttttttgagatggaatcttgctgtgttgcccagggtggagtgcaatggcacgatcttggctcactgcagcctccacctcctgggttcaagagatccctctgcctcagcctcctgagtagctgagactgcaggcccccgccaccatgcctggctaatttttgtatttttagtagagatggggtttcaccatattggccaggctggtcttgaactcctgacctcgtgatctgcctgcctcggcctcccaaagtgctgggattacaggcgtgagccaccacacccagcccattctcacttctttatgtgtgtgcagcaggtatcagcaaactaactgtggcccatactgcaaatgtagctgc

SEQ ID NO: 93544 - DNA, 1314 bp, Homo sapiens
gcacctttaaggggctccgctgtcttgcagggagtgaagggtagcacttttttacgttaccagactacagacgaggtctctgcatggggagatctgtcagaggagggcctttcagggatttgtcactttgtatgttggggctggggtggaagtactgctaagctaggggcttgggggtgggggggctcccagctcttctgtcagtgtttgcattgttactgtcattcacgaaaggggcagctggatatggcatcagcacttttcccgagcagtcgccccagtcactggtcgccctacaccaggcaggtgctggaactacctaacgaattaagtttaagctttgagcgagttgagttttctgtctccactgtctaaaagcattttagacttctttatgtgaaagtgtagggactttccctttaataaagtgcttgttagaatgcctgttttctgggattattttcaggagtcacatttctggtatgttaacaaagacagttctactgtgattcctcatagtcttcagtcatttggtattggcttgtcaataactagacctaacttctcgaggtgaatcggatcatgtttccttttgcaaagaattggcttggagagtgacatggcctgtgagaaagcaaagatttggaagaaaattcatttctctgaggttgctaaactagctcattaaatacatgtaccttactgaaatacatgactcactgaagattttctgtgttagggagacacaaaagaattgtgaggattggatttgcagctatagctaacaggtagctatagttttgcattaagcaaatatgacattttatggttaaagtggcttccattcatggtcctaaagtacttcataaacatttaatcttcctcagagcctgagaatgccagttaaattattcttgttcagcttatggggaaacatgtagagaagtggttttttttttcctctctagacggagtcttgctctgtcgcccaggctggagtgcaatggctcgatcttgactcattgcaacctccgcctcctgggttcaagcgattctcctgcttcagcctcctgagtagctgagattacaggcgcgcgccaccacgcccagctaattttttgtatttttagtagagacaggtttcaccatgttggccatgctggtctctaactcccgacttcgtgatcctcccgcctgggcctcccaaagtcctgggattaccggcgtgagccactgtgccaggccagaagttcaatgttttaaactttcgttgtagtttgcattggaatgtgggcaagtgattctggaggaatt

SEQ ID NO: 93545 - DNA, 1163 bp, Homo sapiens
tattacacagaatattacacatatcataggtatacagcttgatgaattttcacaaactaaacatacctgtgtagcttgcagtcagatcaagaaactgaatactgccagcatctcagaagccatccatgtgaccccttcaagtcattattctttctggggtaatgatcatcccattgtcaatacattttttaaacatgttttaaaattgagttcataaccagatttaagccatacaaaaatttcagtctcattaaactattttgttggctaattaatttgcttgcttatctcatttattttatttactacaaatgtcctttgactgtgaaatgaaaattaaacttaaaaagatgagttttcattatggaacaatatgtttaaattaacacacctaggaaatatatttctaaactttggatttcttttcccttacagaccaccaaatcccattgaatttctagcatcttatcttttaaaaaacaaggcacagtttgaagatcgaaactgacttaatgggaagaacagaaaaatttagttgctactgtagatttacatgattaagaggcagctttaattgccatgatcattccctctttttggatgtataagaaccttccggacaacagaacctatttctggaattgcagaagataacatatttcccttattttgatttaatcaccataaaccatacctatttaatgagtgtattctgtgcaatttttttctcagattgtctttaactttgtttttaaaatgaccttcaaaataaactgtcaaaacaccattattttaaagtagtttttgttctgtatgacaaatattttacatgattgaattgttttatgaatttctctttttcttctgtcttcaaatgctgcagagttttacaacagagagaaaatacagcagtcaagtataatttaaaaaattcagccaatttttctcagcattgtttctggacctttctgagggtgggatctgggcatcttcaatggcttaacaagtatcacaggtgattctaatgtacattaaagttggagtactaataaaagcattgcaaaggggatacaatatcttctaatgttatcaacatttatagtaatagctgtaatttattgcattcctactaagtttcaggcatagtacatttttacttaaat

SEQ ID NO: 93546 - DNA, 1076 bp, Homo sapiens
ctgcgccaggcctgatttttgtatttttggtaaagactggattttgcagttgtccaggctggatatatttctttaaaaaagaaacataaagggaaaaacattctcattgtgataaatagagggtaaccataaaaatgacaacagtgaatacaagacaatggtaataaattttagctgtattctcttgagtgtataagccttggaccctgaagcttgctctctctgatgtgaccagctttcttactatgatttggtgctgtttggtgttacattcattattttttttttttttttttgggaacacactctaagaagatacatgaaaaagagaaaaaggatttgtatttactcctgcaaagtcagaaggaaagggagaaagagtaggatcttgagacatgacattagaacaatgagataataggtgcttttggagagagagagcttgaatgagattgaaagatgggtctgaatttattttgggcagagaagtttgtggtctagtaccatctttctagtcattgatttgccttttctattagtgtcatatttccattagttttgtttagcactcaaaataacctggttatttgaaatgttcatgcactgtttttttgaattcactagagaatagtagaaaatgagaagattaatgcagaaaagtcatcaaagcagaaggtagatctccagtctttgccaactcgtgcctacctggatcagacagttgtgcctatcttattacagggacttgctgtgcttgcaaaggaaaggtaagataattgtgtccacaaatggagttagtaaagaaagcaaaatagattcccctatctgaaatatcatagttatgtatagcgactttttactgtgtgatttatggatgttaaagtttttaagaaagtattcagccataatctcataattcagacatttaaattttttcccaccagtcttagatcatatgcatatttgtaaagatttgtaatcatgatatacatgtaattttgatttttctttttatttattatgacataacatttttctgtatctctccacagtcttcatgattataatttattatt

SEQ ID NO: 93547 - DNA, 1301 bp, Homo sapiens
ttcgtgggtgggtaggatgaaggaagattgtagctcgtagcttccgaggccagaccttggccaggactcacgcggactgcagagagcctcggggactgacgatggttctgcgcgcctcccagcttcttgtccgccgggaggttctgcgcaggcgcggcagtcgtgcgacagccgtcacttacggccggagctgtttgtgctgggagctggtggcgcggtgcagggctcttaagaacgaacggcttgggcgcgggtaatcagctccctttcccccactttctcacttattctaggtacttgggactgtcgtagagtttccagaccccatgtaggcgcccagtcgtggactgtcccactctgctgctctactgctcgtggtgctcccgcgcccaggtgggggtgaggggcggggtcgggggctgggctgcactccatcctggagtcttcgtgttgaaatctcccaggtaactcgcggctcttcttgttttccaagactggtatccggggactgtgacttgcagggtccgccatggagccagagcagatgctggagggacaaacgcaggtatcaggaggccgtggattcagggtggcggtgtgcagggaggcagcgagaaaggggggacttatatctctgtgaccggtgttttgttttctaggttgcagaaaatcctcactctgagtacggtctcacagacaacgttgaggtaactcgccaagttcctatgcctcatctgtgttgtctcttgcaagctggagaaaacttgggatctgcttttactaggtggctatgcacaagggaaaactttgttatcgtgaactgaatagtatcaagttatgggtagcttgttttattagcagtactaatgcttcttggtgtacagacgtacaaattacgtttgagtcaaaggattgaacttttattgcgaaacacatattcttgagggatactgtctgaatcatttttcttggtggcttttaatcgatcttttgggatgttgctacgtaaaaaccgcatattaaaattaagaaacccttcgccgggcgcgatggcccacgcctatcatcccagcactttgggaggccaaggctggcggaccacctgaggtcaggagttccagaccagcctgaccaacatggtgaaaccccgtctctactaaaaatacaaaaattagccgggcatgatggtggatgactgtaatcctatctgttcgggtggctgaggccagagaatctcttgaatctggaagacaggttgcagtgagctgagatcgcgccactgcactacagcctgggcggca

SEQ ID NO: 93548 - DNA, 1012 bp, Homo sapiens
aaataaaaacttcctctagagaggaggtacccagcaatgaacacattatatcagatttgaatatgagattaaacaatgctttttgtttcattgttattgaaatcatatttgtatttttcaaaagtatatatacttaaaaattcctaaataaaatgtctttctgtaatacagcattttaggttataaggatcaataccatgggctgataagcaaaataggactcacggccccaaaatgttgataaacatcatgaccatattccccataatggagttacatatacacattacaatgataaaaatactaagaagttatatagtaatgtttctcagacttgttcacaaccctgttttttatgtattacctctcaacagcatgatttgcaatatttagtgtactcttcatacgatctatacaaataattttttattttaaagcaggacagaaggagcaagctgtggaatggtataagaaaggtattgaagaactggaaaaaggaatagctgttatagttacaggacaaggtaagattgtatttgtttatagccatcccaaattatgatatattcacatgattgtccagatttcagatctatttatttatttatttatttttctttctttcttttcttttcttttcttttttttttttttttttgagacagggtctttcctctgttacccaggctggagtgcagtgatgtgatcatagctcactgcaacctcaaacttctgggctcaagtgatcctcctgcctctgcttcccatgtagctgggaccacaggcgcacactaccatacttagctaattattattattattattattattattattactagtttttgagacagagtctcgctcttttgcccaggctgtagtgcaatggtgcaatctcggctcactgcaatctccgcctcccggattcaggctatttattctcctgcctgagactcctgagtagctgggattacaggtgcatgccaccgtgcccagctaatttttgtatttt

SEQ ID NO: 93549 - DNA, 1054 bp, Homo sapiens
ctacctgggcctcctaaagtgatgggattacaggcatgagccactgcacctggctgatacacttttaagtttttcagctacttttcaatgtagaagtagatggaaaaccatgtacgttatcttcagtagtgtgtttttggttggttaaatttgacagtatgattgtcattattttttgtaaattaaatttttacctggaagagcttaccttactatattgagtatctttctaacccctgatttttgcttctactatcataataactttatttaagtaatcagtatgttatagcttttttttttttttaagtattcttttgccagaagtttttatcaggctctggatacctctttcctctgcatagtcctcctggatggaagaaacaaagagggaaagagtaacttttccttagatgtttgtctttctcaaagcagttatctttgtatatctaagaagagaggagaataacactgtctctctttttttttaaatctctctctactcattctctctcaggaggagagtagaaagaagcacagctcttcctataacctgtccttattactgagaaaggaacacattgattgccatgtattggggattgtattataccttacatttttatttttattttttattaatttttttttttagacagtcttactctatcacccaagctggagtgcagtgatgtgatctcggctcactaccatctcttccttctgggttcaagcaattctgccacgtcagcttcctgagtagctgggattacaggcatgcgccaccacgcctgactaatttttgtatttttattagagatgggatttcaccatgttggccaggctggtctcaaactcttggcctcaagtgatgcgcctgcctcggcctccgaaagtgctgggattacaggcatgagccaccacacctggcctcatagcttacatttttagagaatcttttctagtacttaaatcggtaaatatggttatcttttaaatgtaatatattgaactaatttaatatttgctcttgtgatttttaaaggctaaagca

SEQ ID NO: 93550 - DNA, 1209 bp, Homo sapiens
tttggttgttttaaggaagggaaattaaattcctgtgtgctagattttcaacataaaatttaaaaaactggaataatgttgcattttatgtgtataacagtataatgctttgttttaggtgggagaaggagagaaattggtgagggctctttttgctgtggctcgagaacttcaaccttctataatttttataggtaagaacatattttccaactaagttattgactatttgtgaaatttccctctccaaataggaaagatacgattggaaacattattcagaaggaagaagttttaaagaagggcaagcttaaagactatctaatgaatttagtaggacccactatattaataagtagtaaactagattaatctcagatgactcacatagcttggtctttaattaaagtcttatacttgtatttcctctagatgaagttgatagccttttgtgtgaaagaagagaaggggagcacgatgctagtagacgcctaaaaactgaatttctaatagaatttgatggtgtaagtgttgattatgatatttttaatgtggcagcattttagtatattttcctattaaatggccaaggttaaaaatacaaatatctttatatttgttattacttttctaaatgaattgaaaaaagattttttgcttgtaggtacagtctgctggagatgacagagtacttgtaatgggtgcaactaataggccacaagagcttgatgaggctgttctcaggtagggagatttatatggaaatacatgcatttattacagacaatatttactcatgtgtccatcttacatattatttccttactctcagttttaagactaaattcactattttcttccagtactatctctagcctcttgttaccaactacataaggattttgaggtcaacagcttgatatcaggagaattagtctagtaaaggtttagttacggttttaggcaaattggtcagttcttctgggttgcattaaattatctttaaacttgaaaattgattcttaccgtcttttattgggcttcatgagaaaataatcaaatcagggttcatggaaaatgtgttttctgttcttgtgtgtttgagcagtttattcccttcatactggaaggacggtttgggtcagcataaaattcttgggcatcctttcccaaggaatttacaatattgctccattgtttctagattgg

SEQ ID NO: 93551 - DNA, 2204 bp, Homo sapiens
tcatggcgaaaccctgtctctactaaaaatacaaaaattagctgggcatggaggcatgtgcctgtaatcccagctactcgggaggctgagacagaagaattgcttgaaccttggagggggaggttgcatatctgagtggtgaaattgtgattctttttttctctttgtctgtatttttgaacttttctataaatgattgtgttttgtttttatattggaaaaatattatgctttcaaatgttaatacctatgaaactaaacacaagtaataaatatattagtatagcatttattaaggtttcttgtgtagcagatcaacatagaaaatatatttaaatggctgacataattttctaagaatacatacacgtatattttttataacattaagaaacagcagcatcattactttaatccatcatttcgttaaccaccatatacctgttgatcatttgtattgtcatgtgctttttaaaaatctagatgagaaatattcgattatctgacttcactgaatccttgaaaaaaataaaacgcagcgtcagccctcaaactttagaagcgtacatacgttggaacaaggactttggagataccactgtttaaggaaatacctttgtaaacctgcagaacattttacttaaaagaggaaacacaagatcttcaatgaacgtcatcggctacagaaacagcctaagtttacaggactttttagagtcttacatatttgtgcaccaaacttgaagatgaaccagaaaacagacttaaacaaaatatacaatgcaaatgtaattttttgttgtttaaggccttgccttgatggtcacagttatcccaatggacactaagttagagcacaacaaaacctgattctggtcttctttaccaatataatcataatgtaaataataatttgtatattgtgttgcagatgaaagtattccaggaacagtgaatggtagaagacacaagaacatttgtttgtttgtcttctgatgttttttcttaaaatagtaatttctcctacttttcttttctactgttgtcttaactacaggtgattggaatgccaaacactcttaagtttattttcttttttcgttttataaattcagtgtgccaaatgaaacttttttcctaagtaactgtaataggaaaaagtttattttgagagtttcttcttcataaatctacagacattaaacaattgttgtgttctttttaccttttatttttctattaccttgctaccaaacagtttagatagcaatataatagcaaaaaagcaaatatggtaaaatagagaaggtttgaaggtttgagttactctgtcatataacatgtagatcagtcttcatgtgacctgcagtatttttttttctaatgtatttgtcagaaatctgttgtagactgttaacttcttcctgatggaatttattttctgcaagaattattctgatatttaagagagccaattttaactgctgtgaaaatgtttccagtgcaagagaagggaaatactaggaactaagacatttctaatttattgcttattactttcttaattttacaggataattataagcaagtggaactaccatcttttattcttaataattattaatcccttcaatgaaactttaaaaaaactgaatttttatacatggcatacatttttctagttccttctgcttgctttattaactcaaaagttctagttctagtctgttgatctgccttttgttctcccaaaatgtacagtaattccatttgtttgtataaatatgcctggattttcattataaaaatgtcattgtagggagtagagactcatatcatggccttttaaatattgtaataaaggcaaatagatatttgcccttagtttactggttaaaagtttgtttacagaacttttctctggtgcttaaatgatgctatgtaaaatgtcatgagtggaaagaatatttgtagtagtaacaagaatttttcatttaggaaagatttcttaggttttgaaagaatacattaaaataaaaaacttgcccctactaggtaagaactttataatgaagacatacattcttcttaattttactcttgctcttgttaaagatttgtttgaatatagaagatgcatgatttctgggtttttttttttttttgagacagagtttcgctcttgttgcccaggctggagtgca

SEQ ID NO: 93552 - DNA, 1315 bp, Homo sapiens
atcatattaaaggactatgtggttccagctcaacttttaatatattgtctcctttaaaactatcatggttataattctattgggaaagacttttagataacaaagatttcaaatgttaaaagagataaaagtcaggttaatactatcttaaacactgagtcagaaaatcattactgtatagaagttgctttcctgatcaagtctgaacttcagctagtgctagagaactattttctatgacttaactctaaccaagttttattttaagctgtttctttgatagaagggccatgaaaatagagtaatgatatagtaggagataagggattggtttggtctttttcaataaagatagaagttgctgaagttttctgaattaataatgacttagattgtgaccttttagattcggtgttgagctctgtgttgtattacttcctaaaagataatgcttaaacattaagcattagtgtgctcttcatgttaatatggcagagttttgtaaactaaattaaaacttactgatatattggactttgagccaagggaaagaatgagtactatctttccagatatcttaagggtaaaagcttattctaagacagtctgtccattgagaatattagatttctgacttgcaaatatgtttgtactccagaagaattagaggaaaagcagatactagaattctaatttaattacatatacagccgtctttgtttatagtgtagaattctttatattttgtacaaaaactaattcttttggtaaaatgaaccatttacagttcggttttggactctgagtcaaaggattttcctttaaatgcttgtctcaattttagtctggtcttttgtacttttcttcagaagaaatgaattaaagggtacagttgcataaagtgggtttttatcctaatgtattggaaataaatgataaactttattttgtctttacttttttactttaaaactttttgatattttaggggttggagtctgataatgaaggagttgtgtgtattggactcttagtaacaattataaacgcttaacaaaatatagaaagcaatgattgggtggctctgcagagcaatcaaaacaaggtagaaactgcaaagtcctataatggaagagattcaggctgggtgtggtggctcatgcctgtttgggaggccagtatgggagaatcgcttacactcaggaattcaagaccagcctggggaatatagggagaccctgtttctgccaaaaaaaaaaaaaaaaaaaaaactaaactaaaaattagccaggtttggtggcctacacctgtagtc

SEQ ID NO: 93553 - DNA, 1049 bp, Homo sapiens
cccccatctcttgaaaaaaagaaaaaagtggataaagtaattctaataaggggttgggaggtttagatgaggtaatatgttaagcactctggtgtctaacgcacagtgggtcaattaagtgttattattatgattgtgattatttctagaaaataaggactataattgggtcctggtaattgtcttttttttttttttaatcattttaaagtttttctggaaagagaaagcctctgacatgggctgaaggtgctctctcttctgagtcctaggaattgtacaaataggtactccttggaatctgtgattttcattgtttattattattctagaaaccctaatctgctctaacagtgttgggctcatagtagacagcacatatgtatattaagtgagcaaataaatgaatgtaaatgtgttctagagagactggtttgtgaattgaaagaattgtgatgatctaattaatgttttggtttcaggtttgaaagattagaagtcctggctgtatttgcctccacagtcttggcacagttgggagctctctttatattaaaagaaaggtacatttgtataggatattattctaaatccccccatgacacctttgggaacatgaaagaaacccgtcagacacatttgctttcaagggtatgaaaacttagatgagcagggctggagttttgatagtacactttctttatgtttcagactttttcttctgtttcattttttttacttccttccttaatgctactaaattgaatcagaagtggttgtgaatgaaacagagattcagtcaggcatgtttgatgcttattacaaacccattgaaataggcttggcagagaaagatagacattacatattaaggataatttgtgaaaaaagaaaacaactaaaaaggataatttatgagtctccttgcctcatcactgctaatagttaatagttataatattaaaagattttgtgaactttaaggtgggtgaatgatatatttaataaagctttttaactttataatttataggacttatttaatatat

SEQ ID NO: 93554 - DNA, 1003 bp, Homo sapiens
agttggccaatgtcagatttcagactgtggcaacataacgtttttgctggtatttcacaaacaaaattccctaatactaagactccgtttctttactcttaacagttcccaagttctaaatatttttatactacacaggaaggcctttctatcttggcttcaggcttctcattatttccaggcctaggaaacactaacccagcttcccctagtcttctgtaatttcaaatttgaccttcaaaatctttgcatagcacctgtagaaaagagaattggacgaggctcagggattcagtgtaatcccagcactttgggaggctaaggcaggaggatcgcttgagttcaggagttcaagaccaacctggacaacagagtgagaccctgtctccaaaaaaaagaaacgtatatatgtttcatatatattgcaactatgtgattttcatatatatatgaaaagagaattgtatgtatcatatatatgaaaaaacaattgtatttctcaaccacagagctgccaactatatggaccttatctattctgatcagtttaattccacaaagtctgacttgtccagtatatcgtaaaacaaataccattgatatttatacagatttataacagcgtttacctgtagcaagatactgttaatgctaaaagtccttacttatcctttgtaagatggagcaacagtagatgggacatgggtgatggggctagtaactaagttcagattctgtatctggaaacaccaaatcattaaagcagaccactttaccttcccacctcttagtccctctacgtattgaaattacatactgataataccaagaacaaattaaaggtgaatgttatcgttgttctttttaggggaagattattagttggtacttttgtggctctttgtttcaacctgttcacgatgctttctattcggaataaaccttttgcttatgtctcagaaggtatgttttttatttactattaatttaaaaatccaactaa

SEQ ID NO: 93555 - DNA, 1097 bp, Homo sapiens
ggacttctttatatattggtattattgcttattcttaccaagtatgccatacattttcattgcttttccctcagtgtggaatgcgtctctactttttgaaattctgtttaatcaccaaccgtagattaaatgccatcttcttttgaagtcctcttcaattggaattaatacctaccttttcggctcttacattgtattttttgtatgtttcatttatattcttccttgtattataatattcctatcttgttcctacatggatatttctttttttgtattttaaagattcacaaattatttaactcattacaatgataatcaccagcaagtagtctttaagaaatattaacattaagctttttctttcaaagaaaatgccaggaacttaccaaatcataaataaaatgttttatctaatgaattttttgttagtataattctaagcaatctctttgttatgattttgccccttttaggctggatcagtgcatgtaagaattcgacgagatgccaatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccagctaaacctagtagtccacctccagaattttcatttaacactcctgggaaaaatgtgaacccagttattcttctaaacacacaaacaaggccttatggttttggtctcaatcatggacacacaccttacagcagcatgcttaatcaaggacttggagttccaggaattggagcaactcaaggattgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgt

SEQ ID NO: 93556 - DNA, 1029 bp, Homo sapiens
attcagaggcaacacctgtgcatctgtcccaccaaaggtgctttaatacctaccttcactatttgagaaaggacactcacagttgcctgtgggttatgaaagaattggccctacgtcctgcatgtaagatgttacaggggacattgggccaggcattattatatagagaagtcttatttgccaagctctgactaacttctggatatgaaaataaggaacttgcccagcataggcctataggcagcagccttactagtaaatcttgccacagaatcacttgaagctagacagagaaagaagttcaatttaaatatttgtcccattgtttgtgattaggatgtaagctttgtggaatgtaattaaccctgctttacgaagtcaccatattataataggaaaaacactgcctaggaggcaagagatctgaattccagttctgatgctgccactgtgtaaggaagtagttttataacccatgggcaaatcatctgagctttctcatctgtaaagttagggagaggaattaattagttgatctgtaaaataatcagcttcaaaacgttatggctaaatctgtagaatgtatgcccaattgctaaacggatgttgtgcccagaattttatctagtgactacctcaacatacaggccaagcgttacctacaccaacacccaagccattaatttgaggtgccatgagaataggtgaaccacagcctaacaccatttaggtttttgtgtttttttcaggcttgcctctacttaaatatatttagatgagagagttctcttagacttctttctttgtaaggaagggttatttggggaagtgttggaaaaaagattagggcagggtacccttagtttatatagggtacaaaagaatgggaaacatcttccctttcttctttaatctctgaagtcatgtttggaattacatataatgtagcaggtactggagaggacctgaatttcaagcttctgatttagctgtttgtaaacttccaagttttgcttgactaaagaatgc

SEQ ID NO: 93557 - DNA, 2033 bp, Homo sapiens
tattgtataaaatttttacttaatcgattttcttatttagaaggaaaaggaaaatttcctactttgcaggaattagttttctctcagtaatttggtataataatagttttttcaaaagttgcctaatcataatcaccagggaacttatttaaaatactgataactagatccttcccttagaaattatagctcaaagaaaaagaaacaataagttataatttaacagaactagagagtcccccaagtctttttaataggcaccccaagtgattcttatgattagactggtttgataagaccacatttacagaagtcaaggagtagagcaaagatggacattcttaataagtttttaacatttgtaacaagttttactatttaccaaaattggttgttgattttttaaaaatattgtaaacaccatttttactctatgatatccaaaaagttaattgacttgctaatatgctgccttttgtcttttttcctttttttaaagctgtttggtgtgttttgggctgcctacagtgctgcttcattgttagtgggtgaagaattcaagaccaaaaagcctcttctgatttatccaatctttttattatacatttattttttgtcgttatatactggtgtgtgatccaagttatacatgaatagaaaaagatggtgttaaatttgtgtgtaggctgggaattcttgctgaaggaattggagaaaacctgttgctgcaaaattttacatgttccagatggaaagggaagtctaagcgctttttaaaacaatttttttttgtatttaattaagcaattgcagttatctgggatttttgggtcagaattttaaattctgtttgattctccatattccagtgaataaaatacaaaagcattgtgtttttaagattgtgtcgatattcacctaaaaacttgtgccaaaagcacctggattggtaattatatttcacttaaagggtaaatttgacaatatcttgataatcaaaagtgcaatttttttcttcaaaatgttttctccagcatcacagatcctgcagatatatatttatatttatacatatatatttatgaaataattcttactcacaaaatatatttctgataaacattaagatattaaatctgatgcacaaactttttaatttggccattaatcttttttatttaaaaatttaaatttgtttttaaaattgtatatagtttttaaaatctcacacatgcttcgatacttccttgttaagaattcttaataactactaaaactgatttttaatagttgctgatatatatttggtttgtttgggtatacttttcaaaaccatttttgaatgtccaaacatctgatttaaagtttctgtttatctttctgaccaaaggagcaagaggtataatggatatggcattcattaaaatctttactatgtacaaaaacagtaatatttacagcatcagtaaatatttttaagtggtacttctaaatcataaaagttggggaaagagacctttaaaatcttgtggtgttgaacaatgttatatgaagtagaaaaaataaaatacttcccagttgtgtgttttgttttacagcaccatgtcctgtattacttgatattttaacaagtatcaggtactctctaacaaatgtacagtttttgctaagggaaatattaagaaatttttatcagtgaaatatttgttgcaaataatttcataggtttttagatacacctgtagttaatattactttgtaaagtaggtaaatcattttatttatgtccataaaatatcaaatgtctgttaactattagcaaattattgtattatcctttctggtctcacctggaagagtttcctgctgtcctcagtatgataacatggcgacctcttggtatgtatttctttagcaaacttacccatcaggaaatatccagcacctctgaagcaaacctacaaatgagtgtgttatcaagcccagccgtcttcctttcccctaatcccaaaaggaaagaaagaaaaacttat

SEQ ID NO: 93558 - DNA, 1288 bp, Homo sapiens
ccgcttccggccacggccgaacagctgcaccgtgcgtaccgggaacggtcaaggcgcagctggaaccgctgcaaaaggcctccgggcgtaccggacaggtcgcaagggcgggggtccccacctagcggaaatgcacggaggccaacccctccccctgcccccgcgaggagcggggcggactcggcagccgccactccccaggctcacaggaagaaactgggacgctgcggacgcggaactggccagacccgcggcgcgtggcacgcgcgagccctcccgcgcatgctccacccgccggcctccagcccgcgccccgggccccgcctccctccctgcttctccccctctcccgtcagcctccctccgagtttggcccctccggccgggcgatcgacgttccgcgtgcgtgcgggcgcctgacttcacttccggctaacgcgctcggcttgccccctggccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtggtgagtcttccgcacgccgggcgggcgcgaagccggggaaagaagccgtccagccccggggctcggcctcgcgactcggggaagcgagatggcgagagggcagggctgggggttcgggcccagccgtgaagggaggcccggaagctgatggagggggaccttaggacttggctttttcagcggctgcagttgggaggaaagaccggcgagtcagggagtggtgggaggggagttgcctttcgggcctggagcgtccggtctggcttggtcctccgcgagaggtgaggagaccttggagcttggcaccggaggaagcgaggcccgggtaggccctggagaggctgtcggtcctgcgtccggttagatgagagcgaaaggctggaagggttgaccccgggcggagaggctggtggccggaggcgaggggcggggagcgtctgagccggcaaccaagccctcccttgtgggagaggagccggcagtctgctgttctcaggtcc

SEQ ID NO: 93559 - DNA, 1041 bp, Homo sapiens
ggaaggaaagacaatattcactttagtggtagattactaaagaggagggttttagatgtataacatgaaggtgtaggtagataagtaaaatgtagcattgatttgggataacaggttttgttggggcatctgttgattagaagagttcgggattggatacaattgcaggtccccatgcatgaagattgagtatgtgaattaaaatatgtagaagggtttatagtgaacggaatgaaggattacagaaaaaatttggaagttaacaatggatgcattctgaaacattttcatatatgagaagtgaaatttattattatttgtaaaatttattcgtatttgtagagatggggttttgctgtgttgcccaggctggtcttgaacttccggcctcaaatgatcctcccacctcagcctcccaaagtgctggtattacaggcatgagctgtcccacctggccagaagtttgttattaataataattatcagaggttgtatagggtcctatttgccccagttcagatgattgaggagggaatgctgcattttatgttttacttagaatctgcaggtatttagtaagtttgcttttaatgattaatagagggtgacagccctataaatagagtagagagaagatgccagtagcgatcatggtcctaacataatccctctttcccgtttatgggcaatgggccactttcttttctaccacagaggaaagacatctgtgtctgaggggataaagactaggtgatacagtaataggtcttatggacgcctggggttcagtttatagggttatgggttgcctgtagatttgcagttgaaggatgggaacaggacttgtatgtatatgtattgagtggcaaagacagtgaatttttaactatgactactagtatatgtctttatattatctgtatctgatataaaatgtttataaatacagtttaactggattaagagctatcagtatatacacaggctgggtaagtatttgctccctgtcagtatttaagagtgaagatttttgaagctctg

SEQ ID NO: 93560 - DNA, 1083 bp, Homo sapiens
tcattttgcacttacagaaaaattgcaagaatagaatgttacaaagaacttccctatataccctttacccagctctactagttttaaacattttactacatttgcttattattcccttaatatatatgtgtgtgtgtgtgtgtgtgtgtgtgtgtgtgtgtgtatacacatcatattttattctacttgagagttggttgcatatatcatgctcattttccctatactgttgctgtgtttatttctcagaacaatgatgttcttttataatagcaatttggttgtcaaattttagtaatttcacattgatacttttatctaatttatggtacatatttgaatttaatccagttggcccaataatgttctttagagaagttttttccagtttaagatccaattcaggataatatattgtgtttagtcactatgtaaacatttatttttaatagaccattggcctgaaaatcttaagtgttgaatttttgttcttttaacagctaaaccaggtggacaggtgaaatgtcagtatatctctgctgtggataaagttatatttgtggatgattatgcagtagggtgtaggaaggaccttaatggaatcttgttgttagacactgctctgcaaactccagtttcaaagcaggatgatgtggttcagcttgaattacccgttacagaggtaagttgaaataagtatcaatgtggtcctctacttaatgtaatcttagacatattagatgttaaatgaaattaagtcatcctttaaggacgttattatatatattgctataaaaacaatttacttattgaccacaacttcatttaaatattaatactcaccttttctctgcataattaattcttgttgaagtggtgtttttaggtgtgaatggtgcatcagcacaggttaaacagctgtaaccgagacccaaaaaaacaatggcttaaacaggatagcttgtttccaataatagtccagggctaagtgtatggccatcattgccaacctcaacacttgggttagcttgggagtttaagacagctgctctaggtgtcattatttcccagtcacagggaaag

SEQ ID NO: 93561 - DNA, 1018 bp, Homo sapiens
gactttatatagcttgagtatttaaagctcattggaggactttaagtttgtctcttcagattttttcctgtattatttttgcttatggtttcagcttgtccatttttctatcttgatttggtttacaataactactttgtgtttaaactttaccatgtagtatttctacactgaatacattgctttatctcatttaattttataatagccctttaaattattgtttaattaagtagatttgttaaaaggtaagtttagtatagtacctgtcataatcattgcatattaaaatatctgaaagaggatctgaatttaattttttgttgttcttgtgttgaattttctgtgatttttttattttttattttttatttaggcacagcagctcttatcagcatgtttagaaaaggtagatatttctagtacagagggttatgatttgttcatcacacagctcaaagatggtttaaaaaatacatctcatgagactgcagcaaaccacaaagttgctaaggtaagaagttaatagattgcctcttttggggttatattacaatggacacctccattcttttgcactttcctttcctctccttttggaaatgttctaattctagatttttcttttaaaaagcagaatgtgcttataagtcatcttaaagttgaaactggctgggcacggtggctcacacctgtaatcccagctgagggaggctgaggcgggcagatcacctgaggtcaggagtttgagaccagcctggccaacatggcgaaaccccatctctattaaaaatactaaaattagccaggcgtggtggcaggcgcctgtaatcccagctacttggaggctgagacatgagaatcacttgaacccaggaggcggagttagctgagattgcagagattgcgccactgcactacagcctgggggaaagagtgagactctgttgcccaaaaaaaaagaaaaaagttgaaactttgaaacttcttaatcgaagcttaacttcagtttgtggga

SEQ ID NO: 93562 - DNA, 1023 bp, Homo sapiens
acaggtgtgaaccactgcacctggctcttttttttttttttttttggttcgagacagagtctcactctgtaacctaggctggagtgcagtggtgtgatcttatctcactgcaacctccgcctcgtggattcaagctattctcctgcctcagcctcccgagtagctgggattataggcacacgccaccatgcctggctaatttttgtatttttagtagaaattgggtttcactatgttggccaggcttgtcttgagctcttaacctcgtgattcacccatctcggcctcccaaagtgttgggattacaggtgtgagccaccgtgcctggccaccttgctttttttcactcaagaatttgtcttggatatcttctcatatcctcagagatcatctatgttcttcttagtagttgcattgaatttttttttgtagatttgtcatgattgtattataccttactctattgatggggcattttatttaggaaaacagaaactgtcctatgagtttcaacagagataatttattgtaagaaattaactggtgtttgaaaactgaaaaagtgaaaaggagatcctgagataacagagataactataggaagcagttttcacctaggtctggaggaacaaagagtagagattaggggttatcagaacctagaaacttagagaataggccccgtggatctgggactaggaagtgctacccagttggtaactcaggagcttggacgagggcgttgcaaaactgggactcagatctctgaagagagatgctacttgactgatggtagtacctctgagggaactctatgaaactggatctcggaatgctaaaacaaccaaaccaaaacaaaatgctgaagactggaagaatcaactactgcatcatgtcctttgctgaaacagtgctgatggcaatggccagtaaataagaaggagcaagtctttcttcatctttctttccagtttccttcctgtgctgttgctgggagaacctaaaagccaggaaactggttga

SEQ ID NO: 93563 - DNA, 1029 bp, Homo sapiens
gctgaggcaggagaatcacttgaacccaggaggcagaggttgcagtgagccgagattgcaccactgcattccagcctggcgacagagtaagactccgtctcaaaaaaaaaaaaaaaaagaaatatacaatacatgattagtaactgcagtcaccagatcactaaaattaattcctcctaagcttcccaaagtgttgggattacaggcgtaagccactgcacctggcctttactgcacattttctttacccagtcacccattgatggatacttagattggttccatatcttggcttttgtaaaatattttatttttttttataactgcaagtttctgttttaaatgataaactaatgaagaaaactgacttgaaactgatgagtgttctttatttgataatggttaagttatgattttggttaaaactgttgagtacattttcctttgcttatactcccattttctttcagtgggccacagttacatttcatcttcctcatcatgtgttgaagtccattgccagtgccattgtaaatgaactcaagaaaataaatcaaaatgttgctgccttacctgtggcgtcctcagtgatggacagattgtcttacctcttacctagtgcacgtccagaactcggagtggggccaggccgttctgtagacaggtatgaaccttgctaacaaaggtgacagtgagatagaattgattagtttttgcattaaacaaggaataactagaaaatctggttatgatttttaaaaatttcacaatttctagcctaattttgaaattaaaaaaaaatcaatatgaattagaatctgaaaaccagatttaaagtaaactgctacttgaattgctatttttaaacactatattttagtacactaaaggtatttgaagggattataaagccacattttggaaattccagtttagtacttgcttagtaaatattttagtcaaattaaaattactataattatttaatgattaataactatttttccattgatgacattttgtgacctt

SEQ ID NO: 93564 - DNA, 1090 bp, Homo sapiens
aatagccaaatagaatgtgctatgttcatataatagactgtggtccaacagttaaggggaatgaacagtaagatctctgttaatcaccctcagtaactttcagatatgttactgtatcaagaaatctttcgtgttaatagaatggtagatgattggatacatgataaaatgtatatgtgtcatgtacagtgacaccaattgtttaacaatttaagaccctgtattttatttttaaaattttttttcatacatacttccacatcatgtattttctatatgtacatttatgtatgtaaacttaaaaaatattttagaaatgtatcacttaaatttataatggtggtttcctggaggtgggattggaaattattgggattagattttaaaattgatgtgggtctttagctttattttatatagccgcgtgtaacttatataaataaaattttattgaaaaagttaaaactcaggaaagagagagagacggaaaggggtaaggtacgctagatttagctgggagggaacctggcccaaatgtcatttgcttggaagtgcactgtaaaaggatttaggaaagacatctacatattaaaaattgcccaggatttatagatggatttatatatgtaagttgtaggtgcattgtaaaaagaaatacatacattttaaggagtagcatgttttatgtgtaaagttctttctttgccatggaaataaaacaatgagtttaaaaacaatggttctttaagaaacatttatttttaaaattttatttatttatttatttatttttttggagacacagtcttactttgttgcccaggctggagtgcagtggcgcgatcttggttcactgcaacccttgcctcccaggttcaagagagtctcgtgcctcagtttcccaagtagctgggactacaggtgtgcgccacaatgcctagctaatatatgtatttttagtagagatggggtttccccatgttggccaggctggtctggaactcctgacctcaagtgatgcacccatctcagcctcccaaagtggtgggattacaggcgtgagccaccacgcccagcctattttattttt

SEQ ID NO: 93565 - DNA, 1028 bp, Homo sapiens
ctgttttaatgtacaaactgaattgctttatttttagtaaacttttcctttctaaatctatgcaaaggtctgaacacgaaagacattccccaaactgcccatttgtgaaaggtgagcacacacagaatgtgccattgtcagtcactcttgcaacaagtcctgcacagtttccttgtacggatggaactgacagaatatcttgctttgggtcggggagctgccctcattttctagctgctgcaactaaacgaggaaagatctgcatatgggatgtttccaaacttatgaaggtatgtttgaattttgaagtaacaaattagtaattgaaaaaagatcagttgtaaacttaggcttttcatttgtttaggtgcacttaaagtttgaaattaatgcctatgatccagcaattgtacaacagcttattctatcaggagacccaagctcaggagttgattcaaggagaccaactttggcgtggctggaggactcctctagttgctcagatataccaaaattggaaggagataggtatgtgagtttgttttagtagtatttaatagatgttacatgttttcctaaattttatattctcatagttctaataattaaagaggaggaaaaaaaagttacgcagttaagagatcagagagtaaatgtttggttagaaatctgaaatctgtgattcttgaagaaaaatcttcattcagaaacaccgtagtttataaaatatgcttaactttctatcacaatctatgtcaattggaaataattgccacattgaacaatagatgatgaaaagtcaacattggaaagtctaaataatgaaatgaaattctattgtagtttcaccttctgctaaatcttttcatagagcattcgaactagatgatttcagtttccgttttttcattagcacctcaaattatggcagtgctaatgaataataataatgggatgacctgaggtgaggcaagaggatctaattgtttaaaacagtgtaccagtagtcagcagtgagttgagatacc

SEQ ID NO: 93566 - DNA, 1054 bp, Homo sapiens
tttctgaccatattttgccaataggactagatattaagcatgcttaatttctgtgatttcttagaagttagtggaaaagtaatagaagataatgaaatttatatgtccttctaggcacttactttaatttgaactttgtcttgaagttttgtaatttggggattaaaaatggaatcaaaatatacttctaggattacatacacccatacacatatagtcacaccctcctaggtaaaatctgcattttagataaacatgtattctgtattattagtggaaatacttctcaacattatatggggtaatgtgcttgagttgaggtaatctctacttgcttttaagaaattcacaatctagggtcgaaggtcaattttctctgaagaaagtctcaaacaaatcatacaaaaacattaagttgatgtggtaggaggaagctgaagaggtgaaacttcatccctaaccttaagccccctctcttcacttcccctccccaagaagtaggagcagtcctgttggaattgatagtgaatataatgagccacactacctctcactttatgtgacacaagatccaatatgtttggttataaaatatactatgtgggtttcattagcttgaagaataatacattaattggaaaaatctaagcttatccaagaagtttaaagtaattagcaatatagtttgcttagaatagtttttgtaaaatttgtttttatttcttatttacattgaaggactaaggaattgtttttgacaattttttcttagaagactatatttgtcttctgaattaaggaagaagatatgctaatacatttaattttaatgaattaagatttcttctagatgattcacttgtcatttgtatatcaggtcaagttggtaaaaattccttgaatgtaaatgaaattgtttatgggattgctgtaaaccaaggtactgttacaatattagtatgtctgtttttcagaaacacatataatcttaactaaacatttttactttaaccataatatttattttgcatgtttattgctttgtaaaaggttt

SEQ ID NO: 93567 - DNA, 1040 bp, Homo sapiens
tttttgtcagtgttgttaatcagttatgatatcaaactactctttatatatcatttaagcctattttaattatatggttgagatgtgtagtagtgattttaacactgtactttcaggccaggcatagtggctcatgcgtataatcccaggactttgagaggtagaggtgggaagattgcttaagcccaagggttcaagaccagcctgggcaacatggtgagaccccgtctctgcaaaaattaaaagaaaaaagtagctgggcatggtggcgtgtgcctgtggtcccacctacacgggaggctgaggcaggaggattggttgaggccaggaggaggtcagggctgcagtgagctgtgttcctgccactgtactccagcctggatgacagactgagaccctgtctcaaaaaaacccacaaaaccaactgttcttttttctttgctttctcatatgatgtatactttttttgaaattcaaattgtttactttgttttttgatttaagtgatgatttactggaggattcagacagtgaagagcattccagatcagattctgtgacaggtatgtaaaaagtattagataatgtatttaaaaaattctttacacagttgtgcatacagctaactaccacttaattctgaatttcttagttaatgctaactctaaatttttgctagtatacacagaagactgaaatattgtgtgtcagagatctcaaattagtagtatgtacatagtgttccatatttaaaatttaaatggtacctatttgagccaaaggaattacagtggatagttacgttaaagttttgtcacatatgtcaggtaattaaatgtttttatttgtataatgtattctgttaactaaaagtagtgtttaaagctctttattcatgtaggtgaataaagaactacattttaatgtgtgaaattatagacattaaaacatcaagtaaatgctgccttactagcttttaagatactagggcaaaataatatacttcgtattttaatgttattttgtaggaaaagctaata

SEQ ID NO: 93568 - DNA, 2108 bp, Homo sapiens
ggtggctcacgcctgtaatcccagcactttgggaggctgaggtgggtggatcacctgaggtcaggagtttgagaccatcctggacaacatggtgaaacccaggctctactaaaaatagaaaaattagctgggtgtggtggcgtgagcttgtaatcccagctacttgggaggctgaggcactagaatcacttgaacctgggattcagaggttgtggtgagccgaaattgcaccactgcactctagcctgtgtgacagagcaagaatttgtctcaaaaataaataaataaataaataaataattttacttgtgtattcataatgtgctgactggatgagtagaaacatatctaatgaatattgttcctttttaaagggcatacatcacagaaggaagccatggaagtaagccttgatataacagcactcagcattctccaacagccagaaaaacttcagtgggagattgttgcaaatgtgcttgaagatactgttaaggatcttgaagaacttggggcaaatccttgtttaacaaactctaagagtgaaaagacaaaggaaaagcaccaggagcaacacaacattccttttccatgtttattagctggaggtttattaacatataaatctcctgctacctcacccattagtagtaattctcacaggtcactggatggtttaagcagaactcagggtgaaagtatatcagaacaagggtcaactgacaatgaatcctgcactaattcagaactaaattctcctctggtaaggaggactttaccggttttgcttctttatagcatcaaggaatctgatgagaaagcaggaaagatcttttcacagatgaacaatattatgagtaaaagtttgcatgatgatggttttactgttccacagattattgaaatggagctggatagtcaggagcagttgttattgcaggatcctcctgtgacttacattcagcaatttgcagatgcagcagccaaccttacctctccggattctgagaagtggaactctgtgtttcccaagcctgggactttggttcagtgcttgaggctgccaaagtttgcagaggaggagaatctttgtatagactcaataactccttgtgctgacggaattcatttgttggtaggactgcggacatgccctgttgaatccttgagtgcaataaatcaagtagaggccttgaataatttaaataaattaaactctgcactatgtaatagacggaaaggtgagctggaatcaaatcttgctgtagtgaatggtgcaaatattagtgtaatccaacatgaatcaccagcagatgtacagactcctttaataattcagcctgagcagaggaatgttagtggtggatatttagtgctttataaaatgaattatgccactcggatagtgactttagaagaggagccaataaaaatacaacatatcaaagatccccaggacacaattacctcgctcattttgcttccacccgatatattggataatcgagaggatgactgtgaggaacctattgaggacatgcagttaacctcaaagaatggttttgagagagaaaaaacgtctgacatttctactcttggacacctggtaataaccactcagggaggatatgtaaaaatactagatctttcaaactttgaaattttggccaaagtggagcctcccaaaaaggagggcactgaggaacaggacacatttgtttctgtgatttactgttctggcacagacaggctgtgtgcatgcaccaaaggtaagttgtctgattatgctataaatcttataaaatccatgtatatatggcatttgtttatgtgcaaacctagtatgaattttaggttcaaatagatggggaggaattaatttttttgtaatgaagtggtaaatccttctttttaaactgttcttaaaacttttttctactgccctaggtaaggattctaactgtaaataagttagtaagtcacttagcaagtatcttctgctttaacctcaagaaaatcacgtgcttttatttcagtgagtccctgactctgcatctgctcaaatttatgaccttgggcaagttatgttaaattcattaaacctgttt

SEQ ID NO: 93569 - DNA, 1045 bp, Homo sapiens
tctccctaccttttgccaggtggttgttgctttgtttgttttgtgaaaacaaacaaactgttgaatctgtgaaatctgaatctgtaaaatctcttctgtattgtgcagctgctgatttctgtcatttattctgcctagttttaatttttaagacttgtttcttattttgtttcttttggggcagcagagcttagtattcagccaaagattgataggtttggtgtccaaatacctttagccagtaaggctgtgctcaagtgtgccctggcttttattttctgttgtgctttctcaggtctcttttgcataggcatagaggcttagttgactgaggatgtaataatggcttcggctccctctggtctttgctggacacgtgcacagcctctgatcaaggtgggatttgtggagagtttaccaggccccctgtgcttctctcactacatgtaattctgtgttaaatccctggtgtttccagtgctttgcttgccccacacagaattgtgacctcaagtagcagatctccttgtttgtttcccattgaaatcacctgtttaaactggacgctctccatcaatcaagtcccatctggagatagcagtgaatgtgctggttttcactgcttacctcaccctcgttaaattacagttttgtctagctttatagttgcctttcaggaaggggatttatcatcttccttcttctgctatgctggaagtgaatctccaaattagaatgttagaatatactattacccattaatttttttgtcttaattaaagctaaatttgctgtcagtttttttcctgtgacagagattttaaactagaaatttgagttgccttcatttcattgtgaatgctttaaaaaataagagtatttgttaagttttgttattgttgagattaagagatctggctgtggattccagtatagctagtgcctcatctgtaaaatggccacagtaatagttctaccacaagggtttttggtaaaaagtaaatgaattaattaaagcacttaaaatactgtctcataaaagtaa

SEQ ID NO: 93570 - DNA, 1906 bp, Homo sapiens
atgctactccctgccaaaaaatcattatttgccttgtagacttttatgaaatcatagtagcctgcttctcaatctccagttacttgagttaaccaaggtgtcttggttaagtatacaacttggtataaaaagctaaaatactgaatattctcatattttataggttattggttgaatggagaagattttttataaagtacagaaaaatgctttttagtagaggaaagatgaattttgtaatgaagaaataaataatggaaagaaagaagattgacatgctgttaatatttacaaactaagcagatttaaaagggtctagactttgagaaaaagatgtaatttgaattaaacttgtaataattttatagaacttgctgtcatttttttattgtgaaaatactctaaacctaccagattttatattttagtattttattaattttttaaaatgggaacaatggcttagcattttttaatgttatacatttcactgatgtgaatacatgtatagcatttgtaaagaagcctaattagtatgaagcacgttattactcttataatactagcatgtatgcaagattttcttaactgccacagaaatagaaaaaacaatttaatttttcagtttgtaagtatttctttaccacatagcttttgactgttttagtgttttattcatatgttatgtacttgcttgatgtctagcattttattttttaaaaaatagggtctaaaagttaattattggtctgatgtacattggcttgcactttagtaccactgcttttcttgccatccttattagggctaaagttcagtaagcccttttctaacaggttgggtttgggtttcttcaatagcgagtattgtctctaattttaaatatttaagttagaattttcttctttgctattttttagccagagttagttatcttagttatatatagatacctgagcccactttattaactttcagaatatttggcaagtgttgcaatagaaaacctacccatgaattaaaacttcacttcattgtcttctttttttttttttttttttttccacacctatttcaaatactgctctcactaatgttaaggagttgatttattggtggaccagccattcacccttgaaatcttgacatccctagtggagctaacccgctttgagactttgactccaaggttttcagcgactgttcctccatgctgggtagaagttcaacaagaacagcagcaaaggaggcatcctcaacatttgcatcagcaacaccatggtgatgctgctcagcatactcgaacttggaaactacagaccgacaggtaaaagatattcccaagataattaattttaagtccatcttgtgtatttgtcagagacaacgtagaattcctaggtatattactgtttatcttttttttttttttttttttttttttttttttgagacagagtctcactctgtcacccaggctggagtgcagtggcgcaatctcggctcactgcaaccactgcctcctgggttcaagtgattctcctgcctcagcctctcaagtagctgggactacaggtgcgcatcaccacgtccggctaatttttgtattttaggtagagatggggtttcactctgttggccatgctggtcccgaactcctgatctcaggtgatccacctacctcggcctcccgaagtgctgggattatgggcatgagccaccatgcctggcctgtttgtgttttaaactgtctaaaagatatacagtaatatacttaggaattctgtgttgtctctaacaaatatataagctaatttttgcatgttgatgactttgttccttctatttgtcatattgcttttggaaattgttatattcttattcttaattttaggataaaataatg

SEQ ID NO: 93571 - DNA, 2279 bp, Homo sapiens
tataatcccagcattttgagaggccaaggcaggaggatcactttagcccaggaatttgagaccagcctgggaagtatagcaagcacatgtctacaaaatttttttaaaaaaattagctgggtgtagtggtgcacacctgtggtgctactcaggtggcagtactcatgaggctgaggcaggaggatcacttgagcccaggatttggaggttacagtgagctatgactgcaccactgcactccagcctaggtgacagagtgagactctgtctgaaataaataaatagtatttgcatggcattcacattgtattaggttttattagtaaactaaagatgattaaaagtatacgggaggatatgaataaggttatatacaaatattatgccattttatataagggactggaacatctgtggattttgacatctgtgggggtcctggaactaatcccccacagatactgagggatggatgactatatgtgtgtctgtatatttatgtgagtctgtgtgtatatggatatgttcatatgtgtgcagtcttttgacagattttgaattaattgggtggaggactcaggatttggtagtttcaaagctctgcaagtgcttgtaccaggcagcctagggtaagaacttttagtttagttgccagcagattgtttctttaggcaaatattttattaccgttaaaagagagaagaatgtataaaacaattgaatcaaaattttcctccaatcattttatagcatctgtgatgaaaatcacagaagttcccaagttaacaggaaattttagatttttcaggcacataaatcattgatattaaagaaaattaagtttactaatatttttatcctctagaaacagcagtagataggcagatcacctttcctttgtctccagctcttaacattgaagtggaacaaaatgggaaaccgtccctggttgatttgaatgaagaaatgcagcacatggatgtagaggaatcacagtgtgagttaaattatagagctgttgtccatgacagtaaaaggagtagtgatctgaatgcaacatgtcgggcaagatttccttatggcttgcaaaaacttggtttcaagaacacaattaaaaaataacctataattctgctttggcaatatgctttaactttcagctcatcttttgtgaccacagctgcgctaatgcattcttggtttttaataccttgggatttgaaatcaagtcgtggtttataatttttttgaaaataaaggtgaactgtaaaataatatgggaatggaaagcaacataacaaataattgattatagttccttagcatgacaattcttattttaacacattctaagtatgatattttgtgtggtggtattatatgtaaatgggatgatatttgcttattaaatattacattttaaatgaatgaatttaaaagaaaaatatgtatttttctttttaggtcttagattatgtccatttttggaggatcataaagaagacattctatgtgggccagtatggcttgctagtggccttgatctatcagggcatgctggaatgttgacgttaacaagccccaaacttgttaaaggtgaagtaatacattttacaaaagcagaattaataataccacagttgtaaaaaagacgaaaaaaaactgatctcaaaaaaaataagattgttttctttgggactttcgttcgaaatttcatcagttttctggtagctgaggtcatttcctgtcataaagtaactaactgtatggttatctgatcctactttttgtgtcttaagaggtctcagtgctttttgaaaaaacgttgaagaaatgactacaggatgacttagtgtgacataacagagctcttttgagtaagcagacataatgttctgccatttttacccttcccatcacatcagagtcccgtctcttcagagttttattatatattattacagtatcttcccttaaaagaggtattttgtttgtttgtttttgtttttttgagacagtctcattctgtcacccaggctggagtgtagtggcgctatctttgctcactgaaacctccgcctcctaggttcaagtgattctcttgcctcagcctcccaagtagcagggattacgcccagataatttttgtagttttagtagagatggggtttcaccatgttggccaagctggtctggaactcctgacctcaaatcatctgcccaccttggcctcccaaagtgttgggattacaggcgtcagcaccgcacctggccaagag

SEQ ID NO: 93572 - DNA, 1011 bp, Homo sapiens
cttcattggtttatctctagtgtccgcacagtgcttgttgtatagcaggaatggatgatagttattaatttgacacgtactcgtcaggcaagggagcatgtatctatagtcctagctactcaagacgtgggggtaggaggatcacttgaacccaggagtttgagtccagcctggacaacagagggacacccaatctctggagaaaaaaaacaaaacaaaaagaaattatacacattccatgttacattacaacacattattgtaaatgttattaaaaaattttctacaaatgaaatacttgacatatagctattgattgtttttaaatgtacttgagatgttcatgaattaaaattaaacattgcctttccagccaggttgtgatagctttagttgttctgttttgtttggtaatgtgtttatattttctttttttgtagagtgcaacgatgtgccatgttacagttttcagaatttcatgagaagcttgttaatactctttgcagaaaaacagatgatggccagatcacagaacatgcccagagccttgtgttggatactctctgttggttagctggagttcattcaaatggacccggaaggttaataattaaaattttgcttaccactgttgattgccttttagatgttatgattgaaagttcaggatgagtctaaatgtctgctattgttttgcagctcaaaggaaggaaatgagaacctactttcaaaaacacgaaaatttctgtcagacatcgtacgtgtttgcttctttgaggcaggacgaagtatagcccataagtgtgcccgatttctagccttgtgcattaggttggtatgtttttaagttgaaagcatactttctaggtacacctgcaatttagtgggtgataccttgtttatagtgtgatttgatccttgtttaatgtatgtataatttaagagaatttcaaaagttgatgaagattgttgataatcttagcaagaattttgggttcttaggggaaagtg

SEQ ID NO: 93573 - DNA, 1860 bp, Homo sapiens
accctggtttgatcattgtgcattgcatccatatttcaaaacatcacatataccccctatatatgtgcaattattatgtatcaaaaaagaatgaaggtagttatcaagtaggaattcataaagcagttctctaaaatagcacatatataaggtaatgaagatttttaaagattcttactgtttttgctagtacatggtgttactatgaagggctactaacttggccttttaagccaaattttatttattgatagacatttttcacaatctgttttattaaaaaacaaaccattcaggctgggcacagtggctcacacttgtaatcccagcacttcgggaggccatggagggaggattgcttgaggccaggagtttaaaaaaacaacccattcaacaagttacctcagtgagttatatatttcataaagatttcatctttgtgttaaacaaaaaaaatgcttgtttagagttgttgaaaagttatatcattttcttaatttaggtaaagcgtgtttatatttacattgaacatattttggctacaaccattaactctatggaatagaacattttgactcagttgctcattacgatagtctctaatgtttaaaagcttcttaaggatagttttaaagttgggacgcttaagttttggcatgtatgtagcagttaataaaagtaaaaatacactgtcatgataatcttttaagcaatgtcgatctgtacctaacgcattatagaataattttattccccattcattcactaaaatgggctgtttgaagctcactgccatccactattttttaaagtttagtacagagaaacagtatgttggtaaggatgatttgaaggaccttcagtctcctcactttttcagctatttcgaagtgtccctcagaggcatctcacattattatacacctaaataaatacacattattatacacctaaatgactttataaaactctccagaaatatttgaaattcttagtgtaagactgtgcctcagtgtgttgtttatattttaagtgtcctctttgatccctccaaggagttatctttgtaaattgcctataagattgtctttccagaaaagggagtatctttctagcaaaaggaagtattctgataaataggtaatcttaaattctcattgttagaggaaaaggaggaaaaagaaacatttattttgtttttattgtttccaggttctgtctattggtattttgtcttactgaattatgtgaaagatgaagatctggctggatgcagtacagcttgtgcatctttgcttactgcagtgtccagacagttacaggacaggctaacaccaatggaggctttacttcagacaaggtattttagtatatctaatgactaataataggcgtctctgagtatgatcacgcttttgcagagaactgttatttaatatatatatgctgataacagtctttttcttacaaaaatgtttagtttataccttactttttccatacgataatagcctgaggttttactttcttctgttttgtcagaaattactcttttttttttttatcgagatggagttttgttcttgttgcccaggctggagtgcaatggtgtgatctcagctcaccacaacctccatctcccgggttcaagcgattctcctgcctcagcctcccgagtagctgggattacaggcatgcaccacaggcctggctaattttgtatgtttagtagagacggggtttcttcatgttggtcaggctgttcgcaaactcccaacctcagttgatccgcccgcctcagcctcccaaagtgctgggattacaggcatgagccaccgtgcccggccagaaattactctt

SEQ ID NO: 93574 - DNA, 1050 bp, Homo sapiens
tgggaggtggttgtagcgagccgagatcacgccactgcactccagccttggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaccgaaaaccagtcaggcgtggcgacgcgcgcctgcaatggcaggcactcggcaggctgaggcaggagaatcaggcagggaggttgcagtgagccgagatcgcagcagtacagtccagcttcggctcggcatcagagggagaccgtggaaggggaccgtggagaggggagaggggagaggggagaggggagagggagagccctctgcgctgttagtcagactgcttttaaaactaagtaaaggtaatttgttaattagatggctgaaaggaaaattgttagtgcattattttatttttcagatatggattatatagctcaccatttgatccagtcctctttgatttggagatgagtggctcttcttgtaaaaatgtttataacagcagcattggtgtccagtcagatgaaattgatttatcagatgtcctttcaggtagtgatttcttttattaaaggaaattctgaatgttgtatcttggatttaagttgccatttgacttaatagattatagtcatgatgttttgtctttagaaaactaaaattccttagaacttatcatatgaattattaaaatgtttcctagaagttcttaacttcctctttccctctgaagaaaatcccagtatattaaagtcatatttgaaagggttgtgactttaattttttgtttttgttatgcatttcatttcagtgtgattttaatgcttatgagactatttaaaatgtatttgttgtagccttttcagttttatttgatgtatctttgctgcctctataaagttaaaaaagatttcctatttcaaaaatacaaaattagtaatatatacttactgtaataaggatgcacaaacaaaagata

SEQ ID NO: 93575 - DNA, 1870 bp, Homo sapiens
ccagtgagttccttcggggttactcctgcagtaggtggactatcatctgggacagttggggaagcctcgacagccctgagttcagcagcccaggtagctttgcagtctctctctcatgcaatggcttcagccgagcaacagctacaggtgctgcaagagaaacagcagcagcttttgaagcttcagcaacaggttggagactatttggctctttgttcatgctgtctctaaacttcaaaagctgaaaaagtactttaaaaatgaccattattttcataaagaaacgtaggttgactgatctgagctaatcagtttcaacaaaaattgaggtaaagtctttgtgatatttaaattggttaaaattgtatgaatacatcttatttgatacatatttgagggaatatgattgatattttttgtgcaatcttgaagtaaatccattctctacacactcgatcaaagaatatgtacagttactagttactatttatatggagtatagttcctaaaacaaaattttatagaacagttaaatttaatgtgacttaaaattcactaataatgacagatgcttcataaattttattgtggcctaaattaggggtctccagtccctgggccatggaccagtaccaataaatagcctttcaggaactgggctgcacagcaagatgtgagcggtgggcaagcaagcaccacctgagctccatctccttttagatcagcaggggcatttgattctcataggagcatgaacattattgtgaactgtgcatgtgagggatctaggttgcatgttccttatgagagtctaatgcctgatgatctgaggtggaacagtttcatcccgaaaccagtcccctgcgcctctgccacatctccccgcatccgtggcaaaagtgtcttccatgaaactggtccctggtgtcaaaaaggttgaggaccgctggtttaaatgaaatctttggcaattccaggtgacaaattgtattacattagtcaacatgagaattcaactccttataatattttgttttgagcagatattccttatttacattaattgttctgcttccttttcaccactaccttgaaagagtcctagttcccaaatgcacaggaaattttgtgttaaacatttaaagtgtatatagcaaagcaatgatccatttatatcgagtccagttttgatttaatttcatctttaagtatgatcaatttaatcatgtttatcttcataatatatgtccatgtggtattctgccacaatttaggtaggcaggattagtctatatatgttgcttttacttcttttgcagaaagcaaagctggaagccaagttacatcagacaacagctgcagcagctgcagcagcatcagcagtaggtcctgttcacaactctgtgccttccaacccagtggctgcccctggattcttcattcatccatctgatgttattccacccactccaaaaacaacacctctttttatgactccaccactcactccacccaatgaagcagtttccgttgtgattaatgccgaacttgcacagcttttcccaggctcagtcattgatcccccagcagtcaatcttgctgcacataacaaaaattccaacaagtccagaatggtaaattatgttttaaataggtgttggcttagacatttaaaaatatcttgaaatatactctaactttagaaggcaaaatttttaataccaactagatgtatcaagttattttcttttataaaatattacagtacatacattaagagaagaaacttattaatttgctattatggttagtagtttttatagaactatagtaatatcaatataaagttagattttttttttttccctgc

SEQ ID NO: 93576 - DNA, 1061 bp, Homo sapiens
ttatactagaaattacactcaaaatattcctaaaactagccttcttatagtagaactctttcttgagaagagcaaacagaactactgcttactgtaataactggataagaataataacatatcctaggctctgaatagtttgaatgttacctgagtttgtcttctgcttatatgctacagaactgacattgggatagatgctttcaatcacaacatatttgtgaataaactctaggcaacttttctcttaaaacagttggttttaactaccaccaacatttttgtgctttagcagcagtagaattcaacaaaatcctcagggaaataacatggttatagtatacactgtagcatgtatcattatatgaagaattaaatagtatttgcgttcttgcaatgtggttgtttcctctttgtaagagggagtttgaaagctaaaataaaagtcttacagtattttctgcccaactaatcattcattggtaacaacattagtgttgatgacatttagagtggaaatttgttattctgaagtcttatgggagatgagcagttgtttacactgtagtttgtttttttatacatagcaatgactgtagtacataagcctcctgaggaggataactatgttctttctttttttttaataatttttcttgttagggaagtattagtaactgccttgttttcttttaaactagctctgtcgagaatagcactattcctagaagtttaatttagttgttttccttcactataaaatgtagctggtaagattactagctgacccaccccaaaacaataaggaagaaaaagaattatgacattattaatgatctgccttctgttttttaattgaacttattcttgtaatgtgggtgaaatgagggatgtaaatctgctttttctttacctatctcatctggcattgagctgaagagactgggatatgtctatactgggaaaaagcattgtttgagatccattagaggaccttcccaaggcctttttcagtggtattttgattatatatgattgtagtcctgctttcactttggatc

SEQ ID NO: 93577 - DNA, 1021 bp, Homo sapiens
aaaaaaaaaaaagaggggtttcgctgtattgcccagtgtggagtatagtggctattcacaggtgcagtagcagtctagtgtattgcagcctggagctcctcggctcaagcaattctcctgtctcaggtcccccagtagctgggactagaggcacttgccactgtgcccagctactcttaattttctacttacgtcttggggttcaaaactaacacagactgggatttcagaaaatttttgaatcaattgacaaggccatttttacatatttacttttcctcttatttatagtttagtgagttgctttcatattttaagatgagtgctccaaattatttttgagtgtatcatttggttaattgatatatttttggtcaactgtttcttctttctctcataggagcaagaagatttgtgaccttggattttgggaggcctatattgttgactgatgtattgattcccacttgtggagacttggcctctttgtcaattgacatttggacattaggagaagaggtggatggaaggcggttggtagtggcaactgatataagcactcattcactaattcttcatgacttaataccacctcccgtgtgcagattcatgaaggtaaagaactttaagaaagtaaattgatacgctttctatgtttctgacaagttatgaaaaatgaatatataattaaaaaatataactatctttttaaatacattgctcagatttttattgtggcagatgtgtatatatgtatatttataatttttcatttcagatcactgttattggacgttacgggagtacaaatgccagagccaaaatcccattaggattttactatggtcatacctacatcttgccttgggaaagtgaactgaagttaatgcatgatcctctaaagggagagggagaatctgcaaaccagccagaaattgaccagcatttagcaatgatggttgctttgcaggaggatatacagtgcaggttagtacagagtgcaaattttaatgttattgaa

SEQ ID NO: 93578 - DNA, 3630 bp, Homo sapiens
attagtacctatcaagtgggtaattctttttaatggttgtatgttaacaggtttaagagatttaattcttagtatttgtacatgtacataaagaggacattacaagaattattttgttcaatctttttttactttaggtataacttggcttgtcatcgtctggaaacccttttgcaaagtattgatcttcctcctctaaacagtgctaacaatgcacagtactttttacgaaaaccagataaggcagttgaggaagacagtagggttttttctgcttatcaagattgtattcagctacagcttcaactaaatttggctcataatgcagtgcagaggctcaaagtggcgctaggtgcaagccggaagatgttgagtgaaacatcaaatccagaagatttaattcagacatcttccacagagcagttacgtactatcatcagatatttactggacactttgctcagcctgcttcatgcttctaatggtttgtatttggcttacatattttaaaggctgggaatatacttgatgtgatttcgctgcatgttttaggatctgtgtcaatattttctattgtaaattttggtattttaaaaaatgtcagtatttatgaaatgtctctttaggttaatctatttctccctgttattttaaacatttcttaaatgaagttgtgtgtgttttttttgggtttctggtattgacatgcacatcattgtgctactggcaaagtattaagtattgcattgaagttgaacagtgaaacttttcataaattgctaacctaatatagagctatcattttctagccaggaggtatttttgatcattacacgagctcacacattcactgacacagccatctgacacatccagctccataggcaagaaatgtaatttacttaagtgctaaatattttcgtctccaagtatgtaacagatttctacatacaaggagtaaatacattgcagaataaatagaatataattatctactgattactagaaaagaggaaagtgtatttaggcatgcgtattttaatattatacaatacatttaaataggaaagtttactgttttctttcttgtaataggacactctgttcctgcagttttgcagagcacatttcatgcccaggcctgtgaagagctctttaaacacttgtgcatcagtggaaccccaaagatacggttacatactggtcttcttcttgttcaactgtgtggtggtgaaaggtggtggggtcaatttctttctaatgtccttcaggaattgtacaattcggaacagcttctcatctttccacaggataggtaggtcagaaaatgttggaggtatttgttattaatgatgtgtacttttcacagttactggttagcttttgaaatctttgaaatgtggatactaagttgtgaatatgaagcagatctcagagtttgtgaaatgaccagtgaagggcaccagcactgtgtatcgaagaagataataagtgataattagagtctactctttagttttctaattgaacttgtggacttcatagatctgtgtttataagtatttctattagattatgttgctttatatgctaaatgtgtttgtttgtggctaataaaattctctcattcactaagtgcttgatttcttgttaataacattagaaaatgtaaccagtagttagaaaaaaaactaattttagcttcatacctccagatacaaatcttgctttcccagtctgaaatatggtatgttttaagaaagcaaatattctatcattactctgttaaatttctatgtaaattattttaaaaattgaacaatcgaattgattcttattcttttcttttttgtttgttttgtttttagggtcttcatgttactttcctgcattggtcaaagatcacttagtaatagtggagtattagaaagcttacttaatctcttggataatttattgtcacctcttcagccacagttacccatgcataggaggacagaaggtattaagagaaagcagtgttctttagtaaaaacaatattcctgcaaatatttcttttataaaatatcttctctgaaatactttaataattatttgcagcacatttaatatttttatgatgtaagcttttaagaatgagcaaccctcatgtgattgactgccatatagttaatacttttaaaatttattccttttcattatttgaacttagtatagtatgtttttcctgtactattataactaaagtcaaactcccttacataagtttgagctgtaaggcacagttgttgttcccatcaacaataatgagttttgtttgaacacacttttttataggaataaaaacattagaacctagtttagtgctatatgaattataagttgagagttagatgttttatttcagttcctgtgaatctaagaatagtatcttataccttgctttctagtttatatagtccattttggattcagcctgcacttaatctgttcttataccttgaagtctttgtctttcattagatttgatgttctactcagtttctggctgttggtgtctattttttagacttattacatataaatattagtgttagtaatgataagatatgttttggatttatagaatgttttgtttcacttatattatcagatctaattaggaatcctaaagtcatctggatgtttttcctttgctgtcatctctctccaggagtactagatattcccatgatcagttgggttgttatgctggtgtccaggttgctggattatgtggcaactgttgaagatgaagcagcagctgcaaagaaacctttgaatggtaaagacagggagaggtttctgacaggtatcagaagtttataataatatgttggtggggattttgagtgacttcgcagttgttccagaactggctattggcctggagctaccagctgtatgtaatttaaggaaaatacaaatgaacttcactacaattctgtttaaagataacatttatacttggtggactttatagacaagctcctttgtctggacatgacttttagtttctaaatgcagctatgacttttgcaaggtgtcttccctcaggcttgtttaaagactttataatagcatgcatgtaagttagttatgaaagggaaatcagagtttttattttttcttagtatgatgtgtcatttcatttagcattattggtatctactaattaactacaaatggcctgtatttttaaatacagaaattctcagattttgagttgtaagctttctttataggttcaaagcacagaaaaatttaaaaattaaaggaaatcaacctgcaacattattttattaccctcttcccagttaacaaggctttttatttttctttatttttatttttcctcagagattcttgttctgaaaataagggtttttaaataaaggatttgagatacctaaatccagtatgtaagccattgagatatgtaagcctacatatgcttacatatggcttacatgtagtatgtaagccattgaaatccataaaatttggaattctgtacattgtcaggaactcagtatttttaagagttcccttgagatgttatagtggaatcagttgtttatagtgcatat

SEQ ID NO: 93579 - DNA, 1030 bp, Homo sapiens
ttatttcttaagctacattgtagcaaaaaactacaatgatctcaatccaaattttaataaaaaatatagacataccaaaatgtgtactactcttgagatttccataaaaacaaagctaagaaatattaagcaataaaatatttttctcatttatttaattaaaagtaaatttttttctctctattaaaaaatatatatcgctcgattatgttagtggcttatataagaaagtcttccagttatttcttactcccatgggtaagggagattttaatgaaaacagggagagatctcaaagtcaggatttgaaatgattttttaaaaaattatcatcacagttaaaattatactacatctttcaagataatgtgcattccattagtttgatgtatgaattctgtgaggagtataataatttttttgtttttaacgttgttaaagattaagttgtttatttgttttataaagcaacttaacctactaaaagcaaagcagaaggcattggtagaacagatggaaaaagaaaaaatacaaagtaacaaaggatcatcatataaactcctggtagaacaagcaaaactaaagcaggccacttcaaaggtatgatctatacttttcaatatagttatctcagaaaagtcaaggagttatgatctttaattacgatcgagaaacttaaatatacattactctgcttaacagagaagccaacctactctggacttttttttggtggggtagtttaactgaaggaaatgtatgataaatgtggtatttaagtattattgtaatgtattaccttcattgtggattgagttccagtaaattgaagataaaggatagtggaatgtatagttttgctaatgtggcattgatagagcagtttatttccattttacaatacaaaattatacaagatgattgcaaatattattgtatcagcctcacaaataaaatgtatatgtaaagtgaaaaatgtggcattctctttacccttagtattgttattggaatattttggtggctgagt

SEQ ID NO: 93580 - DNA, 1133 bp, Homo sapiens
gagggataccgtgtatgtatcaaacaagtttgtagtctttctataacatgaaattatgattattccgccagattttgaagtaactcgaattaatattttgtacttgatgttatattagttttctttaccttcaagcttttacaaattatgtttaggatgttacggtaatatttatgttgttagatttgacttaataacttaatatattatctacattgaatgtctgtagaatttcacttttctgaaactctgttacatatctgatactttactccaaataggaagtaaggtatattggtcagtttagcttttaatattcttacttttgaaacttacagtgtatctaaaaattttgctctttagaagttgtaatatggagtggatattttcattacataaatctatactgaaaaaattttcattaagtaaacattgatttaaacactatacatttttgtgtgcagcactttaaggatttaattcgtttacgtcggacagcagaatggtcccgttctaatttagacacagaagttacaacagcaaaagaaagtcctgagatagaaccacttccatttactctggcccatgagcgttgtatctcagtagtccagaaacttgttctgtttcttctctccatggactttacatgtcatgcagatctcttattgtttgtttgtaaggtatgtaaactataagtgtagacttacagggttggccgggcgcagtggctcatgcctgtaatcccagcactttgggagactgaggtgggtggattatctgagtctaggagttccagactagtgtgggcaatgtggcaaaaccccgtctctacaaaaaaaaaaaaaaaaaagtgacttataggttaattaaaaactagcaaaggatgatgtttttagtcaattttcattaagagaaatgatgcctcttttggttttgcttttttgcagttagtttttttattgtgtcttaaaagatgaaaaaaattcttttcaaatttttccttaaggaaatctgatttatattttaatttatttaaaacttgagggtttgaaatgtaagtaatgtggatatgtttatctccaacctgcctttcttatattaattaaaataggaaatacacaagtaagtgtcaa

SEQ ID NO: 93581 - DNA, 1144 bp, Homo sapiens
aaacccgtccttactaaaaatacaaaaattagctgggtgtggtggcatgcacctgtagtcccagttactcgggaggctgaggcaggagaattgcttgaacctgggggcgatgaggttgcagtgagctgaaatcgcgccacttcacaccagcctggcgacagaccgagactgtctcaaaaaaataaaaaaagaagaaggacttttaatgtcatgattgcttttctgtggcatattcactgttcgtagaaatttaattcttaactatacaattagatcttaaaccagattttaatatttgattcatgaaattacattcttttttgcattccatctcaagcaattttttttgataccagactcatacatcattgttgaaacctattgttcagtgctaaagtattggtagacttctgttagtgtttgaaaaaacatgtaattgctatttaagtgtatgattttataaaatgtattacaggttcttgcacgcattgcaaatgccacgaggccaactattcatctgtgtgagattgtgaacgaaccccagctggaaagactgctgttacttttggttggaactgacttcaatagaggagatatatcttggggtggtgcttgggctcagtattccttaacttgcatgctacaagatattttagcaggtgtgttaggatttttcttcatagagtatgtcaaaattaccttgtcattgctcaactaagaatcttcaaagggatctttaacccctagagggatctttaaccccctaaaagcataaaggtctgtttaatcggtgtgatgttatagcagtagcaaccattgaaaattacttttgtatttaagtatattgatagtcgcgataaatgcaaggctttagaaaggctttgggttgttaaagtgcatgaatattggagctagcctgctttattattaacatcagtggtatgctgcttactgggtggggaaatcactttgcctcattttcttcatatataacataaggataataaggataatctttgtataaggttgtttttatgaataagcgtgttaatgtatgtacagtaattaaaataactctttgtacatgttatgtgtttactggatacttgtctctagcatttgaaagtaatggagtgagtcctag

SEQ ID NO: 93582 - DNA, 1025 bp, Homo sapiens
gcaacgatgaagaaaatgcaatgtagaaaacatgtaaaaatacaaagtgatgaagacagcagttttaaaagctcttattctttaagatccagcatgtgatttttttggtgtatttttttcttactttttctttttttttcctttttaaaaagtatctttataaattagcatgtataatcctttatcatctccataccccttacttttcaaaagtctgttttgggtactaatctgtatatgtcagatgctgcagtcattttcaaccatttgtcattccttaatcttatgtttgctcatgattttctattttttacttgatattctctttatctggagtagatttcctgtgtgcacgatgaacacttcgttatcgaaggttcacataaagcgtgcctttctctaagaggctttttctgtcattcccagcagagttagggactttgccatctgtacttcccttgcgctctcaaatatctctgctagcacatatcatgttgtagtcagttttaattatagtgcacccccacctctgaatttctcttaatttattggattggagagttttattaatcttcatgtacttatactcaaaccctcatacaggctggcatttactaggcattctataaagttatgttgaataagaggataggaatgatggaaaagtaagagttatagaggggtacttataagggttataagaaagctacttaaaaatttggagacatctgagagacaataatttctaattcataacagaaaaataaggtaaatggctttttttttttttttttttttttttttttttttttttgagacggagtcttgctcttgtcacccaggctggagcacaatggcgtgatctcagctcactgcaccctctgcctcctgggttcaagcgattctcctgcttcagcccctggaatagctgggattacaggcggccaccaccacacccagctaatttttgtattttttgtagagacagggttctgccatgttggtcaggctgttctcaaactcct

SEQ ID NO: 93583 - DNA, 1050 bp, Homo sapiens
gaactacatttaagtatacagaagtatagttatagatcaccaacatttcagacagccatctaaacttcatccgagctgtgttcattgcagagtctacttgtatgttagcctacttttttttaaaggagaatcacctgtaataatttatggtggtacagttctttggtccataagagattttattagggatgctactttcagtttctaaacatataaggtatttttagattttggcagaaagtgaggagaaaattactggaccattcttataaatcattaaaattataaggggatttgggaaatttaaagggtggatagaatatttattttgtagttctgtttgggtttagataatgtaaataacgtgtcattcagccaagaggcaaaaataaaccacagttttttttccattcttttaagccaataagcagtacatggtatgattattggggtgctgattatgggacctacaattacaacccttacattggaggtctgggaattcctgtagcaaagccaccagcaaacacggagaagaacggatcacagacagttagcgtttcagtctctcagggtaagtgtatgtttatattttaagacatatgctattcttaaaacaagtctgtcatttatgtatactttgtcccttgagaagttgagcctgggtgtatgccagtgggtttagtatcacagctgtgccgtgagtaccattcagagctgtttctttgtagtcactttagaggaacttctatctttttggttctctgtcagaataacacctagcaagtgttgtatgggattggcaatgattttaatgaactgtgctgtattttaattgttgactttaatagtaaacttgtattttatttataaagagaatgaaactacattaaataagtattatttttgcagtttttttttttttttgagatggagtcttgttctgttgcccaggctggggtgcagtgatgtgatcccatctcaccgcaaccgctgcctcccaggtcgaggggcttctcttgcctcagcctcttgagtagctgggagtat

SEQ ID NO: 93584 - DNA, 1050 bp, Homo sapiens
cgtggtggacagagctagggagtatgtgtttgtgtgtgcgtgtgaacacacacacttggcatctatatttctgtatctgtctatctattctgaatatgatgaattcacatcagtgtatctggatttaatctaactccatagggttcattttagctttcttcttgtctgtatttatagcactttattctgacagtgagaaacctggttctcattatccttaatgtctttgtttccattattgttacttcacttatttaatatttctgtctctatataaccaatcgcctgtctctaccctcctttccacagatattcttcccctgctgtggctccgatactgcatgttaggtggctgttctgtaagaacacactcttcatcctctcttgggttcagatgtcatcattttattgtaggaggtaggacatgagtaataattgtcaatgttttctttttctttcaattgctttttgtagccctggatgctcgcctagaagttggacttgaacagcaagcagaactgatgttgaaaatgatgtctactctggaggcagattccattttacaggcattaacaaatacatctcctacatgtaagtaaaatgaccatttttagagtattgcagtgaatgattcagctcttcatcattttcaggtggattcatcaaggacagatttttaaattccatgatgtgagtctgaggggacttagtatgtagcactttcctggctccgagttagtagcaagttgaaaactaagacaaaggattaacaaatgcagagagtatcatgcaaaatacttccatgtagtgctgtcagttcagtgcagaaacctccattgtgttttgtttactgtattgttgtaaggttaataaaattcctacagaagccttcatacctgcctgtgagttcattgcactattccaaatttatgatgaagtagattttttgtagtaacatctttatcatccttaaagactaggatagagaatatagtgtaggatgacagccaaataggcctgttagttgaaagccagaattgagaggattta

SEQ ID NO: 93585 - DNA, 1776 bp, Homo sapiens
agcctggccaacatggtgaaaaaaatacaaaaattagccggctgtgttgacgcatgcctataataccagtttttccagtatctgttactgttttcagttgccagttttgtagagtgtgaggatttttagtaaattgtattgaagtagaaatgcctatggtttggaaagtacaacatactgagagtgataacatgtcatttcaggtgttgtgggctgagctttaaaccttatcctaaaatgttactgattcttaatgcgttagttgtatttaatggagaattccttttatttgcatgttttgaagacactggttaaggagcggatttaaagaaatagtgtcttgtttttaaatttattcttttgacttagttcttcataaacattgtttttctgaaaaatattttccctttctcttttctgcatagcatcaataactagctttctcacagtgttagcttggtatcccaatactttgctccggacatggtgccttgtgcttcatagcctaacactcatgacaaacatgcagcttaattgtaagttcataaatttattcatttaaatctctgacatatactttagtgttctactattggattcttaaaacagagttttccaaggagtggtatacttgtcaaagtggttgagttggccagatgtggtggctcacgcctgtaaacccagcactttgggaggccagcacgggtggatcacttgaggtcaggagctcgagagcagcctggccaacatggtgaaaccttatctctactaaaaatacaaaagttagtgggcgcctgtagtcccagctacttgggagggtgacgcacgaaaatcacttgaacctggaaggcgaagtttgcagtgagcttagatcacgccactgcacaccagcctaggtgacagagtgagactctgtctccaataaaagtgactgagttttttcttctaacatgtctcttctgaattagttcttatatatcctttgtgcttgtttactttgataatatagtctcatatgtctcgttggatgttcaaatcatattttttaccttttaaaaactgattaaaagaaaattgattgcttttagagtacaaaggcaggtttttacatttcatctaagtttttatgttattcttttaagatacctttgtacttaaaaatgatttattcattattatattcataaacatgcataactagattcctgggttttgtttaataatttaaatcattgcttagctttaaaatgctattatcttttttcatttggaatgtattttccaaaaatgagatcaaaagcatcactgtgatactgaaggtggatttcatgcaaaggatattttattcatctcagaaaactgttgtgttacctgtacgttagttcacagttaacctgtatacaactaacatgcaaaaaggaataattttgctacaacttattttagaaaacttgattaaagtttacctgaaaagtagatctctgactgtttctggaagggggagttagttagaataggctttccaaataagagtcaggacctagttatatcttttctgtttgactgtactaaataagatgtacattaagctcgaggtgttttcagaatcagaagggggcagaagagatagatggtagatagagagggaagtcctgcttagtcaatatagtagaaactgaaacccctttaataaactgtaattactaggaatgtatgaattttccttggaactaaaagatgctttcagatactgcatttccattatttcatggtcca

SEQ ID NO: 93586 - DNA, 1072 bp, Homo sapiens
tttttttgacttggtataaatttatttttatttagtttttgttttgtttttcacttagcttaatgcttgctttgctagttgttagaaacatgaccttttatggatcattttacctctctgctcctgagttatttgattttgaaatggggtaattaagaaggttatttgtgaaaatctatgttgaagttatttatactctaaaaagcattataaaagtatttattgtgtaattcaggtgaactttttttagtattgagttcaataaacctaatatagttgtggtgtataaactataatgaaaaagtattaacagtatttttatttgcaattcaaaataaatacatcaagacctaaaaaattcatttcctgctatcattgttaatacttttgttttcctcgtacgaaaagttacagtgtatagcttttgactttctacttgataatttttaaatgaatgattttttacatgttaccagtaagcagttttcagtgaatatacatttctctttaggttggtcctacagctacacaagctatgcaagaatttcttactcgattacaagtgcatctttcttcaacatgtcctcagatattcagtgaatttttgctcaagctaattcatatactttcaactgaaaggtaaatttttgtgtactaatttgttcctgatatagaagtaacatgtaattctccaaatatacttttctttaacatttgttgggaatttatctgtgaacaaataagcaggaggacggtagtaattaagggggaaggatatattggtgtgtttcctgattgtttccatttcatttcattatggttttctcaagtccttatacctctactctctttaatatgaaaggaatacagttgacttgcttttaatggttttatagattagttattataagctttttaaaaggtgaaatttattttgaagctgtttaaactctaaagctaccagtgattttgtatgtaagaaaacctgaaaaatagagcttataaaagaaaattgtatactaatcttgtgtagaaattctaaataaatttattaacaaaatcagactccatg

SEQ ID NO: 93587 - DNA, 1031 bp, Homo sapiens
ttgtatctctctctctctctctttttctgtctctctctctctctctctgcaggggtgctttccagacaggccaaggacctctcgatgcccaagtgaagctcttagaattcactctggagcagaattttgaagtcgtttcagttagtactatttctgccgtgatagaatcggttacatttttagtgcaccactatatcacttgctcagacaaagtaatgtcaagaagtggatcagatagctccgtgggtgctcgagcatgctttgggggactctttgccaatcttattcgtccgggtgatgcaaaagcagtttgtggcgaaatgacaagagatcaactcatgtttgatttgttaaaacttgttaacattttagtgcagctgcctctttcaggcaatagggaatacagtgcaagagtgtctgtgaccacaaatacaacagatagtgtttcagatgaagaaaaagtctcaggaggcaaagatggcaatggaagcagtaccagtgttcaaggatcgcctgcatatgttgctgacttagtcttagccaaccaacaaattatgagccagattttgtctgctctgggcctgtgtaatagcagtgccatggcaatgataattggtatgtattgagaatattaatcttaccattgtctctgatactataactggtttttttttaagcaatatatggattcattttctttttactttatagtgtaaaactgctttaagcttttcatgactgatttttattggtgaggacttctgtttaggggcttcaattaatgaatgaaagtgaaatattgacaaatgtcatgtcagtttggtttgttttctttttattgagatgcctcccaggttcaagcaattctcgtgcctcagccacccaagtagctgggaccataggtgcctgccaccacacccagctaattttttttttttttttaccccgagccagagtcttgctcccacgctggagtacaatggcgcgatctcggctcactgtaacccccgcctcccagattcgagtgatac

SEQ ID NO: 93588 - DNA, 1559 bp, Homo sapiens
tcctttttgtatttcatttttacaaatgaaattgtaggaaccagattattttactttcttgtccatttcccattttgaaatgcagatattagaacagtttcttatgtcttttatatagcagtgtataattatcatttttgtaaacatttgttgaatgtgtatatttctctattagaaaatacaaaggtactttaaatggttcaaattttaaatgaaattggtgtctaaatgcatattaagagaaaagataataatggatgaagacacatgctttaaaaaattctctgagttcagggagatggtttttttattcaggtaagatttcttatgtattttggcagacattttgtatttagcgtatttaaggctgtcagtttacaaaaattaactaggaaggaatattacatgcattgagtttagttcttattcacaggaatatataaagtcataatatgcatatttcattttttagggctctcttgctacttgccagttatctgagccattattgtggttcattttgagagtattggatactagtgatgccttgaaagcatttcatgatatgggtaagataatatttcaataactatcatttaagtgtagttatgtgatagtatgttacattttcatttttgtagtcttttgtggaagtttacttttgatgttgaaccatctgtcctgagatcgatttcatttcatattctttataaatttaggtggtgttcagctcatatgcaataatatggttactagtacaagggctattgtgaacactgcaagaagtatggtatcaactattatgaaatttcttgactctggtccaaataaagctgttgacagcacattgaaaacaagaatactagcttctgagcctgacaatgctgaagggattcataactttgcacccctcggtaagaaaagtgttactaaatcttacttatgtgaaattatctagtttattagctggtatgaaacaaaattagttgaagtcagttgatgatgttatatatcactattttaattacaaacagtttattttagaggtagtggatatctcgacattctacttatgagagggaatgctttgtttgtttgtttgtttgtttgtttgttttgagacggagttttgctcttattgcccaagcaggagtgcaatggcgtgatctcagctcactgcaacctctgcctcctgggttcaagcgattcctgcctcagcctcccgagtagctgggattacaggcacctgccaccacgcctggctaatttttgtatttttagtggagacagggtttcaccatgttggccaggctggtcttgaatgcctgacctccagtgatccacctgcctcggcctcccaaagtgctgggattacaggcatgagccaccatgcctggccgagagggaatgttttaacagttctttagcagtaaagtttgtttttatttgtgagtctaaatagaagcacaatttaagaaactaaacagagattcttccgtaagttttctctttaaatgttaatcaattttaaatctcattttccttcttaaagtggtgct

SEQ ID NO: 93589 - DNA, 1111 bp, Homo sapiens
tacctgccttggcctcctaaagtgctgagattacaggtgtgactactgcacccagcccattttgtgttttatatggttcacaaatgctttcaatatagttataattttgccagaattgtttaaattaatacacatgcttacatttattgattgattctcattgctatcaaatatcactcaataattgcatgaggagctgtgggaaatgttgtagattcctggcatctttggagaaaacaatttttttctatgtgtttgcaagattagactgatatagcttaattacttgtggcatccacactccttagataaaaaacagataatataaaggtagaaggaaaatatgctagtacacggtgttttaggaggtcaaaaataactatattaaaaggcaaatataagtcaatgtaagacttaggctacctctaaaattggaaagagattgcttttatttggaaagcaaaggagtttggtcataagtggtggcttttgaagttcagctggatttttcatatgggaattgaaacaggaagcatattatgaagggggaacccctgtgaaaaattaattggtttaggtgttccctacttaagtgtacttgattacaaaatttggttttattattggattagagcagaagttgaaaatatgttgtgatacagtggaaataacagtctttagaatcaaacatggacttgaatctaaggtgtgacatttcttgtgggagcgtggattacttaatctctttttgctatgtctgcttgtgtaaaatgtagataatactttcctcaaaaggttttgaagtagaaatttaaaaattaacttgactgtctagtaatcagtgtaaagctggcatgtaattccttctttttttaccactgaaattaaaaataaaaccaaatttcaaaagttttagttgacatatttattagatggggttccatgttaagctagaaataaataattttctggtagttcattggggactccttaaatttcagcaagaattgattttttaaaaaaaatcctgtggatatttggtttaatttgaaaaggaggctgggcgcagtgggtcacacctgtaatcccagcactttgggaggctgcggca

SEQ ID NO: 93590 - DNA, 1019 bp, Homo sapiens
ccaaattatttaaaatagtaaaccatagcatattaatcaaaggtagttttgtattatttgtgataattttgagtaaaatagaaatgatgacataattacctatttggctggttttattcatagggagcatcaggtacatgtgcatcacacatctttggttcctctttttttaggtgaatattagactgtttaagtataatttttattgtagatcaaatattttgtgttgaaaaatagctccaacattaattatggtgaaagtcattgtcaaactatattttgttgtataagttttccttttacaagttcatgatgaatacaactgtgaaagctgctattttactgggattttaataaactgttcaatctagtatactttgtcttttgtgatgattcagttttctctttttatagcctgcccttcctcagtgtctgttgaagtaagtgcagatggggtaaatatgctacctttgtccactcctgttgtcacaagtggcctcacctacataaaaattcagcttgtaaaagccgaagtagcttctgctgtctgccttagactacatcgtccacgggatgccagcacattaggcctttcacaaattaaattattggggctcactgcttttggtaccacctcttctgcaacagttaataatccattccttccatctgaagatcaggtatccaaaacaaggtatgttttgtttgtcctttttttttttttttttttttttttttggcatggttgggagataggggacttaattattttgtgggttttttcttttttaggtcttaggaaggtctttgttccataggtatctgtataatacaattttattaggtgtaatagagacagttttgtggaaacagaatgctgacactgattaaaattaaggtgtatatatgtttagtctttgagatgatctgtatgctacatgtaggtgtacattgtaattttctggcttgtaattttttgtatcatactctgtttcgggaatttgcaaatgcctatgacc

SEQ ID NO: 93591 - DNA, 1800 bp, Homo sapiens
ctcactgcaacttctgcctcccgagttcaaatgattctcctgccccaccttcccaagtagctgggattacaggcgcccaccaccatgcccaactaatctttgtatttttagtagataaggggtttcaccaagttggccaggatggtctcgaactcctgaccttgtcatccacctgcctcggcctcccaaagtgctgagattacaggtgttagccaccgtgcctggccatgatttatcttataggggaaacttactgtctgtttacttaatttgcagcattctaaaaaaacatgtcttagattggttaatgctgtttatgaaacacaacatgctgatctttaaaaagttatgttctaccccgaagtgatttgagcgacttatattgatcatacaagtcattttgtattttcagtattggatggttacggttattacatcattgccttactcacataagtgatctagaaggaatgatggcaagtgcagctgcacctactgctaatctgctgcagacttgtgcggccttattgatgtcaccttactgtggaatgcattcacccaacatcgaggttgtgcttgtaaagataggactgcagtctactagaattggcctgaagctcatagacattctcctgagaaattgtgcagcatcaggcagtgatcctacaggtgataattaactttgatatttaaatgtttacatatctgtaaagtaacagcagttgaactgtgcgatcttcgtgcttaactctgttttgggaattattttttcttttagtttatgtttatctctcctctcttctctgatggagtctcactctgttgcccaggctggagtgcagtggcgcaatcttggctcactacaacctccacctccctagtagctgggattacaggcatctgccaccacacccggctaatttttgtatttttagtagagatggggtttctccatattgatcaggctggttttgaactcctgacctcaggtgatccacccaccttggcctcccagagtgctgggattacacgtgtgaaccactgcacccagcctagtttcattatttttagagtttgttctgtgttgttggaatttatggaagcctcatttttaatgaataacttaattcaattaagtaaatcttcccatggttaacttgcttatttagcaaactttttctttggattctttgttgcaagatttgaatagtcctttactttttggaagactaaatggactctcttctgactctacgatagatattctttaccagcttggaacaactcaggatcctggtacaaaagacaggtacgattttatttttcatttaattaagcacacacatgcacataatcatgctatagtaaatgtttctgacagtttttccttagatgatctcataaaagacaatactgtgatatattgtatgtttaccatatgcctcacacgatgtaacttctgcaagtattcatgaacattagacatacatttgtatgtgtttggacatactttaagcaaatttgaacttaaatagaattctttgttaatactgcttttgaggaatggaataaaacatatatttttaagttggctacgtgtgaaaggaaccttgtaaagtgatggtatcagagtcatactgtcttaggtagtactttatatgtgtatatgaatgtagggatattgtgtctgtagttggtacttcaactgtttttataatggttctgtttatttattattgattatcgtattcatcgaaatcttttcatgactttctgcaccctttcctgctgtttacagaa

SEQ ID NO: 93592 - DNA, 1276 bp, Homo sapiens
cacagaatgatagaaccattttaaaataatttacttgattttctgtactcattgacaagtctaactcaacttgcattgtacctacattcttcaattttaaatatatatatgtgtgtctatatatatatatatgcagtcttaaatcttacaatgttttattattcaatgtcaaataaagtatataatgtcagagtatactttgaactataacagaaatatttgaaatagtttcttctaaaaatatacttgtatcattaatatgatatcttttattttttaggttactttttaattggtccatgtctcttccctgcaatatggttttgaagaaagctgttgacagtctactttgctcaatgtgtcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggctacccttgcttcctcttctcaatctcctgaagctattaaacaattactagactcaggtttgccttctcttcttgtgaggagtctggctagtttctgctttagccacatttctagctcagaaagcattgcccagtcaatagatatttcccaggacaaactcaggcgccatcatgtcccacaacaatgtaataagatgcctatcacagccgacctagttgctcctattcttaggtttttgacagaagttggcaatagccatattatgaaagattggcttggtggttctgaagtcaatccactatggacagcacttctgtttttattgtgtcactctgggtccacttctggaagccataatttaggtgcacaacagaccagtgcaagatcagcttctctttcttcagctgctacaacaggactgactactcaacagcgcacagcaattgagaatgcaactgttgcgttctttctacagtgcatttcatgccatcctaataatcaaaagctgatggcacaggtaagacaaaaaaataacttacattttagttgttttattacataagaaagggccatgtataaaggccaggtaataataaatttagtgagggttgagtgcctttaaggatctgaatttaagctataaagtactgatatctcctttctccccctcaaaatatgctgtcactggaatcacttattctttatgatgagatgactagcagatgcattggg

SEQ ID NO: 93593 - DNA, 1988 bp, Homo sapiens
taacatacctagcatagagcctatatgagatatggtagacactagtaaataacttttctccttgttatttaatagtgctcattcaagtcaaactttagtagtacctagaaaaatagataatataatttttataaaatattgaaggagttagttttattaagaagaagggcaggtcgggtgctgtggcttatacctataatcccagctctttgggaagccaaggcgggtggaacacttgagcttagaagtttgaggccagttttgacaacatggcaaaacctcctgtctaccaaaaaaagaaatcataaccaaaattagccgggcatggtgatacgtgcctttggtctcagctactcaggaggcttgaggtgggaggatcacttgagcctaggaggttgaggctgtagtgagctgagatcacaccactgccctccatcctgggcgacagagcgagaccctgtctcaacaaaaacctaaacaaaacagaggaagaagagaaagatatttaactgcctgtagtaattaattactgggaaaatatctctgctaaatatgcattaaaaggaaatgcttaaattaccaacttcacccgagggcatgattctaggtatttgaaaatttggtttgtgcttctgggtagcatgaactctttgtgtcccattgatttctctcttggtttcttagtaaggctttatatacattttgggggtgaggtggggcaggatctctctctgttgcccaggcctgtagtgcagttgcacaatcagtgagccgtggctcactgaaactttcgggctcaagaagtcctgcctcagcctcccaagtagctgggactactggcacatgccaccatgcccagcttatttttttttggttgggggagtgggtagagacaggtttcaccacgttgcctaggctggtctggaattcctgggctcaaatgatctcttctcttagtttcccaaagttctgagattatcagcatgaccttggccttgttatatatttttaatatgctttttctcataatttttattttaagataaccacaccaatattgactaaagttaacgggagttcgttatgctaggtattcattatgtgcaaaccgtttagtactaattttttctaaccctggacacgtttcttacacttttatctcctttggtattcatatattttaagataaaatcatttctttcctccttaaaaaaaaaaaacttaactactagacccccagagacatttgttctttagctactgatttgatatgttaaaataaacttattcatattttctgtttcctttttatctttcaaaataaaaagctgcatataaatcttgcatttaactttttaaatattttgtcttgccaggttctttgtgaactatttcagacatctcctcaaagagggaaccttccaacatctgggaacatttcagggtttatacgaagattatttttacagttgatgctggaagatgagaaagtgacaatgtttcttcagtctccatgtccagtgagtatttaacacttaatcattggctgtgtatacatgtattttacaattttgtatcagagcctgcagttacctcctatgttctaacttcgagtatagcaaagtgaaactagcacagcctttatacctaatgacagaacttgacaatttcaggatagcgctctccctcatgcctaggaataacataattttaccttagcctgagaagtatagtttgatttgtggaaaaaaatgaaaaaaggtacagagtgataatgcaaaagttgaccaacaaatcatggcaactatgccatatctaaattaattatatcttgtaggatttattgagtattttattcttagatgcttttgagattattttataacaatatgtattccaaaaagttacttcctgatttctttgatttcttgattttcagctgtacaaaggtagaattaatgctactagccacgtcatccagcatccaa

SEQ ID NO: 93594 - DNA, 1627 bp, Homo sapiens
gctatagactgaatcttgagcttgagtcccatatttgccatatacagattatatcagtagcctttctaaggctgtttcttcattttgaaaataacattcatttctatgttgcgaggactgaattagatgcagttgccaagcacattgaactatggctaaaataaagcaagttttcatgctactggtttttcattgtttctggaggtggtaccattaaaatactgtatataatactttacagagattagatcttaaatattctggcttaagtacagtggtgagtcttcctcatcaatgtcagtaaagattgggtatcaggcctttacctcatgccatttctcctaaattcctttatattgccttagtattaaggataatattatcttgcataatctccctctgaaacatatattacttctcttcttaatgatttggaaaagcagtgtattttagataatatcttcttacagatactccaagtatcacagctaaattaattagtgaacaaaaagatgacaaagaaaagaaaaaccatgaagagaaagaaaaagttaaagcggaaaatggatttcaagacaattacagtgttgttgttgcctctggtatgctttctattttttataatcttgattttgtttgggtttctataaaatattagaattttagttacaggaaatttatgtaatacattgtactaatataaaaagctgactcgtaatgatgttttaatactagatttttatctttttatttttattttttttcactttccactaaataggttgtcatctgtatttcagagattatagcagctagctacagtttttactttttaggaaaatagttacagatgcaatgccaaaattatttatttgttgtcatgaaggacgaatagaattgggagattagatattggattagaaggaacatttctgttttctgacattagctaggaatgcatgccttattaaaatattttaggaacactgttttccttcatattagtgtgttgactatgtagaatcttactgatccttttcttttagggctgaagtctcaatctaaacgtgctgtgtcagctacaccacctcgcccaccatccaggagggggaggacaatacctgataaaataggaagtacttcaggagcagaggctgccaacaaaataattactgtcccagtgtttcacctgtttcacaaactcttggcaggtaatattcctcaatgaataaacgtcaaagaaattttagtagccttaaaactatgtaaatcagaggcacagtcaccaaaatcattttaatcaggtgccattgatgagatcagtgagttagtgagacttcttccatacagttcctccgaagagaagtgagagcaaaggaggagtaatctattacgtatcctttttaacactatcaagttatttatttctactttactggttttctaagtttttctgtcagtgtgccatgaaatgattgatgaaatagacatttagagagttcatgacaagttatttaggaaacaccgtggggcaaatttgtaggactagttcaagcagtagaactcttagaccactggtagttaagccatatgttcttcccagataaaacacatttattgagcacca

SEQ ID NO: 93595 - DNA, 1106 bp, Homo sapiens
aatacggtataaaattaccttaaggctatgtatataagggatgtgtgtatgtgtgtatacacacaaaaataaattttgtgtttccacttggatcccctccctaagataactcattgtgtacatgcaaatattagaaaatgcaaaaaaaagaaaaaaaaagaaatctgaaacagttctagtctcaagcattttggatgagggatacccatcctctattttatcaccattttcatgctgtattaaaatgaaattgccaactcagttcaaaggaatttttcttcttagctttacattgttgattcatggtggaggcgaacaaactatcgactggtgggttggataccttggtccagagaggtccttgtgacatatctcatggcccattacctaggtgatgtgagtcttgccttctgcctgcaataaagttttgttggaatgcagctatgcccatttactagtgtattgtccatagctgcttctctgctacaatgtagattagcagttgtaacagagactatatggcccccccaggttaaagtatttattagctgtccttttatagaaaaaaatgtcccacatcagatttatggaaatgtctgttcctttgtttacgttttgcccatgactttttaacactttcacagacattattgttcattattatatgtcagaaataaactcactttttgtaaactttccaatggctgttgaattttttaattgttttgaaattggtttcagaatcaaactcttgcctgtaatttagtaaaagcagataataattaaaccaagtaaatgtttctttctcggtttccagatttaacttagttatatcattttaggccagccattgccagctgaaatgacacttgcccagcttttaactctcctatatgaccgaaaacttcctcagggttaccgctcaatagatctgactgttaaattgggatcaagagttataacagaccccagtctatcaaaaacagattcttataaaagactacaccctgaaaaaggtatgtgcataatactactttaaaaattacagactgtcatacaaagaggcagagatttctatagctaatgacttaattgacttgtgtttt

SEQ ID NO: 93596 - DNA, 1080 bp, Homo sapiens
tatttgtaatttattgtctagatcatggagacttacttgctagctgtccagaagatgaggctctcactccaggtgatgaatgcatggatgggatactggatgaatctttgcttgaaacctgtccaattcagtcaccattacaagtttttgcaggaatgggtggactggctcttattgctgaaagactacccatgctatatccagaagtaattcaacaggtaagataagatttcctaatcgagtatatcattccatagctaagcccttcattctttttaatgtttgttttttaatgtacttggattaactttgtagaaataccctttgctttatattttttgaacattatataactctttcaatggtcagtctgtacagagcttcatgaccttcagtaggtatggaagaaatgttgaagatcaagcacacttgccagacttactacactgttgcatttatcttgatttcatggttgtaacactagcattctcttttctatgctgctttaagtgtgatatttattagagatattattggaaataggagaagtaaaatagcagtgtatactgccaccaatatatgtctttttgtttaccttttattcctgtttcaggtgccatttccatttttggtggtttaaaaacatgacctattcccgtgttcatttacgaagctgtcaatgtctgtgctttccatgctcttgtatcaatcagtaggaagtatggtgcatggagagttgtaaaaacaaaactttgtgtttgttgaatgaagtaggggaattattctctttgatttcatgtcgtgtgtgtgtgtgtgtgtgtgtgtgtgtgtgtgtgtggttattttggtatagtagctctagactctattatagtttcctgagctgctgtaccaaaataccacaaacgggctggcttaaaacaactgaaatttattctcaatagttgaggaggctgtaagtctgaaatcaagatatcagcagggccatgctccctctgaattcaggctgtagggaagactccttccttgcttcttcctggcttctattggttgccagtagttcttgctgttcattggttt

SEQ ID NO: 93597 - DNA, 1732 bp, Homo sapiens
ttggaagcttgtttttatttttatttatttttttgagatagttttgttgcccaggctggagtgcggtggtgtgatcttggctcactgtgccttccacctcctgggttcaagtgtttctcctgcctcagcctcctgagtagctgggactacaggtgtgcaccaccacacctggctaatttctgtatttttagtagagacggtgtttcaccgtgttggccaggctggtctcgagttcctgacctcaagtaatccacctgcctcagcctcccaaagtgctgggataacaggcgtgagccactgcgcccggctggaagcttgttttttaaagcaagcagctttattaatccttataatcctatattttaaagagatcatttaaagttaagtctttactttgaatctgatgttgaaaatgtgaatggccaagccaacacttttctttttctttaggtgagtgctccagttgtaacatctaccactcaggaaaagccgaaggatagcgatcagtttgaatgggtgaccattgaacagtcaggggagttagtttatgaagcaccagaaactgttgcggctgaacctccacctatcaagtcagcagtacagaccatgtctcccatacctgcccattctttggctgcttttggattatttcttcgtcttccgggctatgcggaagtgctactgaaagagagaaaacatgcccagtgccttcttcgattggtattgggagtgacagatgatggagaaggaagtaagtgtttagtattaaatttatcaacacatatgtgaataggttgtgtaaaggtatccagatcattgcctattattcatcatttatttccttcatagttaagctgttagatgatttgtaagtggtagctcacttccagtattagttatacataataaatcctaaagaatcttcattttcatctctgtgttcattcaaaaattattttccttgtgctgacaaaactgttgggcatcactggggggatgtaaacatgaagcagttatttagagctacccccaagtagctaatgttctccagtaatagaaacaagggatgtacataaacatgtatacttagcaagttataaaatcccttcagtactcttgagtgcagtattatggagaaacacacatgtgagattatttctttactactcagcaatgtgaatgaagtggcatggtagtttttagtggggccttgaaggacagattagatttaggttgggatgagttatctcagaaaataaatggaaagagcagtgttttgaggttaaaatgtatgagaggggataagttagcagatgaaaatttgcacaaaagggagcattgtgagcattttaaaagctaatattggtaacagatcatggaaaaaacgtactaaaaactttagattttattttgaatagcaataaaggtttattaaaatgtgttaagattagtgatgtgttgaatatagtttttttcagaaaatgaatctggtagcaatacttagattaaagagaacagaattaggaaaatgatgccataatatgtattaatgataacatagaataataagagaaagctgtgatgattgtttccattgggttggcattgttatttaatagaaaaactgaagaattacaggatagcctcacaagtagattttcatttgggtgacgtctgcattttcttttttctttcttcttcttttttttttttgcattttcacttactattt

SEQ ID NO: 93598 - DNA, 1047 bp, Homo sapiens
tacttgttcattatctgttcttggttaaagctactcccaagaaaagcagttactttcttactgttgtaagatactactaatgcttcttttctattgttcaggttttagtttaaattctagttcgtaataattttgacataatctatagctatgatcatacatatgtttccatttttttgaggtttatgtataccgtgtctgacagagtttttcctgatacttattcgttattaaattttaagatattactgttgtatttgtggtatttggttttctaaataatttagtggtatacttttgtattacagtgtcattattaatttatgaccctgtatgtaacttcttatgtgtttttaactgtttttaatcttgagtcctcttctttcttcaatctaggtcatattcttcaatctccatcagccaatgtgcttccaacccttcctttccacgtccttcgtagcttgtttagcactacacctttgacaactgatgatggtgtacttctaaggcggatggcattggaaattggagccttacacctcattcttgtctgtctctctgctttgagccaccattccccacgagttccaaactctagcgtgaatcaaactgaggtaggttcacttttaattatttcagttattaaaaaaactagatttaattagggagtacagaataaagtttttttctgaattaatctttcagagacttgggtgttccattttcacatctaaaaggatatttaaaacagaaattgtaaattaattgttttctctattagtcttcttcagtaaaccaaaaagaaacctatctacttgaaaagcagaaaagatttaagcgcttaataagctttcccatttaccaagatacactgaatttatactgtgatccttcttcctttcctttttgaacttttaagaataatactatagaatgggggttgtgggtggggatctagccagtgcaataagacaggaaattcaagaaagaaagaaaaaaattcctcattatttcaatatgatttaattgtattgtagaacataccag

SEQ ID NO: 93599 - DNA, 2471 bp, Homo sapiens
cctagctacttgggaggctgaggcaggtgaatctgtctgtgctcatgtatatcttcagtgggttagatatgatagtgcaataatattatttcttcccagatcaatccttaagtttgatacaattccagattcattttggaggaagtttacaagccaattataaaatgtatataaacatgcaaagggtcaggaatagctgagatatccttttgctatatttatcctaaaaagatctgctcatatctgtattcttttcactgttttctcaattcaattttgagtcattgactttttaggctctaaggtggtttatcccttcttttcttgataaatatttgaaaatttgtatttatttatgtgtttattgattcattcattcttaaatataagcagtttctctccatttaccccttcccccagcccctggcaattaccagtctgcattctgtctccatgcatttacctattttggatattgcatataaattgaatcatgtaatgtgttgttccttgcgtctgtcttctttcatttagtataatgttttctaggtttattcgtgtagcgtatatcagtacttcatttcttcttatggctcaataaatatcctgtttgttgatccattcatcggttggcatctaggctattttcatcttttgttttaaatggtgctgctgtaaacgtgtgtgtctatttcagcaccagtttttatctgttttaatactagaagtagaattgctgggtcatacagaaaatctgtgttcaatttttttgagcagccaccaaactgttttccatagtagcttcatcattttactttcccagtgataaatatttttgaagataagcaaaaacaaattgtaatggattttcattttttgttattttaagccacaggtgtcaagctctcataaccctacatcaacagaagaacaacagttatattgggccaaagggactggctttggaacaggctctacagcttctgggtgggatgtggaacaagccttaactaagcaaaggctggaagaggaacatgttacctgccttctgcaggtatatttgtaaacttgatattgttcatgataatggctttttttttgtatttattattttaaaatattgataactaatccaactttcctcagctatgtttatgcccacttgtggtccttcttcccagtgcattctaagataccactggataaagattgttcttgcttacttgtgactctgtatttcttccctctcaactagcttcttcactgagaggaaagtggcagggatgaaattatccagtagctggaagatgcatcttcctacaggcattttcttgtttaatgtgttgtatctggccttttttttttttttaagtgttatttatttatatgcattttggttgcttacttttttttttttttttttttttgagacggagctcactctgtggcccaggctggagtgcagtggcgtgatctcagctcactgcaaccttcacctcccaggttcacggttgcttacattttttaaaataacttttcagccgggcgtggtggctcatgcctgttatcccagcactttgagaggctgaggtgggtggatcacctgaggtcaggagtttgagaccagcctggcaaacatggtgaaacctgcctctactaataaatagaaagattagctgggcttggtggcacatgcctgtaatcccagctactcaggaggctgaggcaggagaatcacttaaacccgggaggcagaggtcgcagcgagccaagattgcaccattgcactccagcctgggcgataagagtgaaactcggtctcaaaaaaatgaatagataaataaataacttttctagattcaggcaagttggacaagaatagaaagtctttataccacagaaatgtataggggaaataatgaaaaggttagctttgcttcctgcatcagctaattgaagttcgtcagtgctttgaatgtgtcttctgcaactctagaatgctccttctagtataaagttctaagattttgttaccttcaaactgtgaattgagtctattcaataaaatatgtaaataatacagagttgctactacattttttatgttcgtagttgtattgcttttatatgtctagtcatatgtagtgtaccatcctttgtaagcaacactctcagacaaaacagatccttctcttttgaaaatttaaacaaataattattttaaaacatagtataagatactgattaagtagaaaatatgtactcttagtattcagattgaatttctaacctacaataaaaacttttgaagtatgtgaaactgaaatccaaattaatttcaacaatttttaggttcttgccagttacataaatcccgtcagtagtgcggtaaatggagaagctcagtcatctcatgagactagagggcagaacagtaatgcccttccttctgtacttctcgagcttctcag

SEQ ID NO: 93600 - DNA, 2074 bp, Homo sapiens
ctgaattttgaagcatttatactgttaatggaagtttactcctttttcagttaccttttgagtaaattaatgtcatttaccgtatttactgtatttactttgctttttctcacttattttttaagaacctatgacttaagaaatagtgtagatcaaaagatcatagagaattggtcactggaagaataattcttgttagtctttgcctatgagggagaaatcaccttgtgaaggaattctgactttgttggcttaatgtgttgtcattatcactttattcatttattttaatagcttttggcatacaaatggtttttgattacatgggtgaattatatggtggtgatggctcattgccaggcagtcagaatcataaattatagaaaagatgaaatgaagagccagttggtagagataaaaagttgtagactcatacaactctgttactagtaatggaaaatgtaaaggtatattttctttgatagtgtgatattttttcttttgtagagaagagaatagtgttgtatttggtcccctcctatcttgtggccccccccagaatctttctcactggtaaccaaggaagctagtgtaataatataacaatagtgtggtatcataattgaactgaacatctgattgtctcattgagctaatgcctccttgagaagtgtctactaaaacatcttattcccttccctggccatctgtgttgcttattcttgtagaataaacatagttttcagtatatcaatatgtataatatatactgagctttgaaactgccatcatgtctttttaggggaatcttgccctgtatttctgtaccttacatttctgtgttttgagatgactctgttagcttataactaaaattgaaaatttataaaaccttgagtgttttttacccaggtatattttgtcttttagatgaaaaattgcataatgatttggaatgttgttttaggtttagccttgattaaaaacagtatcacacatttatagtgttacaaagtgaaaataaaaccagtaaataataatatccttctttaaactgtgtatttccttatgctataatttctattagatcctgcaaaaatggagttatagagtattgaattctaaggtaattatagaatattcttattgcaggaaatttggacacctatagtgcctctttggtctatttgcttttcttagcttaatctatttcctgttcacataacactgtataattttttgagaaaggaatcttctttataaaaatacaccagttaattcaccatgaaaatttaatttcagatagaggataactgagtttcaattaactggagctctttatttttctatttgattaaccggatgaaattattccatttaaattcttttattcttcagccagagaacattcttcagacttataaactatgtaccaacaaaatatgcatgtgaagatataatgagtgttcgtaaagctcatttcattagattattttatctttacagtgaccgtgtgcagtacatatttttagtaattctttttactgataaacattattatattttgcattaagacttgaatatactttttcgttgaaaccctcatggtctctgctaatctgtgcagcctctgttataagacggcaccggtaaagactaataatgttactacatctctactttcaaggtttaccatatagagaattcattttcagcttcacagagagagtaaaatctattcttttccagttgtcacaacttaagatgtatttttttttctaacagagttcacaaaataatccatttttcccttacagtgtatacccacagaaagtggccttagtttaattttaacactgactcaaagctccccaccccacctgtctgcctcattcccaactgtatttcacaaaaatcctagaatactctgagaagagaatgattcaggaaaatgtgttctgttaatgtatcactttcagggtctattttagtgttttttgagggtttggagctgtaactttaaaaatgctgtgtatcacggccgggtgcagtggctcacggctgtaatcccagc

SEQ ID NO: 93601 - DNA, 1689 bp, Homo sapiens
tgaaatctatcctgaggccactgcctaaacccaattaattttgatctgataattcagagaatggaggagattccataggtttgtgcgcccccaagcccaaaacccttacaagaggagataaaaagacatcattaagaatctggatcccagtgccagcactttgggaggcttaggtgggacgatcacttgaagccgggagttcaagaccagccttggcaacatagggagaccctgtctctacaaaacataaaaataaattagtcaatatcgtgggctgcacctgtagtcctagctgctcaggaggttgaggtgggaggatcgcttgagactaggattttgaggttacagtgagctatgattttaccactgcattctatcctgggcgacagagtgagacccactctgcatgtgtaagaacaaaaataaagaaaataaaaaagaaagctggaaaggcttatcatttaccttacatttatctaatttgtaacatattcatgattataagaaattcatgattaacactgataggtgagatctggcctggtcacaaaatcattactgatgcattcacttaacagattttttttttaatgtctgtgggcacataactagaaaattggtcttctttctaaggggctgacatataaatgggggaaataataaccaggcaggtttttttttttttttttggacagagtctcgctctctcggccaggctggagtgcagtggcttgatctcggctcactgcaacctccgtctcctggtttcaagcaattctcttgcttcagcctcccgagtagctgggattacaggcgtgtgtcaccacgcccagctaatttttgtatttttagtagagacggggtttcaccatgttggccaggctggtcacaaactcctgacctcaggtaatccgcccgcctcagcctcccaaagttctgggagtacatacaggtgtgagccactgcgctgggccaacctggcagttgtaacaacatagtatctgacatattagtagaattcaagacactacaggaaaatcaatccagatttggaggcctaaaggatacataggaattaaccaagaatagagtacaaatgaagaggggcaagggattggtgtcccaagggtatgaaaacaatgttagcagtgaaggaaagcatcacatattcaggggaccttgaaaagtttggtgtgcctgagcatagtgtagctggaaggtagtggtgggagatgagcctggagaggaaatcaggggctagaagataaacaggaatatatcacagagttacttaccttaaaagtaatgttgagccactgaaaggttttcagcagctctcatcaggtttgcattatagaaagatggtcttcaggtgtagttgaatggttggaggggaagttggaacaagaccaaactaccatggaagagactttcatctgttttgtctcagcagatagagctgtatatgtcttctccctgtcctactgttttgggggactgagattttggtactcatcagcactcttgctctcatattatggacttaatagatagttagtttccaggtagaaatatattccatgctccagatatttgtcttaaaaagcaatctgtgttcatattggcaactgcagatttatctctagggatctccttcaatagagtacaagtgccatagcataaatggat

SEQ ID NO: 93602 - DNA, 1636 bp, Homo sapiens
agtgagccaagatctgccattgcactccagcctggacaacaagagtgaaactccgtctcaataaataaataaataagatttttctgaaattttcttaattattgatggatgtacttttctactgtcttttcaagatgatttggtatccactttcgtagattagggcaatgtcttggtgataaaatggcattaccaaaagaagccccctgctcccacacacacagtattattttccatttcctgcattttattgtggtttaatgtaccctatatttctaatatctttagctcctttgtcaagaagagatggttaaaggatttatgcagcagtacttgatatttaaagagtaagcaaaaacactccccatttatgagtattgttcaacattttattttagactgttagaaaagacagaacttgaaagtaactctcagttacctccactaataaagggatttctggcgtggataacataatactttaaatctgtacatacatattgtttttacttgaatttaaatattattatctattgtgaaaattcattctgttacccacaaaatagtcactctgtgaagatgggaccctttagcatttacaagttagttctggtgaaatttatctcctgctggtcattccagctggtattatcttaagatgaaattaaaatatagccatagtagttttacttttgaataaatatggtatttcatagcttccttcaagcaggaacaaagccttttttttatatctgatcttttgtgcagactttttctgctgtactccaataagcaaaaatcgtatttagtgtagttggtatttgatggtttcaccaaaaatttgagagagaaacttattgtgaataaaaaaatcttatttgctgccagggcatgacacaaatgactctatgttcagtgtaaagtgttctggatatttaacttctctttgaacagcattgaagcaagcatcttttattgccgtttttcctagctatctcaaagtttcttcctaatggaaagttgttcatcatagttttaaataactgaagtcacttgtacaagtaccccacttcctttttatatacctaagcaatgggagatcacttgatttacatctttcaaggcatattttctaccagactcttttattttaacccccataagctggatcttctagcactttagttaaaaaaaatttcagttccagccctcctactttgatttctgttgaaaaacactcttttacctctgcttcttatacctaaaaatgaaaaagtcctgatttcttagccagatagcatttgttatacccatatatttctttaaacattcctgtttttgatggtggtaaacaagttcagttgtttgtcagtcttttttcacacagataggcaaatatttattttaacatctcttctttgactggctcagttgggttgtcccctggtaaactgctgaaacatattatttgtggcaactctatttaacagtagcatgcagtaccttccgtatgtctggtgatgtttaatttggcctaaaaattagtatatttgtgtctagtatagaaatcaaggttttatttttaaaggcttcttataactattttaagtattcccttctttcatgctcacttatg

SEQ ID NO: 93603 - DNA, 1194 bp, Homo sapiens
agcacagtgtgatcagtgctttttggtaaatgtagaagtttcattctcttatagttttagaatcttcttctgcagtgctaattcttaatagttgtgaatctacatttcagcatgtagtctccagataacttcttcaaatggctctccttttttaaatgtttattgcaactttgcagtatgtttagcttagatttaggagtgcaaagggttaaaggggtcttgttttatcaaggaaatagctgtattaagctgttttcagtttttggattataaaataccataattctgacatggtgtatttagtcttactaatactcaactttatttgggcggtagatactggtagaggcagttcaatataattgaatgttgaggtatgggtttgcttttttgttttgttttcaggagaaagatttgcccattttgctcacatcctacttcagatatgtgtcacagagccaaaatttgtttaactaattagctatttagttggaattcacagcatagtggaaaatgtttgcagataattctgtgcaatagtggaaacttcagttgcttcctcgtatttcttcagggcagtgatcacaaccagattcaacgtatgcacaaagcagcggataccatggtagcggccgtcgctgattgcttttaccatgttggatccattgtcagtctcaaagacctacttccagctaggtgccttgaactcaaatagcttttcacacagacttcaggatgtgagctaaggtatggccttttttcatgagctgggcctacatatgggttgacagtaacctgcaacttttatagaaaagagactactggctatagtttaatgtcagacaatgactagttagaatcattgataggcaggtagtgtgtgttcttcatatattcaaagtattctcaccatttagagattttctttttttcggtgtgtttttgtcagactattcaagtaaagatttctcattagaacctggtcaaaggtctaatatatatctgctttatgattcaaccattgtcttcaatatgaaatatatatcatttctttcacacatttgatgtaaagaatttttttaaacttctgaggattcttgcacaattatttttcttttactttttcttaattatggtaaaaaaataaaatttatcatcctaaccttgtgtactattttaataatctcttactaa

SEQ ID NO: 93604 - DNA, 1914 bp, Homo sapiens
gcctatttgttaaggattcttctactgtctgttactctttttatagttctctaaggctccatgaccactttgcgagatagtattttaatgtaatgaccaagtccctttttaggtaggtatacaactaaaaaaataagtgatgtatagtttagatcataccttagcataaatattttaaacacttttatttatatacgattttagtttgtttcaaatgatctatttaaagaattataaagatgtagatttttgaaattctaagcagtagtgtaaagatgtttgtgatgtcaataatgtgctgagagttggaatagagaaaaggaaataatgtttagttgtgttttcagtgactcttgtattaaactactagtacatttatctagaaaatttaaataaaaatgtaatgtcctatatacttaaaccttgctgtaatacatcctattgtgataacaatgtgaaatgaaattgggtacattttagatcctgataggaaataacagaataatatctttaaaatgaatatgccctaaaacttagtgtctcattaaaagatccaatgtatagaaacacattgtattaagacacccagtaatgaacctacattttactctaaaatatgtttttttttcttggaaatttaattctgagtgaaatacaaatagtattaaaatttaaaaactgcttgtggtcctttaattctcaaatattttaggtgtagaagtgatttctgtctctgaatatttataattatgtgtgtttttaaaagtgtgtctctgaggacatcaggtatctggatcttttacagtatgacatttatataatgtctgtctcttctctgattttatattagaagggaaaacctacccataactttactagccagtggcttcaaaagcaagttaatatagatcatgtgtgtgacaaatgaaatgcacacactcatttgtatattgatttatggaggtgttttagtcctaaaatcttaattttccttgcttttctttccatattaaaaaaattcagatctaaaagggaaaatgttaaaacaggagtaaaaccagatgcgtctgatcaagaaccagaaggacttactcttttggtaccagacatccaaaagactgctgagatagtttatgcagccaccaccagtttgcggcaagcaaatcagggtacaaaacttttcctattatgccacttttcatttgatgtaaagatgtttcatttacttactgaaacctgcctttgtgtttttgctttatgttaatgattttaaagcaagttcatttacctaaaaattttgttctctgttagattttgttctttatctgatttcaatcatgtatagtctaatttttaaacatttctactatatatgattgctaaatttagtaggctgagaacatacattataaatatttcttccccctgaaattcatgaaattgaaaaaatgcctttatattagatagaaaatagtacattaagactatgggtgagaatttagtttaaattgatatctctggctggcgcagtgactcacgcctttaacccccccagcactttgggaggactaaatggatagatcacttgagctcaggagttcaagatcagcttgggcaacatggtgaaaccccgtctctacgaaatacaggaaacattaggtgggcataatggcgtgtgcctgtggtcccggctacctggaaggctgaagtgggagaattacctgagcctgggaagttgaggttgcaattagctgtaattgcaccactgtactccaagcctgggagacagagtaatactctgtttccagatagatggatggatggatggatggatggatggacggatggatagatattttcctatgttagctgaagaaagtgatctgaattatctattgtttcacttcctctttt

SEQ ID NO: 93605 - DNA, 1022 bp, Homo sapiens
aaaaaaaaaaaaaaaatagtacatggctagttttatgctccttaagaacagtttgagcagaatgttgctatgagttgtttaaactcataaaacaactaaaaaaaaaataaactaaactaaaaaaacgaaatttttttagcattttttggaaatagattcttcatatctattattattattatcatctatcttcatatctattattattcaagaattcaagagtaaaaacagatgtgtaagtattacttatggctctattgtgcctaattttattttgcctttataatgaaatatttcaatgttataatcataaacattgattttattgtgatagaaatttgtggaaacacatattaaagaagagtctttgtggataaagcaggatatcagttaacccacagtaaaaatgtcccatcatagctgttcttttcctttattctttaggtgttggtgtctgtccagtcccttatattagtagctgagccttattttaatgaaccgggatatgaacggtctagaggcactcccagtggcacacagagttctcgagaatatgatggaaacattcgacaagcaacagttaagtgggcaatgctagaacaaatcagaaacccttcaccatgttttaaagaggtatgttcaataaaattagtgaaatactttgttaaagacattttacaatataggctgggcatggtggctcatgcctgtaatctcagcactttgggaggtcaaggcaggtggatcacttcaggtcaggagtctgagaccagcctggccaatatggcgaaaccgcatttctacttaaaaaaagaaaaagataaattagccaggcatggtggcaggcgcctgtaatctcagctacttggaacgtgaggttgaacctgggaggcggaagttgcagagagctgagactgcaccactgcactccagcctgggtgacagcagagcaagactccatctccaaaaaaaaaaaaaaaaaaaaaaaaagacattttaaaatatagtttgttagtattcta

SEQ ID NO: 93606 - DNA, 1051 bp, Homo sapiens
cctgccttgatctcccagaatgctgggattacaggcgtgagccaccacaccgggccataaatttcatatatttcaacacgtcatatcaaatcatgagcttgatttttccctgctaatattgtagagttgattaaattgcctttttttttttgtttgagatggaggcttgctctgtcgcccaggctggagtgcagtggcgcgaccttggctcactgcaagctccacctcccgggttcacgccattctcttgcctcagcctcccaaattgagttttatggatagaaaaacattgcagtgtctgtatatttatttcattaaatgtatttataataatattctaaatattaatttaaatgtatttatagaataaattatttaaatgtatttataatacattttacttctttgtaatgtcatttactgtgtcttttaaatttgactgtaaacactgcttgttctcctgtttactttttctcaaggtaatacacaaacatttttacttgaaaagagttgagataatggcccaatgtgaggagtggattgcggatatccagcagtacagcagtgataagcgggtaggcaggactatgtctcaccatgcagcagctctcaaggtgagtaagcctctctaacaggagccttgttgctttaagagttgtgtaattattgacagaaccatgcctaccagaagataatgggagggagggaattaaagaaacataatatgtattttcagttcagaggaataaattgttactcagaagtctatagaaaagatacatttttttttggtagtagattgacagttcctaaaataaaaagtgggtccaaggactgagacaacagagttttgtaaagttccttgaagataatgatgacaagatgtgctccatgaatgccttttcctttttctttttttcttttgagactggatttcattctgttgtcccagcctagagtgcagtggtggcatcatgactctctgtaaccttgaactcctgggctcaagcagtcctcccacctcagcttcccatgtagctaggactacagg

SEQ ID NO: 93607 - DNA, 1496 bp, Homo sapiens
gtgctagagggtttgcagttctaacattagtccttttctcctgcatagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttattttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagtatgtcttgtttctaaacccctttgccatggtgtgaaatgctatttctataaagaattgaacactttcaagacttaagcatgggaaaacaaagcatgtttttccaagaccagttgccgcaggggaaaggctaaggtgattctttgacagtatttttataaaataaaagtggcggctgtgcgcggtggctcacgcctgtaatcccagcactttgggaggccaaggcaggcgggtctcctgatgtcaggagttcgagacaagcctggccaatgcgatgaaatcatgtctcta

SEQ ID NO: 93608 - DNA, 1012 bp, Homo sapiens
agccaccgcgcccagcctaggaggcaaagattaattcttgtgagcaatgaatatttaccagagagataaagagttaaaaggcacatgcactggcacatctggttgtgggatttaggctggacccaaaagagtaataatgaacagtgtagtgtgtaagtactctgtgtgtatgtgtgtgtgtgtgggcacttgtgtgacacagtaggtgcttccagtgacaggaagtttgaactttggtggcctggaaaactttcctagaagaagttagacttgagctgattttggattaaagggtaagactaacaagtggagaagagttcaacaggcgatatcacaagtgcaaagtgtggaggcaggaatacgcatgggacattagggaaacaatgagtaaaccagcgctcttggagtgacttttcaagaagagaaaataatggaggtagaaagaaccagattgtgaaaagttttagaaccttgactaaggaaacttttgtattgtcagtaggaatctttgtgaatttcccagcaaaagactaaatacctattaatgaggaatattatttctggggctgacttccactttggggctcatagtcagtatgagtgagctgctaattctaggagagagaatgtttgtagaatgatggaaatttactgagtgccttgtgactgacatacagtaatcattctaagtctatagattgtttttgcacactaaaatggtagatttacctaatagtgttatcctttacggtatgaaaaataattttttttggattaccgcactaattttttatattacagagagtggatctttcctacaattgctactggaagggaactatgaagccatattcttaaattcaatgactcaaaatatttttaattcaacaacaaccgctgaagaaaagattgatagctacctggagaagcaggtagtaacattcctggattactcaacagatttggacacaacggaaaggtagaattttatttgaaattttcatagaggaac

SEQ ID NO: 93609 - DNA, 1017 bp, Homo sapiens
gccaccgtgcccggcccagttatttcatttcataattgatgaaactgaggcttcatcaggaaaacaattgtgggaaaaatttacatgtgctcacaaactaatgagaagcagagaaaggacactgtcctgtgcatgtgacattggaacccatgttcctgatgggtgaagattcttgctcgctattgtatggagctgttaaaattctgccatccaaattttaacaaccttgtccattgtaaaaaaatctctgtacaacaggagagtgcatttttcaaaggcatccttttttttttcagccttctgctcactctggtgtgtggtcatatgcccattctgcatttgatgcatgagaccttgttgattgtttggcttgatagaaattatggagtagagacttacttcataatgacattttccaggtattgaagcttaagtgaaatgtaggtgtttaatataaatatcaaatacactatttactataaatactttaatatagggatgcttttcattgagataatattttgttgtaagtgaatttatgaagtgatgatatctcttcaatgctagcattttttttgagttccttgtttctctaaagtttgaacatgccaggcgcagaagctttcacctgtaatcccagcactttgggagaccaaggcaggggatcacttaaggtcaggaattcgagaccaacctggccaacatggtgaaaccccatctctacttaaaatacaaaaacttagctggatgtggtggtgcgtgcctggagtcccagctattcgcccaggcaggaggatcacttgagcccgggagatggaagttgcagtgagccaagatcacgccactgcactccagcctgggcaacagagtgagactcccatctcaaaacaaaaacaaaaacaaaaacaaaacaccaaaaacccaaaaaatcaagtttgatcagatgggtggccatccatcagggcaggctggatttatagatgtctaagggcatttgcagtgttataattctgtcca

SEQ ID NO: 93610 - DNA, 1027 bp, Homo sapiens
agcctggtacctcagttggaaatgcagaaatcacctgccttctgccttgatttcgctgggagctggagacgggagctgttcctattggccatcttgacagccaccccctatttatgtatgtatgtatgtatgtatgtatgtatgtatgtatgtatgtatttatttatttatttatttggagacgggttcttgctctgtcgctcaggctggagtgcagtggtgcgatctcagctcactacaatctctgcctcttgggttgaagcgattctcctgcctcagcctcctgagtagctgggactacaggcgcatgccactatgcccggctaatttttgtatctttagtagagatggggtttcaccatgttggtcaggctggtctcgaactcctgaccttgtgatccgcccacctcggcctcgcaaggtacagggattacaggcgtgagccactgcgcccgtccccccactattttttttttttggcattgttaagacaaacccgctgagaaagagcaaggttatgaatcatatctcccaggattgtgtggaataaaggagatagtgtacataatgtccttagctcatgtctggagcatataagtgctcagataatgctggctggtaactattagtgttactgtattcctcaggtcttatgtttaaaattatttaacaacagagactatgtactatatactttatgtattatagactctattttacacattaatatatttttcttctcatcataacttttaatgttttatcttttgtcttgcagtgatgaaactacagaatctgtttgtagatgattcaggtcgatatttggctattcaattccatctggaatgtgcatatgtgtttttatattattatgagtacagaaaagcaaaagatcagttggatattgctaaggacatcagccaattacaaattgatttgacaggtaagacttattttttgtggataattgattttatttttatgataaaactatatacattggcagtttgtattgtatgttggtatt

SEQ ID NO: 93611 - DNA, 1069 bp, Homo sapiens
agactttctagactggtctttgtaatcaaggatctttgtaatctgaccttgtccagagagtggatgttggaacttttgcttttcttaaagtggtttgaaaacagctattctgcagtaagttatttcagagacataatgaaaaaattttggtcttacatgaagtcagatagtgtaataaactgttgatatagaaccaaaagatcctggctttaagctctggttctgatgctgagaagccctgtgatcatgaacaaatgactgtattctttagaacttttgtttctgtcatctgtgaaaaagagataataatagttcttctacctacaacactcaatgtgttactttttttttttttttttaaagggtggtagtttgatgcaaaaattagtatgtggactgtagtggcagaaatcctgggtttgagtcctggtaccagagcttgttggctttctaattttataagtcatttaaaacctgaggctgggcctcaggactttcttatgtgaaatggagaaaataccttgtaaactctaaagcactctgaaaatattactcttcatgactgtacagtagatctcatgggtaagtcagtagatataattttattgttttttcaggtgctttgggaaaaagaacacggttccaggaaaattatgtggcacaactgattctagatgtaagaagggaaggggatgtcctttcaaattgtgaattcactccagcacccactcctcaggaacatttaaccaaggcaagtaggacattaagttattaaattcaattaacacctgagtctaagaatttcaatagctgagtaccatagaaacactgaatgggttggggacagacttcattttattctttcttttgccttttaaaggttgctgagtcagggagaactggtgtttaactggtgtttttttttcctaacctgtgatagaaaaaactggtgttttttttttcctaacctgtatatagagataaatactgtttttcttctaggattcaataactatgaattaatgatgcagttagttatgtattacccctcttgaagaaatacgaaagg

SEQ ID NO: 93612 - DNA, 1010 bp, Homo sapiens
agtgtttatcatagtacattttgtccctgttttcacttatccagtactttcattttgcttcccactacacttgtgatcatattggatgatttctactatgttctctgggtaatggtggtcacagctttctctggggttaggtttcagtgtgtgcatattcagttttgatataggccagtctttgttaagatgccccttctaggaatgcattttcattaaaattggaaactccctaccctaacaaatgccagaaagcattctcatatgttttagaatgatttctgtaatacaaattgagaaaaagagaactttttgttaactgggaagattttcaaatctgtgtttaactgtaccctgatattttggaagaattaattttgtcctattcagaatgagatcacctagcttatctcttttctatgatttttttcttcccgcttctatcagtgtttgctttcacaaccaaagttctgggccattcagacatcagccttgatcctccggacaaaacttgagaaaggaagtactcgccgagtggaacgggcaatgaggcagacacaggtaagaattaatgtggcaatttgtgtgcttcttccaactctctattgctatcagtaagcatacatgtttgctatgaatgaaggaatgaaatggcttacatttcactcaaataatttgttactgtttagagaataagttctataatttaacttcttggttccaaagcccagctctgtgacttagcagctctgtgaactcggtatttaacctctccaaacctcattttcatcatctgtaaaagaggttaataataataacagcacttaggctgggcgcggtggctcacgcctgtgatcccaccactttgggaggccaaggcaggtggatcatgaggtgaggagtttgagaccagcctggccaacatggtgaaaccccgtctctactgaaaatacaaaaattagccaggcgtggtggtgggtgcctgtaatcccagccactcgggaggctga

SEQ ID NO: 93613 - DNA, 1810 bp, Homo sapiens
cccaaagtgctgggattacaggcgtgaaccaccgcgcccggccaggactgcctcttaaagttcatcttttcagcctgtaatcacaaaaagaggatctaggttctcccatctcccattagtagacccagttcctaccaacccataccctaaagtctgtcgtttctggggcagaagcaataactgagcatctccttgatcaggccacaccctgtctcccatatttttggatttatgtgtaaataagacagttaaatagagttctcagtatttttccaatgagaagctgctttcaattttgacacatctgacattgatcacatagttttacagaaggttttaataaagttgccaactgtggtctttggagtctgacaggctcacctatttcatcgccttatgactttgggcaagtcatttttatctctcacagcaacagtgttctatgtatgaggaaagactgggttcacaataagtttaatgatggtgttgatacttactaggtgtgttaacagttttaattgttattctccctgttcccattggcaattttcttgggcttggaggtttgagatggcaatgagcttgactagtctatttgtaaattacagctgaattgactgcagactcctgttagagaaagctgtttggctcaactattggattatatacatatttttataataaattccatcttcctatacacacacacacacacacacacacgtacaaagattgcacagcaaagccagcataaagtgatatggcatatgatcagtcataacttttagattatcagctaatttctacctgacccttcaaaaagccaatgaacacgtagatgtcatgctagtgagaatggatagctttcaggaaaagggtaggtcctttgggactatctctattcttttgaaaacgtgtgccatacttttagatgagaacatataaataagtctaaatcataccagacatttttcagaattgtccttttttactaaatcattctccatgtgctaattttaaaatgtagttttgatcttctctagtttttttctgggaaattccttctctgttgaaaacagagcattgaaaggagaggggacatcattgctttcttgggttttattccccattccatagagatatcccttgacctgtgacactgtggctcctggaagatttgggaattgttattgcatggggttagggggtctttatgcacaaatacatattctcaaaggacactgaaagtataaatgtctttaggcggagttagggagtaaatggcattaaaagggagtcttaaaacttgaaaacagtctcatatcacagtagtccatgcaacatgaagtcacctctggtatatccagcccctacttctggaccgcgccccaggggcctcctctctctctgcttgttaccttttacgtttattcacatctcttcagtcatccacctagagtagactgtcttgcttcaaactgcccttaatgattggtttagggtatatttgcttcttctccccctgtctccatttttgacattatcatctttccttaaagaccacctcctcataccactttttacttatgactaagccctaaaattaatgaaatttagaaactggaaagagaaaatgggtaagtgcaagggtaggacacactgctttggagaccatttacctaaatttctgggcgtgtgtgaaagcttgcgaggtacttctatctcatggagcacattgtttatattcgcattcatgcacataaatacctcaatagtagtgaggcttcacgtgcattcagtcccattctca

SEQ ID NO: 93614 - DNA, 1030 bp, Homo sapiens
ataaatgtatctcccagccagtgtaaaatagagaactttcaatttaggagaagcctccctgctcagaaactggtctccctgtcttagatttttaccaggacatggtagattcccgtcctttttttttctcctgaggcttggacttgctcccttttttactattttttgaaattttccatttaaaaaattaattttgtaaaaattttaaacagtttccaagttaccaaaaagttgcaagaacagtgcaactgtcttttgcatcccgaagttttggagagtaagttgccaacatggtgcttcatcatcctcaaatatgagaacgacattctcctacataacccagtatgcataataacatcaggaaattaacattgacttttcactaccgtctaatcctcataagagaggcctgtgaaaactagtcaactggcaaaaaaagaaaatttgagtactgcattgtagaaaaaagatcatgataattctcagttgagagtaggtataagtgtataataccagaaaaatatgtacacttaatgtaaactgaatggcaaatgaagaggcaggagaaaatgatcatgataatggggctgctgtccacatgcttctctagcaatcccacaatgtgtcttcattcgctttgatgctgaatacatgagctcttctatgacgaatcatttgaccactggatagctccagctttgagtttgcagttggccctggtaccttgtctcaaagtcagctattttggtcttgttggtctgcttcttgatgtagcttctgagagtttagttattcagtaccattgtagaaatttcagtacatcagagggattctttcatgtatgtgggttgcagctgcccactgcactgtatagatggtctcacatgagtgaatgtccagccttattgctctgttgctgaagagtgagagaacttgctctctgtgatcaaataggctactttttcctttcattttattcctgagcaaataatcctacatagagttcttcatgtaatttttctctgattta

SEQ ID NO: 93615 - DNA, 1222 bp, Homo sapiens
ttatttttacttgatttttctagcgccaacttgcaagtttgctctttgagttgggatgtaccagttcagcccttcagatatttgaaaagctagaaatgtgggaagatgttgtcatttgttatgaaagagccgggcagcacggaaaggtatgtaatagtccaatttgatgtactggtgagagccttccctctgggagcatcttctcacttgttttgtttttcaaacccacttttgccaatattcacttatattccttttttcactttttttccagaaaacttttaaatgttttctctgatttccactggggcagatttttacaaaatttttaagaaagactaacaagagctttgaagacgtgggattttgatttctttcctttactcaccttctcccttaggatgacttcaaagcgaaatatttggaatcattttaatgatcactgggttgcctgatgatcagatgctgtgggcctcaatggaggttccctaggagagagggtgagagcagctgggttggtctttaaaagaaaatccaaagggtgtgacgacacctcttgaggcagaagagttgtcaagtgtgtaatgcacatttaattctacccttaaattgggccaggagggaaaatgttgcaatatttgcatctgttatttgtctgttgtttttttcccctcatacatgaacagaattttaagaagaataaggggctctgcattgttagtcactttaaaaactgacacattgaaatcatatgttaaattttggattaaaaatttaaaagacttaagttgagtacataagcaagcagagtaaagcccacaaattggatcatttatacctacagtcaaccttttgccatcaccctaaaaaagagcaatagtggttcaagcatgtgtttttcttaaataccttcctaagtatgtctattttagattaatagtgaaagttgcatttctttcactaatcagttaatggcagtgaaggtctttgaattgtattgacttaaggagaaaccagaataagaacaaagttttactgtggaagattatcgactgggcatggtggttcacacttgtaatcctaacacctcgagaagctgaggtgggaagatcgcttgagcccaggagttcaagaccagcctgggcaaccaagtaagaccccatctctacaaaaaaacaaaattaaaaaataaaaaattagctgggtgtagtggtgcatgcct

SEQ ID NO: 93616 - DNA, 1050 bp, Homo sapiens
gtatgttgtgtttaattgccatttaaaatatcttcaaaaggatttcattatgatttggcactgaaacaaaaagttattgaatacagagaaaaagacagaaccaaattagagaaatgaaaatttagtattactgaaataaacatttgccatcagataaatcatcacaattccatttacttttctttaaaagcagcaaccaagtgctttatgagagtcaagaaagaaggatacccaaaagtagatgaagctttgttttgtactgagatgtatgaagaaaggttgtcatttaaaatgtcaagcaacgtattgaaggcaggaagaactgccaaatttttctgaatagactgaaaaaaatcaaagcaaacaagaggcattagattataattaaaagcattttttctttctttaacagagtttgtcttacaactgatagcatctcaaatttgatgaaatatagtcatgtatttcttcagcgacttaaatatctttttagtgcccgttgtctgacactaaagtagtactcagatgtttgtttaacaaaggaatgaatggatgaatgaatatcttgacttccagtctgatgtagttcccattgcatcattctttactgtgctagtctttttacactggccaagaaataagtaataactttatataaaaatatggtagtttttgaaataataatatttgaaataagcaagttggtaaatcacaaatgctcaaagcatattttagaatattaatttaattatttttagaaagtatggaaagatgagactttccttaattgcaggagaaaaaacataatgaatccatccccttcagagaagggatttgactgtccccctaagtagttgtgatgattattatttttttaaatgtgcacatgaccttgtaagaattgtgtgtaataatgacaaatgcttctgtttctaaatcctctagaaaatgtgcatatttaaaattttagaaatgtatagtcatttactttgtcttaagttttttgtgagttttagccaaacagcccccaaaatcttgatcttaaaagtt

SEQ ID NO: 93617 - DNA, 1076 bp, Homo sapiens
cgagtagctgggattacaggcgtgcagcaccttgcctggctgatttttgtatttttagtagagatgagggttcaccatattggccaggctggtcttgaattcctgacctcaggtgatccgcctgcctcagcctcccaaagtgctgggattacaggcatgagccaccgcacccagcctcactttatgatctgtctcctgtttccattgccaactgcattttctccttcttttactccccttcatacctactctgtcatccaggttgcacctgaagttccagcagtactttaatagcttgaattaaagtacttgtaagttcttgattttgtagcgccgtctcacttcagacctttgtaattgttgtctgtctagaacgtttgtcttctttcagctaactgctacttattctttaggagattgctttctacagagagccttcccagatactttcctcccacatttggtggtaccatccacctgtgtactcctatggcacccaaactactctggtaccccatttgttggctcatctgatctactaaatgtaagctgcttaagaaccagacctgtgtcaacagctgttggccaggtgtggtggctcacgcctgtaatcccagcacattggtaggctgaggcgggcagatcacgaggtcaagagatggaggccatcctggctaatatggtgaaaccccatctctactaaaaatacaaaaaaaaaaaaaaattaaccggacgtggtggcatgtgcctgtagtcccagctacttgggaggctgaggcaggagaatcacttgaacctgggaggtggtggttgcagtgagctgagatcacaccactgccctccagcctgggtgacagagcgagaatccaataaaaaaaacaaaaaacaaaacaacaacaacaacaaaaaaacagctgttgccccagaacctggcaaagttttggcatgtagcaagaagtcaatcatatttgctgcatgagtaactagtaagtgatcactcaatagttatctcattgaagcaatctccatgtaggacactccttatggatgactgcatgtggcagaagatacccctc

SEQ ID NO: 93618 - DNA, 1053 bp, Homo sapiens
aagtaggagtagacaccactacacagaagtgtagctgggagtgtctgatgggtggggcaaagtgttttgcacttgtcacctctcagctgctgctcatagaataagaatttagactaggagtaaattgccattctgctaaaagggttgttcttggtgagagggaaacgtgctttggagttctgtcagctgtgcccctgtcatctttatgtactgtattgaggacgtagagcacctttcagtggtcagtctccctgtcattgagaaacagcctctacaatagaatcagaatccattttttgctctctgcttcaaggtagaaggctagaattagactatggccaatgttttgtgagtcccttgtgtgtgtgtgcgcacacactttttaaaaattttttttaatcctaaagctattgtcaagatgccaaatctggctaattggggaaccttaaattcttagcctgctttttctccattctcttggagcaaacctgtatttattaagtctaattttgctcttcatgtggtcctcaaagatactcttcatagttggtgccatctctgggtctagagcttatttttttccccttcattttttacgtggagggcttcctatagttgttggtctgccaatttcccttcctaatatactgaccagttgcaaggtcagataagaaccactcttatcacacattagaattttaattctttccattaattcacaaaatttccgctaattcacaaagttaaggcacagatcacagccaaaaagggtagtttcattccttctcactcaagtatgaataactttcctgaaatattttgtctaccttttcactggaggctcaacttaatttttcacccatattctttaccccaaacccaaggcttcatccctgacagagtgcttcctggaatcctagtggtgcttagggtaggatcttctctcccacaaatctcaaatttcccatataacaacttgcagaaaaaccatatcatcataaatataaatgagccccaatatagcaggttttcaatatattagttccttttctt

SEQ ID NO: 93619 - DNA, 1052 bp, Homo sapiens
tatagactagattatgcaacacaattttttagtaatatgttaaaactattttggttgtaaaataattaacacatactagcttaggcaaaaaaggatattttattggttcttgctactgaaaattctagtagacttcgcatgagagctcttccaggggctcagatgatatcatcaggactttttagctctctccctgaggcagacatgatggccacaggaagcccaagtttagtaatctcagtggaaaaatacagtcaattccacatctctaaagaacgattcagtggaagactgaagggcttgagtcatgtgccttctgccatctcatctgataggaactacctggaccacacatgaagtgggttttcctcagggaagaggagtttaattttcagaagatcagggaagggatgctgagcaggaaaaaagcaactgtgatgtccactgtggggtgggagtttaatgacctaaatctgaagttgcaaactggcagcttatgggtgaatataggccagagagacagtttttttttgcctaactcagtattttgaaaaaaaaataataataaataaatattttaaggatacttcatcttaaaaaatctagacttcttggcctctcttaaagagtttaaagatgtggaaacactgagcagccagagtctcatgttggtgtcctaactggctggagctaagcagtggctctttcctttggatgctcatctaccagcccactatattcatctcaaaaattggcaagcatctctgggcaatttagggtatgacctttgctctaaatagtgcaggtttccctggtcaagtaaacagcatgttactccggttataattacaagttctgcttgagtcttggccaacttagttttgtgctgagatagtcattgccaaaaaaaagtattaaaattaataattagttgtgtggaattactatagattgttgaaacagcttagatttgtatgtatgtggagcgggggtaatgatctttggggtttgcatctgaaaagattcttgcaagcgctgcaggttcattgcaa

SEQ ID NO: 93620 - DNA, 1111 bp, Homo sapiens
atggtacaagttaaaatgccatgaagcttgctcttcttaccaagatttagcatttctcttgaataaatgcttcctgtattattgcaagtctttggttaattttcagagttctgaaaaagttggttctgacacttttggccagttttctggttattttgtagtggagggaattttcagatgttcttataccattacatttgctactgtctgcctgtggaatagtgttgaagctagaatcaagttcctgctttttaacttagtgtttcttgggttttgggtggccaattgactaagaaatctaagcttttatttctttctctcaaaaatgggcatgttaatatatactacttggaattattgtagggattacatgagatcatgcatttaagaatcaactggataaaagctaacctatatgttactaccaaatggaaggatacataagttcaaaaggtagaaatgggaaaaaaaaaagattttatcacttaggcctgttttatggaagcagagccactttgagtattttagagaataagtggtttactaaaggagttgaatcttaacacaaatgtgagaagagctggggaaatgaaggtatggaagagggaatcagaagatcaaggcaagaatcattgactagtccacttgaaacattggcacaagtgggtaagtcagaacttaaggtaaatccaagaagccaaatactttcagacattgaaatgggaccatgaagcaggggcttgtggagggatctgtggacaaccattatatctatatagctattaaccctgtgagtccacacagcaaatgtctcaggggcctggggatgctataggtcagcagagccagcagttggaaggacaaggtatacacacagagcatgggttctgggatctgcagagcatctccacatcttgtttgttaccatattagaccatgacaactttccaagagtaaaggctgttgcttcacttctgcctttgaaatccttgataggttctcctatgatgaactctaacatgaaatcagaaggaaaagggattttaggaaacagtttccagtttaagcaagttgacatagcataatccagtacatatgactatgcaagggt

SEQ ID NO: 93621 - DNA, 1084 bp, Homo sapiens
ctttgattttggcttttacctggttggtagctacagggaaaaataaattcttttagataatcatagaaattccctggttctctgacctgggggatttaaaacactgagtgttgtttgctttctttgagctgtctagtgaacttggaaacagccaacttacctcacagttgttgtattccctcataatctatcactcaatatgcaaagccgtgcattaggtaactgtcttagttctgttactacacatgataacttaagtaattctttcatcatgggatatcatggactaccagtgtttaaccctcttatgatcactgcagcctttctgtcttcaaacccaaccagatcagataccaatcacacatttccatttgccccaggagtacattgcctgaaatcatttctatacccaattactataatggtcattgtttaattacagaccactacagtacgctgtaactggctaaagcagaaaggaatttattaggtgaattggcctccagaatttctggggtgacgtgggtaccataccgtcagtatcgggctgtcaagagaaatgccttcaatcacgcagtgagatgatttcagcaaaaattctgctgcggctacagtttgtggttgaatacatctctttataggtgactagagttatagttaggtactttaatagctattgtattgatgtttgaagagaggaattacatggattatattctaaaactttatgtttattttgactgggacttaaaagtattttttcttagaaactgttttataaattccagtttcactttcagattaggtctaaaagcatacacaacctgaactatatcagaatgcagaggagccaacatccaaagacacttttagaagtatagtcttcttttaaaagagttcacaaaaattagactgcttaaggagtatagatatgcccaacctaaagaaaatcaaatatacagactttcggattgccaactgatgtatgttaggggctttaaagtctcattttagctgctaaaggatggctttcctggatatgtacatccattttggcaatggctatcctagcgtccttggcagc

SEQ ID NO: 93622 - DNA, 1389 bp, Homo sapiens
atatagaggccaaagagaacatttctacttttggtagacaatgaagagaggatgttggagtcggctttgaaagacaggtaggactagaataggcaaaggaagtgcagtggtgggggcattctaggcaggtgaagagtatgagcaaagctctagaaacacagagagaagtgtgtgtgtgtgtgtgtgtgtgtgtgtgtgtgtgtgtgtgtgtgtgtgtgttgggggaacagaggtttggtgaagaggttagttttttagggtagaaggaagtagggcagttatagtgcgaaacctagactggagccaggctgtgaaacgtcttcaatgtgaggctaaaccgttgggtttttatttgacagatagccattaaagggttgatttctttggagctttgttttaaatgaaggaatgtggtgtgtaaagaggtaattcaggaatattgttttggtaacactggctgtaggagattctagatggaggctgagttaagagactgtagcaatagtttagttttttgggtttttttttttgttttgttttttgagatggagtctcgctctgtcacccaggctggagtgcagtggcgcgatctcagcttctcagctcactgcaatctctgcttcccaggttcaggcgattctcctgcctcagccttccaagtagctgggattacaggcacatgccaccatgcccagctaatttttgtatttttagtagaaacggggtttcgccatgttggtcaggctggtcttgaactcctgaccttgtgatccgcccgcctcggtctcccaaagtgctgggattacaggcgtgagccaccgcgctcagcccaatagcctagtttttagccatggcaattctcagtgtgggaggggcaataggaaggaagggatgaagtgagggaagtcacaggggagaacttgacagggcttgctggtctcattatataatttagaattaattatttacgtagacaaagaaatgacaattgctcaaagcagagtcacagtataaacagatgttatgtgaaaatattttggagcttctcatatggatccaattcaggcgggcggtaaaccatgccaaaatatgcaggtattgaatgctgtaattgtacagaactactacaagatgcaaacttgaacactgtagactcattttaactgtgaaccaagtttgaactgtctggagggagaacgcctatatgctatgttgtctcctttaagacctgcaataaagggaaaatagaaacatggaatttaaaaaaattctatcctcttttttagacatatccaaagaattaggttaaataacaaaatttaggcaaaccaaagtggtatttgaatggcttctgcacctcttaataactttctaaagtcaaattggtat

SEQ ID NO: 93623 - DNA, 1088 bp, Homo sapiens
aaatatcaatgacatggtattagcataaaatatgactaaaacactgattaaagcatatgaatgtctactcagaataattaattttaattctgtaatagattatggaaatgtacaaaattataattgtacagcttgattaattctcctttattattttttaatgttcacataatcagcattaaaatttttttactttaatgtagttttatttttcaataattttgtttttgaaaataatttttgaatagaatcatcttataagtccccagatggagtaaaaccaatttattgatcaacagtttgttggttgataaatatgtttatttaaaccgtgtaatttaaattattttctttagtgctctggttcactttcaaaagtgttgcagtttgtacattacattatgtggttgcctaactaagcattatcaagtacttgtatatcagatatggatgtggttatgaattgtgctatgtcaacctatcaacagagaacagagagtttctgccaggaaatgataatggacagaactagtttccaaagggccttaaatgccctgtatcaagattacctaaccctgtagatgtgggagcctattgtggttttgaattaaaaagtgatatgacaaaagtggtattatgggaagtttaaataaggaatgaatatcatgggtgagttatcagtggcttgagtggtaagcatggaaaacatagaatgactgaagcctcattacagaggaaattttctgggacttacacattgggctggcagtattgagggagacgttggaatcagagaggaggccagttttctcaattttctgattaaaaaggaaaatgtctctattgatagccatagggatttaggaggaagggaaaatatcttttgccagcaaggtgatgtggttttggatgttgaatatgaggagatggtgctgtattgtagcagagattgttgctagtccattggagataaaagccctagtgaagcccaacagtgaggcctgagcatgcagatggggcttttctgtggaagttacttgaaaccatgaaagtgagttcttcacagaaaactgtgttggaagagaata

SEQ ID NO: 93624 - DNA, 1065 bp, Homo sapiens
aaaacaagcagagcacatgcattttgaggaccttgaggtcagttctcattgttcttgatttagtctcaaaataagaatcccttattccaagtaaacttggtatcataattctttgtatctaagatgccatcggttgtaagaagtacctttaagtaccactttgtatagaaaaaaaaatgttgccaataaaactgataagctattggtttttcagatgcatctctatttcagaaatgttaaatggtggggaaaaaagtacactttaacattgatgaaatataatacacagattttgaaactttttacttggttggagtttagagagcttgttttacatgttagcatcagactttaggttctctcagaatgtatcatgttcagcaagtgtggtttggtgcattgaagctcttttcatttaattttattaaaaaacagatgaaagcaaagtggtgagctcatttttaggttgttgaaagttccatgattcaaaaaagtgaacttctaacttttagtttcaacctagtacctctgcttctgccccctcccagtagacatatatccatcctcttttcagtcattacctgtccctctaacaaaatctgttctccataaaggctcctgataacagttatttatagcctcctgtgaattcatggcaaagcgttaaatggcccaagtctgcttgctttctaagctttatctctaattactggctaaaaatctttatctgcttaaagaactttcaggcctctgctagccacatggaacaagttttgtgggaatggctgaaggaggagtgatgtagaggcagcctcctactctgcctctatggaaggctgtggatagagaacagagtacctcattttctttcctaacctaaactgtccaagtaaatctgacagctggctcagtgcctttctggaagtcagtaagaaaggagacttcgatctgcttataaagttgcctttgctgactgttggaaggaaaacaactcataatagctgcatttctgactaattccattgaatttttgttagttttttgtgtttttgtttttgttttgtt

SEQ ID NO: 93625 - DNA, 1030 bp, Homo sapiens
ctgaaggtttttttctcacagggtgtagaattttggtttgcagcattttggttgcagattcatgaggagtgtgttgttttgttttgacctccttgcctctggtccctccactactgtctgcaccttttgtcttacaggtttgcaattgtgcttgcttggccactctgactccagatttggaacttgagtgtgccttctcctgaggtgatactgggattgatacctagttttaaaataatgtccttgttaccagtaaatagattaggaaaggaatatctctgtatgtatgctacatatgccatagggtctgtcactgaattttgtagggaagtttgagttggttttgtgttgtctgggtctctaattctgtttgtttatatgaacgaataaggacggacagtccacattagtattttatacatttagctatgctttattctaataaaaaaagagttcattattgctctctttaaaatttgaccttcaatagagtaaaagcttttagaactttacaagaagctctcaagtgtaactatgaacactggcagatttgggaaaactacatcctcaccagcactgacgttggggaattttcagaagccattaaagcttatcaccggctcttggacttacgtgacaaatacaaagatgttcaggtaggatattcctattccgttatttcagtttgtgtttgatactaatccttgatcatatggtataaattatttccttgaatatgcacaggaaaattttgttaaacacatgtaacatatgaaaagggtatttttttctagtcaaatattcttcatgatatatagaattctgctattctaatgtcaaatttgtttgtacagtcataaactgaatattactctgactcagttatgaaaatctgatatgtgggttacatatatagtcactttgcagaaactaaataaaacactgtgttacttagtactttgggtatctctgtgtgttctctgacttttggtagctggaataaatcctatactcacttgttcattcattt

SEQ ID NO: 93626 - DNA, 1078 bp, Homo sapiens
ttacatgtacacatgaaaggaagtggcttttctatttgctcttattctccttcgcttcccaaggcacatagagcaggtcaaagtggtatgtggtaaaataacaataattaatatttactgagggcttgccgtgtgtctgaaactatcctaagcacttcacatgtattagctcatttaattctcacctcagctgtgggggataggattatactgtcataagctatgtctaactctggatggatggatggatctctccacctgcttgttttaaggaaattaaaaatatcagacaaaataactattcaaagattgtttggaaaagctgttacttgtacatcatagagttataaagtcatcaagataatgccgattttagttaacttagatgaattaagtatggcaaatcttgctaactcgtgtattctaaaagaaaggcaagaaaaagtgaagcagaagtggttacaatagctgaaaaggtattgaagaatgttacttaaatttctcttttcttaccacccctaccacccccagattaggagtctcattctctctcaggatgaaaaaacattcttgctaatgtttagatgatacttctgtatttgagtatctgtaaatgtgtagggagagaggtgatatttagaattatctattggtagtaacagtggtattatagataccaaaggatataattttggtaacaataacctgagtatgtagatagttgattctgataaaactttcagttgtgatttgccctgttggatgccaaatcaaaatcattggaattttaagaacatttgcttagaaatctttcagccggctgggtgcagtggcttctacctgtaatcccagcattttgggaggccaaggcgggaaaattacttgagcccaggggtttgagaccagcctgcacaacattgcaaaaccctttctctacaaaaaaaatacaaaaaaaattcagctgggcttggtaatatgtacctgtggctactcgggaggctgaggtgggagggttccctgaggctggagaggttgaagctgcagtgagccatgatcacaccactgtaccccagcctgg

SEQ ID NO: 93627 - DNA, 1073 bp, Homo sapiens
tgtatttatttctagattatacatatttttattcatctatcataaaactgattttcatgttcctacataattagttcctgttcagttttccagtttttgactattataaataatgtcatgaatatccttgcagacgaatcctcatatatagccatacttctttccccaaggtaaattctgatgttgatttgttgggatatttttccttttcttccttttttgtttttctggataccttgggcaacattttgggaaaataatttaagtattgcattattgacattcatttgttgtttatatgtggaagaggaaggaaaggggattaatatatattgagtgcttactatgtttctgccacttaacacaggttatcttttattgggcatacagtatgtgaggtggatagtaaatactcctcattttatagttgattaatatgaaacccagagagcttatataacttgagcagtcatttggctagtaggaaccaaagacagaaatcacaggtaggcatgtcttatttttttctttgtcacgccttgaagtctgtgggggaagatttatgtcaaaagcacattttcccatcatattaatgtgcttgtgaactatacctaacaaaggtttttaaaaattcagacataatgtgcagataataagccaggcatggtgggatgtgcctacagccccagctacttgtgaggctacagcaggaggattgcttaagcccaggagtttgaggtttcagtgagctatgatcgtgccaccacactccagcctgggcaacagagcaaaaccccatctcaaaaaaatatgaaataaaataacaaaataaaaaaataatttgcagataattttaactacatgtattcttatgtaatcaccaccccaaacagttatggaacattttcattactacagaaagttctcttacatgcatttccagtcagttgaaacaccacctctttcccccatgaggcaactactttctgatttccatctccacagtttagttttgctttttcttgaataccatatagatagaatcatacagtatgtattcttgcatattgagg

SEQ ID NO: 93628 - DNA, 1052 bp, Homo sapiens
tcttatttatttatttatttatttatttatttatttatttattgacaaagtgttgctctgttgcccaggctggagtgcagtggcatgatctctgctcactgcaacttccacctcccaggctcaagtaattctcctgtgttagcctcccaagtagctgggactacaggcacatgtcaccatgcccggctaatttttgtattattattattattattattattattattttagtagagatggggtttcactgtgttggccaggctggtcttgagcttctgaccttaggtgatccacccaccttgaccttccaaactgctgggattataggtgtgagccactgctcccagcctgaaagcttcttttctaagatcagaaacaattcaaggatgcttgctttcacttctgttcatcacagcactgaaagttcaaggcagagcaattatacaagaaaaagaagtaaaagacatccaaattggtaagaaataaaattatctgtttgcagatgatgtgatcttgtatgtagaaaatgctaaagagtccacgaaaaagctgttagaactaataaatgaattcagcatagtagcaggatgcaaagtcagcacacaaaaatcagctgcatttctgtacactaacagtgaacaatcccaaaaggaagttatgaaaacaattccatttacaatagcataaaaaatactttggaattaagttaactaaggaagtaaaaatcttggaccacaaaaactagaaaacatgatgaaagagattaaagaagatacaaataaatggaaacacatctcatgttcatggattgaaaaacttaacattgttaagttgtcagtactacccaaagtgatgtctggaattcagcgcagagactgcagtgaaaaaataaagaggatactcaaattactgaaatcagaaatgaaaatggggacattactactgattctacagaaataaaaagattataagagaatattgtgaacaagtgtatgccaacaaagtggataacctagatgaaacagacaaattcctagaaactcaaagcctac

SEQ ID NO: 93629 - DNA, 1096 bp, Homo sapiens
ttacatgaagtacttagagtagtcaaaatcatagacacagaaagtagaatggtcgttggggctgaagagaggaggaatgaagagttatggtttaatggggtagagtttcagttttacaaggtgaaaatagttctggagatggatgctggtgatggttgtacaacattatgaatgtatttaatactgatgaattgtacatttaaaaatggttaagattctaaattgtatgttatgtgtattttactaaaatgagaaagagtagaggaaaaaaatctctctaagcatccaggtctaaaaagtttaccagattagtttatgatacaccaaacaaactccagatagactaaatctatgctaaatatttttaatctcatagaaaaattaggaatagggaatggaagtagatactgataaaagtgcttgaactctgaagcagtaaaagagagctggaatgaatttttatgatcacatttaaaaatatgtgacaagatatttgtaacaaataagaaagataaaaagctaataatatccttattatataaagagttaacatctgctgcaggaatgaaatggaacagaatagagaattcagaaacagattcaagtaggaatgagaatttaatacgtaataatgatggcattttaaatctgtgggataaaaataggatatttaatatgtattgaaatagctagccaaatgtttaggaccaaaagcttgaaaccaaaataaattcagttaaataaaatatttaaattggaatttcttgagaagcaggatgtgttgtagggaagagcacgtactctggagttaggcagcccatttctgccagtcactggctgcgtcgccttgggcaggttacttaaccactttgtgcctcagtttcatgaaatagggatgatagcgatacctgcctagtaggattcttgtgaggattaaataagttaatagactattaagaggagtaaatgagttaatatatgtaaagggcggggaacagtacctggcagatacatacaagtgctgttttttgtttttgtgttttttgagacggagtctcgccctgtcacccaggctggagtgcaatggcatgatctc

SEQ ID NO: 93630 - DNA, 1571 bp, Homo sapiens
ttcatatgtttattgctttctgaactaaaaccagaaaatgatttccagaagccaggagagtgccctcggaagagtttttctcagtgttttaactgtcttagtctttctgcttaaaaatgcaatgttagttttctagggctacaataacaaattaccacaaacttgctgccttaaagcaaaagaagtttgttctccccactgagttctagagaccagaagtcaagttcgaaatcaaggtgttgacttggccatgttcctctgcagatgctagggaagagtctttctgcaccttttccagcttcttgtggctcctggcgttcctcggctgtggcaccctaactccaatcactgcctccattttcatctcctctcttctgtgtgttcccttcttctgaggaagaagtcattggaattaggccaaccctagtccagaatgacacctcatcttaactagttacattgcaaagaccctatttcaggtcagattctgaggttctgggtgcacgtgaattttgggggaatgttattcagcgcaccacagcttttgtgctctgtttcaggaagaaaacagttgtagcagtagcattgagaacagcggtgttcatgaagaggggagtagatccaatacctcactgggagctgttagtggtagcagaggtgacaggcacagagttacaccaagggaagaccagaaagacctcaaccactcctatgaaagtcttgcctttagtgaacaccaccagagatttgaacatctggaagtgacgaaagagctgatgagactaggaagggagttgatggaaaactaataaaacttttcaaaagagacaaaaacttagtcatatacaatattgggagataagactggaatcccaggtcatgtgggacaaattaggatttgtgagaagtttctgttattagtcttcagcagattatgacattccctgacataccctgaaagaatttgtgtatatggatatatgcatattctagaaagcggatggaaaactctcattagatccgcaagggtgtccagaaccccaaggaaaaaaaaaacagagattaaagaattatctttggagtagactgttagatttagtttccagatgaaaaggcaagtgggcctttgcttataaacatcatggattaaaatttacctttataacttgttacagtacaaaggggaaaatatcactaaatgcatttatttagttttttaaagttaccaatttttttaactttttaaaagttacctagtttttaaaagtttttaagttacctagtttttaaaagttaccaatgttttaaactgtgtataaataatttttaaaacttccttttctcctattatcacccccatttctctggtgctctttttgtagtcaatccgtcaagacaggagtctctccacattatttctgcttcctctcctcatcctctttggaacttacaccattgcagttttatctcccctagtccacttagagtgctgttgtcaagttccgacttgccacatccagtggacagttgctggtcctcaggtttccagcaatattaaacaccattgcttt

SEQ ID NO: 93631 - DNA, 1056 bp, Homo sapiens
ttgtcaaaacaagaaaaaagcacaactgaattttctgtcttcttttatgactgtatataattaagaccatgaatctgagttcacattcctaaaagtatccatgttccagaggagcccctactcctcagccacatctcatgcacggatcagaatgttctaggaggagacagcaagatctcacactggttgcatttctctcagctacgctttctgaaagagttgtattcattcagtctttcaggcacaattatttattgagtcagtgcaattgcaatatgccaggcactatattaaacactggtgatacagaatgataaaatgccatcctctccctgcagttcacggtaaaattaaagatgtgggcagctgtctcttggagccttgcttctcgaagtgtgccctgcagaccgtcaacatcagcatcacctgggagcttgttggaaatgcagaatcttggtccaagatggatcagcatttttatccaggattctgcatttctaacaagctctgatgccagtgctgtcggtccatggactgcactgactagcatggtgttacagtactttcctcaagctggttcttttgctgtcccaccatcaaaggagtggaagattgcggttgtgttttctgtgccttcagatacacagcctaatgtagatatgacagatgtgcctttttataatataacctggtgcagactgcagtttaatccatctgtcagcattcaaagcatctgggatagaatgtgtaaaggctgactgatgataataagatagccaagaagttaggccgggcgcagtggctcatgcctgtaatcccagcactttgggaggccaaggcgggtgggtcacgaggtcaggagttcaagaccagcctggccaacatagtgaaaccccatctctactaaaaatacaaaaattagccaggcatggtggcgctcacctgtagtcccagctacttgggaggctgaggcaggagaatcacttgagcccgggaggcggaagttgtggtgctgagatcataccactgcactccagcctgggcaacagagtaaga

SEQ ID NO: 93632 - DNA, 1023 bp, Homo sapiens
tatatgaagctataggtgtggatccaatcattcagagagaatgttccaggtgagaagagccaagcaccaaacatggggccctttgaatgaaagaagaaccctctctggaagcttttgaagggacatcagagaggtagtcaccatgagatcctagagagtgctttaggattgaattttattttgcttttcaaaagcttaaaggtgatactcttaacaagtttcataaggtttttcattgtcattgtctttgatgatggtgagatagctctttgtttttgttattgtttgttggtttctaacttaccagtttgttctgtgcatttttaaggtccttaaaattctagtcagggcagtgattgatgggatgactgatcgaagtggagatgttgcaactggcctcaaaggaaagctgcaggagttatttggcagagtgacttcaagagtgacaaatgatggagaaatctggaggctgtatgcccacgtatatggaaatgggcagagtgaaaagcctgatgaaaatgaaaaggcaagtccttcattcctcctgagtccttgcctttcgtttgaacatgttgtagtagatctacttttttgatgggtggaggaagagtttaacaatctgaaagataagattagtatgcttaagttcagttctgattcagtctttaacctacgtactttgaattgtgggctggttaaaacttgtaacattcatctttttatttaccatgaagttttcttacatagttgttccctgtttcctgcaaaagggcctcttgaaatggccacccctactaaatctgcagcagagttggcttttgttatttactccatacccctttctgcaggcaccttgctaaagactacagtagatgggtacaaggagagaaggagtatttagatctgagatggggattaggaaaagaaaagagaaaaatgaacaagataaagatcttggaagagaacttttaagtcaaaacataatacttttacaaaggttgccctgccctttctcacaagtgc

SEQ ID NO: 93633 - DNA, 1113 bp, Homo sapiens
gcattgcttttagttattaatttttaaaaatgccagttaaatttggtaatgcatttttatatttatatttgaatatgggtgtgtgatgcagttccaataaaataatgatgcccccaatgttaagaactgaatcacaaagaccttacaccaatcctaaagttctccttctacttccctgcctaactaacttccttgctgccactaataattacaacaaatagggagcaaacaaggaagaatgcaaagggcagagctttaagatcagggagacctaagctccaggaccagctctatcacatgcttgctagttgaccttgggtaaataatttaacttctctgagccttactttcctcatcagtaaaatgggataatacctacccatgaagaataaatgaaaacattcaaacacttagcagtatttcacacatggtttagatattaataccctaccctctcaccaccaccctcttccttccaaagtagaggacttgagctatagatgataagggactcaaaactaaaaaaacaaaaattaagaacaaggataaagtttggcttgcttataaagaagtcacagaacattcagaaaatttagaaattagcttggtagttgataattctacttttgacctttgatatctttgacctaaaggatataaatatctaatttcctgggtcaccaagcacttggcagagaaggtagaagtgctgagctctatatagctgaaagtcaatgtagaaaagttgggggtaattgctaatagagccgtagaaggatgttttgggggtggttagaattcatgtggcttctactgacctcatgatgggtgggctcagttgggatccagtccttatgcttttggtctttgtggatattgtatgatatttggggaaacccacactgatgtattaggtacataattagcaggatgggatttactttgaaaaatttatcttatctacttcaacttgccaactctaagcatttctatgaactgctcgtctgtaacagtcaaagccacgctattttctgaactcaccaagtaatggtattaaacctgtcaaagagagatatgcaggttaaagagatactctaggaaaaatctttattt

SEQ ID NO: 93634 - DNA, 1090 bp, Homo sapiens
ataatctttgtggtctctgaggcctaagcgaaattaattttcaagtaagtagcataaagggtatgatttatatgaatttgaacatagaatatatttgttttgcctgcatacacaataaataaagtcattttgtttagttgaattatgtctgttcattcaaaaaccatcctataacattgaaatgaataatgagaatttaggcaaatgcgttgaagagcagagctcatttgaatttataagttcaggcatgttgttttgattcaccctttaattattttagcttgtacatttcttggctagtgaacagaaaaaaatgctaccattgctattataattgtatagtattattatgcaaaaggttttttaactctatactctgtatctattttattttaaagaaatttgtgttgttttaatacttctgctttgttttttatattacagcaactttttacagatgtggcaactggagaaatgtccagggaattagctgatgacataacagctatggacaccttagtgacagagctccaagacctaagcaaccagtttcgaaatcagtattgattctgctggaagcagattctggaaaaggtgctttcacctgctggtaaaagatacatctgtatatctgaaatgcaagatattgatttttaaaataaatttgttttatgacttaacattcttggttttgtgatgttttcaattttatatgctttctgaagtatattaaatttttaaaactccctatttcgttaggtctaattatagttgagttcagtatttttattcttgaggtattttggcacaaagagcaattaaattaattttgtttttaatatagtgtttattctctttcaacctaacattaattggatcatactttggaaaaccttttgtctaaacaggtgaaaatcacgtactacaagtttgtgaaatcattagattgactgctttattgttcaaaagtgataaaagagtggacttggagctagaaacatttatgtttcttgagattttgtgcttgtttcagaaagatacagacttggcgaaattggaaatgtgagcatggtttaacttctaaatcaag

SEQ ID NO: 93635 - DNA, 1046 bp, Homo sapiens
tcacaacatgcagaagtgcttataaatagatacgtttcaatcaacaagtagcttattcaggcatgtgctcaaatatagtagctgcattcattagacagacatttccactaatcccaagactatactaataaaagagtaatcccttatgggctaaaggtggtgctggtttgcttttaactcttggagtccttcacacaccaaggcctaataataattgtagctgtatttggttttcaccaagtgaacttaacccatttatgccggaggttgcaatttttaaaatttttgcaatcagagcttggtgatgaccttgagcagtagaatataaataactctcacacgcttagcgttccgataatggaacactaagcataaatgggttaaaagccgagcttatcttggaatttttctattcttatttttttaaattgcaggagcttagtgaagaaagaggtgctttttactctagatatgtagctttcagcaaagccaattcaaaaatcagtttgtgtgtgtgtatgttttctcgatactttatcataaagcacttgtctctttcaccttggttcatagaagtgttcgcttgagcagattctgttttgttctttgatgttaggataaataacaatggtcagttttgagagcatttgcaagctctcactatagtggtttgcctttttacgtggactttttccccttcaatagctctttactcctcctatgttactcagagctagctgtaatccgtttgcttagcacaacaccaaaatctttcccttgccagtggtgtcaaatctgccttcctttttattattctgacttataaactgcagtgacctctgagtcaacttcgccatctcttggccctgtgccaacattgtgttctgtgaaaagagagtcctgccaagggctacgaggcagaaaactgatattattaaagtggtcttctgaacggtaagtatcagccattttctaatcttttgtgatgttattgccagaaagggggaggggggggtaaatcatgttaatgttgttaaggatctaac

SEQ ID NO: 93636 - DNA, 1692 bp, Homo sapiens
tgctgcatatttccacatatataataagttcaaaaagcagattaaattaaactgtgttatttagtgatgcatgcttagtataaaaactataaaggaaagcaatgaagtgatcaccaccaaagacaggctaatgactactcttgtgggtataaatgggtggtggatgaatggtactaaaggacttccggggagctggcagtatcatagttattaactgggctcatggctaacatggttcttctggcaaatcatcaagttatacatttttgttttgtgcattcttcccaaatgtgtgttgtgtttcacagtaaaaagcattaagatattaggaagagtgcagtcaactcttaatgtgaacctgaatgtctgccttctcctctccacgtttttgcacttttctacctctttgtcttttccttctttttgaggagacctgagctctttcctcaagtaatttttctcacaactcataaaattgacttttgaaaaatcatactgcattttgaggtgaaacttggcaacacaaacccaaacttaactccatgtaactttaactccccacccacccccactaccaaacacctccttaaacaaaatataacaacattttacaactataaggtgcttttaccctaaggcaaaaatgtggataatttgacattgcactctaaattctttatttcttttgtctaatacagttaagatcctgtgctgtctggataaataggggggtactaacctaaggcaacccaggccagcataggcagtgattgagtgtggtcatcttggtgaccaaagccagcttctcacatttcttcttgaaaagcatggtgctgacatgtttaatatcctatggcattccctttgggctctgtagactgatggaaaaggcccctgttaacatctgatggccaagttgaatagcacagccttgagaccctccacttcacagctccggttaggggggtgatttctcaccaagttgtagtagaaataccgatagtcatatcctggcaggatccacataccaccggttatagggagaacacttttgtgtgcctggatggttttggacaaacaaaggtgaaatctcacccacaacttcatagggaatgataaatcaaaatccagcacactacaaaaaagaaaaagataaagctaaggtttgaagtttttctggaagaattccaaaaatgcatatttcaagggaatgtctcagggcaaccctaaatagactggtgacctacagatcaaagacactgtattttattagccgtctcctgacccagccaatccaactgtccttccctaactgttacatgcatccagataaaccctcccctgtctgtctttactttcttcctccgagaatcacaaatcaaccctgacaacatttggtttctcatcttaaggaatgttgctggtacattctttatgtgaaagaggcaatcccaggaaggggtatgaaccagactgaatgaagagtatcttatttcatctgcacagaacaaaagagtgtctttcctttcccaatgcctgcaagagtctaaggacttgaatgaaagcagactggctgagcttagtcctaaggatggatacaaggctggcagggaagaggggttctctggggtctgtggggtgactttccttcctccatgattgttcttataatggagtcctgtcttgctaagg

SEQ ID NO: 93637 - DNA, 1139 bp, Homo sapiens
acccttggtgctcagagatgcagtggtggatggcatcatccaggagggtgtgatgtggctggagttcaggtgacctagagaacggtctcaggctgtcccccatccctcttggcttggcatcgtgcttgccaaacttgggagtcgagcccagagtgattatatatttttttgtatgcctgctatggccattggcagctgctttgccaatagatctgcagtgaggtttaccatgacaactgctaggagggccaccccggcccccatgtgggagggtcagctggagaatcttgtcatgtgacacagacaacctcggtgaagagagaggaacccagaggtcaagttcacactaggtcaaatatgtgttctcgagactagttaaaatccacatttaggaaccataacactgtaatagtgcttaaaccttcatgatgaagccctcctccggcccatgggcctgctgaggatgccgcccgccccctgcctgctctgctttatcgaagtttttgctgcccagtgaaccctgggcccttaggaagcctgacttgttgaaaagacctttgacaaccacagggttttgctgtttctgaccctgttatttgttgtcttggatatttcagacgtactcaaacatgttcgagagctcaaattaaattttcctaaagtgcagattttgcttcccagtccttcctagcaatgaacagaggcgacttggagtgtgagggctatgtcaccacccttttaatacggaccaaaatcaggtccagcagagaggagctgccgatggggtgggggtaacttgtgtggtgctgtggagcttacagagagcattttcttgatcttcacaccctgtagtgtcattgaggcagggatgctttattaaccctattccagacagtggggcagtgctcagatgccactgcagatcttgtggctcttcctactgccctgggcttcctggacatccagtgctgtgacattctttcttgaggtcttggtctgaaaactgtcctgacagtcctcagttatctggattggcttccactgcctaacttcacatcatgattttccaagctatgtgagttttctcgggcttctgtaacaagttccacaagctgggtgacttagaacgatagaaatgt

SEQ ID NO: 93638 - DNA, 1002 bp, Homo sapiens
aatgtatatacagtcaaagattgctgcacatgcagtttttacatccagtttttctttagttagttgaatgtttgaagtatatatgtgtatttttgggagagctggaaatttgcaaaattgttgctgcatcagtgattatgtagagtgccttttaaaaaagatttaaacactttggaacagttgggtgttttcttccactaattttttttaattacaaaatttttaaagttatatacatgtatatttttgcgagagctggaaatttgcaaaattgttgctgcatcagtgattacatagagtgccttttaaaaaagattttttggaacatttgggtgtttttttccacaaattttttttaattacaaaatttttaaagtacacacaaacatagaagctgcccatcagggtcatgtttttaaaagctccctgatgtggtagttaagtacaatgatttatacataaaggagaaactatggtcttatctttctgtaaatgcgtgttttactaatggtttcctgctttcttagtggagagaaaatattacataatttgttggtgtgacacaaattggttgttttcgtacttatggaaaaatacatcagggttgtatttgcaagcatacctcagatatggagggttcagttccagcaaatatctcaataaagtgagtcacaaattttttggtttcccagtacatgtaaaactcatgtttatatactatattgtagactattaagtgtacaataatagcattatgtctaaaaaggcaagtgtataccttaattaaaaatattttgttactaaaaaatggaatgatcaagtcagccttgagtgagtcattatctttttgctagtggaaggtcttgccttgatatggctggttgctgaaagttggggtggctgtgacactttctttaaaataagaaaatgatgaagtttgctgcactaattgactcttcctttcgtgaaagctttctctgtagcatacagtgctgtttgata

SEQ ID NO: 93639 - DNA, 1068 bp, Homo sapiens
acaagcacagtcaacacaagtactataaaacacgagtgcatgcaagtgtattttattactaagaaattaaagaaaataaaggatttagtattttttaaggcatggaaaaatatcttacgtagaaaattcattagatcactttgattgctattttttattgatgagaaaaactgcacgtggaacagtgaagtacccaagtccacacacaaattattctcatagcctgaccacctgcctggtgcccagattgccagaccagccttgtgctgactggacctccgggtctctgccgagctctcgtggaaaggcaagaccctcagcagggagctgcgaggctgcggtttaggatgaaagtgtgagggtgaagaaagccaagtcactggtcactattgtgttaaaagtcaaattaatggggatccttacatggtactaaatttaaaaaaatgttcaatcctttaaaaattgattaaaaattttattttgatgatcatagaaaatctacagagagctgataggatgtgttaaagtggaagttaaatatttttggaacatttgtatgctcttctgaggttttgttcatcccccccacctcaacatctaatttacacgttgaattagtcattgactccgcctgccattttgtggtaaagatcaagtcaaatgaggctcatcacagtgcttcacaaaaggggccgggtgtggtggctcatgcctgtaatcccagcactttgggaggctgaggctggcggatcacctgaggtcaggagttcgagaccagactggccaacatagtgaaaccccgtctctactaaaaatacaaaaattagccgggcgtggtggtgggcgccggtaatcccagatacttgggaggttgaggcaggggaatcacttgaaccaggaggtggaggttgcagtgaatcaagattgtgccattgcactccagcctgggcaacaatagtgaaactccgtctcaaaaaaaaaaaaaaaaatccttcaatgcttcacagaagggccatataaacataaggtgaccttattaataaggtttttatgaccagtttgtacact

SEQ ID NO: 93640 - DNA, 1052 bp, Homo sapiens
tcaaggtcccacagttactaagtgacagtattacaatttaaacagaggcagtcacgtttcagcatccatgccctgaaggaaggagttggcaaaaattttctgtaaagggacagatagtaaatatttttagctttgtgggacatacggtttctgttgcatctactcagttctgccatggtagcacaaaagcagccatagacagtgtatgaattaatgagtgtgactgtgttctaataaaactttatggacattgaaatttgaatttcatataaatttcacaggtcatgaagtattattcttttttaaatttttttctcaaccattaaaaaacataaaagttatccttaacttctgggccataggaaagcaggctgtgggctggatttggcccatgaactgtagtttgctaactttttctctaaaggatagtagtgctttttttgtgtgtgccagaacatgaatataactgtgtgtccttggaacggtataaagctttgattatatcatagctagacatctcccttccaacattgttttggatattaaaaacaaaaaacaattctgtgttgaactatgctttggcgatcaagagtcagattactgtgaattgcaattagttttttctagcattatgacttacataaactgtaaagtaatttacaagcaacattattcatcttcaatatcaccatccactgttagaatttgaccctctatgatgtatatatatggattgttagtaagaaccgtatgtcggatgtcagataaaggaacagtctattttttttccttccttttggtagccgcggtgtactttagacaagaatgttgtgagtcaaagaggaggctaaggtttcagctctgactcagctttggtaaaataaagtcattaggcagtttgctttggagacttcatctgctgaatgaagatgcttttttatggtagcattgttataggcatgtatatatgggtgtgcctactggtgcacttttaagtaaagagaagagatgagaagagatggccttgggtgccatcaatcctgatattaata

SEQ ID NO: 93641 - DNA, 1028 bp, Homo sapiens
actgttttgggaaggagtctatataaagctaaaacactccctgcctcctgtctctgacttgcaggccttgtgccattgggaaaaaaaacagccaggcctatggtttaaggccttctgggcatctgactacctgcaccccagcactgtctacacagtttgtgtacatgagtatttttatggggaatggttacagagctcttctcagcctcagggaggcctataatccccaaacggctgtgaaccgctgttctagagggtgagattggcaaattcactacagtgatggcacagcaaatgttccatgtctcagcttgaaaacattatggcaggaagtcctgcgtcagatgaaattaggtatacattaaagtagtgggattgagcccagagccttttcaactcttgtatataacagctttgattctcttcctgacataatgagtctataataattggtcaagaattttttttttttacttattaaaagaaccacctcagataatatgttcctgattatgtaactataattataaaaaatcgtatattattgtgtttaataaaaaccaaaatttataggctgggtctaatatatgcatcttgccatgctatattttggagaagacagtagagtgtaagctatgatctttttgagaagacaggagccacgtgcgcagaccatgaagtccagaggagggtggtggagggagagagtgtttcaggctagaatggccggttttagctgtggatggaaaggtagtatttgatggaccaagaggagaggaaatctgtaagcaattgctcagaggaggaggaagtagaagaaggaatttggctgagcatgttttacatgaagtattcctattaggggagtagccataagtgagggtgagaatgcaacacaggtgaaataacattttgggaaatttatctggtggtggaggaccaggcggtggaggaccaggcatagagaagggaagagactaaaatgagagacggtgtttaaatagttaatgcaatcacatagtcatgaa

SEQ ID NO: 93642 - DNA, 1097 bp, Homo sapiens
ctataaataaataccagagactgggtaatttacaaagaaaagatatttaattggctcagggttctgcaggctgtacaggaagcacggcagcatctgcttctggggaggcctcaggagcttttactcgtggcagaaggcaaagtcagagcaagcatcttcacatggccagagcaggaggaagagagaggggggtgaggtgtcacatacttttaaacaaccagatcttgtgaaaactctgtcacaagacagcaccaaggggatggtgataaatcatttatgaagagtccacccccatgatccaggcacccccgaaccggccccacctccaatattggggattataattcgacgtgagatttgggtggggacacagatccaaaccgtatcaaaacgcattgttgttttttacttttatttacaaaccaagcccaaaactctcaaacattatattgttaaagaaaaatcctgttgaaattgtaataacaaaaattgtgttcgcttttgaacaagattacttttgcaacatcttggtgggtgtaaacattgaggtttaggcaaacaaaaggtcggcagcttgggtatcagtccactgaaagcaggatccgaacaggaggggaagtggtgaagcgggtgaactcacccttgtagattttgaggttgagtggcttacagcatgttcattcaggaagagaggccagtatgcagttgcaattgcttgcagcctggaggaaggtcacatctagatgcataaattttggagacaatttatttgtcactgatgcctttggagacggttgagacccttcattaatcatgaaatgtgataactgctgttgtaacagcatgaacttggtgttaatcacagagccaatattattaagtgatgttaagtgttgggaacacaaccagtattttctcttaaggaaatgggaaggctgtgtctctgacctcacaaataaatattctggagggtggagttgacagaattttagtgaagcaggtatccagttagcacaggcccacagtgccaaccaactatgaattttgaagcagttagaccttacctaaaattagctgtgctgttaaaagagtgaata

SEQ ID NO: 93643 - DNA, 1047 bp, Homo sapiens
agccatattaccaaactcttacttatatgttaccttaaggcagagctgttctcattgcagaatgttaccatttgaatgggaagctctagaggtcgagaaacgatcagtgactgaaaaaggaagttacagaaggttattcacgaagggaacattctttcatttcatgaccacctgacgcactgtcaaattgaggaagccagcattcctaatgggttttttgacctggaaggacattggatactctgaaagaggaagctactctaataaggttggggcccccagactggtaataactggttaacttggggagaccttgccgagtgttaattaaatttgcattacaggtggaggaatctgatgtctggaaatactttcccattccatttaaagggtaagctgcagatctctaaggctctctttgtgacttttaagaaaatagcagacaaagaaggcttttgtgggataaaaaaaacacggaaagtttcttgctgaaacttgatgagtctgcatttgcagcacatacatgtatcagatttttttgtgtgtgcccagataggcatttttgcttttaaattttcagctgagtctgattacctaattagttcagattggccctttcttggggagacagggaggaaagaggctttgaagttgtgaaagggaccatgaagcagacagggttctgggggttgggaaggtgctgctggtgggaggcgtcctggaggcttctgtctttatcctcattgcgtctgtagcagttcatgcagaggaactcttagggatcccgggtgatagcagtcactgggctttagggaactctgttggagagcctgcaggcaagtggatcaaaaaatcaaactgttgagaggggtgtaacatacaaagcaaggttacatcccttacagtccgtctccttaccacatcccactctctggaaaccaccattgacaagagtttcctgtttattcttataaaaaactcctgtgcgcaaacaggcacacattgcttttaaacacacatgatttgtttgttctcattattcagatt

SEQ ID NO: 93644 - DNA, 1016 bp, Homo sapiens
aatttttgctgtatctaggagacctaatgtaagatattggaacaagcagttgtctctagacttgtttctgccattgttgacatttacttaattttttgatgttgcataagttatttaatttcttttgcaatcagtttcctcacctgtagaatgaggagactggactaggtgatttcctaagtcccttttagctgtctgaacactgcttttcatcggtgaagttacaactggcctccttcaagaatgtagagtactagaccattatcacatgagttacagataaggtctggggaattacataaagtcatttactgtaattggcttgcagtactctgtgagtaccacataataatgctattttattattcagtgtgttagaggttacagattccccagttgccagagatgtgatgaatccccttggccttggcaaacagactgctttcatgagttgcactgcacatggttataaacccaatggctttctgagctaatgtgcaaggtaatgccatcttccaaatgaaaaaaaagttgcatttacccattcctctaacgagaatatatttctcctcactttaaaaataactccattaccaaatgcaaatatgcataatgagatggaattatttccaaatttatacactatatagtttttctagtgtaagtaaactgttgctatgaaaccaaaaactaagaactttactgccccttttgtagtctaattacttaaaaatgaacaaagaatggttttattctgtgctttttttaaagcaagaaaatatatatcagtatataacaatagtgatcttgaataaaggaaatgtgtttttaagatatagatggggcaaatttttcttatcagactaatggcactacagatgacaattacaaactctgaacaaaatataaagtgaactatttgaaggcatttgagagcaataaaaagcagactgaaattggagggaagttaactaaagaaagaagggacccccaaacatctatatataaactcttcc

SEQ ID NO: 93645 - DNA, 1033 bp, Homo sapiens
ctgataggccacacgaagtttaagatagctgtgaaacagtagatatggattggttataaatatttccaagaaacttacccagcaatatgaaaacagcaaagaagaaaaaccttctagggtgaaggatcatgtagtttaaattcctcgatgagcagccttcactaccagataaaggttttagttataagggcccaagagtttataagaaacaagcaaattcaaggacatttctgggtgttgagactgattttaagaaatcaatactgtatggctccagaatattctggagtcagactgattttttttttccctagggaaaggtaatacaaatgaatttattgtttgcatgtggggaaactgtaaagcaaagaaaaagaaaagagatggtgcctcctcagccttaggatacctttgccagaaattgagggttttagttgattttacttctggattgggaaagaattttgaggaaattaatcattattagaacagaaatggtagctttgattcaaaataaaataggcccacgcaaaatactgctcatgagatgtttcccagggacttaaagtagaatgctttgtcttctcatgaattagattccttatagaagagtccccttaatgttgaaaatgactgcattggagtaagtccatccccactttgacataaggatccataaatacctttctttctttcttttatttttgagatggagtctcgcactgtcacccaggctggagtggagtggtgcgatcttggcttactgcaagctccgcctcccgggttcatgccattcttctgcctcagcttcccgagtaggctgggactacaggcgcctgccaccacgcctggctaatttttttgtatttttagtagaggcggggtttcaccatattagccaggatggtcttgatctcccgacctcgtgatcctcccgccttggcctcccaaagtgctgggattatagacgagagcactgcgcctggcctgtaaatacctttcttatattttatatgtgacatttcttaaaaag

SEQ ID NO: 93646 - DNA, 1293 bp, Homo sapiens
tcagagcccaggaggttttggttttcttctctgccttgtcttttgactctttttttttcttttatgcagaatttaaatttcgtgaagtgtaataagtcatttccttcactatgtctgcctcggtgtcggaagaaaattcccaagccctctttatgaagatggtagaagcctgaggcattcaactcctttaaagttttgtgacttccagctatcagttgtttgagtaaaagtcatttctctgcctttcacattgtctgcccttcctgttgctttcccttcccattgtccatcttcccatggattctcagcctcagttcataccaggcctcttcatttccaacccccgtattccattcccatgacactcccctcttaccacattctctcttccagtcctaaaaagagaatcaccaggtgggacatttgttatagatagaaaaggaggataagaatatagactattttctttggcctgactgaggccaaaggaaggtgggaaaagtggagaaatatccatagacgtgtctgcaaagagtcaagagacaatggagggttgaaacatttggttgtgcctaggtcagtgaaaatcatggagggaaggagtattttagttgagtcaaaagggtggaatgtggggaagaagaggaaaaggtttttagggaaaggaaactgcatgagtgaggtgtctgagtggggacctgtggacagcgtggcttggctcaggccctggctttacatggagatgtggtgggaggcgaggctaggttggacctaggtaggaaaggggcttactttcccttaagggagtttgattttgtcagaaatatttgtcataacaatgatataggatcctaattttcaaagtgtgtggtagagataatttgggaccctcgagaggaatggccccctgtttagcttgtgagtaagccatcaaatgtgttccttggtaaacaaatagcccagtagatatctatcatttagtcagacatgcttctccacatacagataggtgttatttatagaaatggtcaaatgcctccatttacttgctctttgaaagacaacaaatgtggggataaataaaacctaactgtgttccaaaattaagggacagaaaatttgagtcatgtgaagcatatgtaacccactgtggttataaagagcctatgcaaattaggcagattgcatgcgtagtagagatggaagacaggtaagtgtgttgattgctctgctccttattctgtttacagagagcagtgaagtcagtcttcttgtcagttgcacatctgcaca

SEQ ID NO: 93647 - DNA, 1118 bp, Homo sapiens
ggaagaggcattagattgtgaggccatggggaaccaaattaggattaatgtgtgcaagttactgtgaggccagatttcagctcaataaaaaatagtacttgctgggaactgccataactatcatgtgcttttgtgggtaatgagctgcccgtcactagagattttcaagtaaaggttacacgaccacttgatacgtggaatgcaaacagtggatgagagatggttgcgttagaaaacctctggggccccattccaaccctgaaattggaatggcttctttggttaaagttctttgtttccaagctcagcttatgaccacagttttaatttgttgagggtcttatagaggcatcttgggatgattttctgaaaatataatattagccaaaccaaagcagtataaagagagacaagcttttctggtgggcaaagatggtataaaaaaggctggcccagagcctctctcccctttggccactccagtcatggagtggcgtcagaagggcactgcttcttgacggccttaaagcctgacagatgactggctgtcttcagctactgctaccatctttgctttctgcctagtctcctggaaagaggaaggacctggctaggggcctatcgcagatgtagcaatcaaaacagtgtgtgtcttgcaatttgccagagagttcaggttgcgatccagcagtgaagggcaggtctgggtgaagcagaactgcacagagacagtgcagttctgccgtcatagcacaaaagcagccatagacagtacagaaatgaatgagggtggctgtgttccagtaaagctttatttacaaaagcaggcagcaagctggattgggtccctgaactgtagcttgctgacctctgatagagacgttgaaagttagaagtgtgtagaaaatgccagtttcaattctctcaagttttggaaaaactgaactgaactggactgaaatggcatgtccggagtcacaccgtggttgagctgggattgtaaaccaggatatacttttagtctagggcttattttgtgataccacatagcctcggctgtgtggtcaggtgatagcatttcgtttttaagagaaggccacgctaatgaaagaaagctc

SEQ ID NO: 93648 - DNA, 2026 bp, Homo sapiens
agttagtgagcattttaagattcattctccaaatttatatcataaagaaagaaaataagaagagtcagatgcccttccattgccaatttaatgtgatactgtcattgatatacttattaaaacttgattttctatttagttgaagggtatgggcctaaggaatggtttactgttcaacctcattatcttgaatttagactcatgcaatacttactgaaagactggcatgactgagtgttggcttttcctaagatttggttggggagaaaaaaaaaaactttatgcaatactgagagatttcgttactctgagaccaaacttcattcagatgcccatcagcttcaataagaattggtctggattatggggactttataagttttcctagtgtagagattcagcccaattttcatcagattctccctagaagaggtaaaaggaaaacttgttgttagagtttactacagtgaggaaagcagaccactgcccttctcctggcaagttaggaagtatcctagagcattcttagctaaagtcttatttagcaagattagaatatgtcacttttcgccactgcattgtccttttctgaagaaaggatgatttatgagtcctctggatcttcttgtattaataacatcttgagccagctgttttattgggtgtacacagagggtaattagaaacatctgagaatcccatagcgtgcccagaaaaccatgacgctgtgtggaaatgaaaaaaaataacattaatgccaaaattgtgtacttggtaaatagatgaataagtattcaacaaaatttcctttgtattataccattttccaaaaagaagctaaagtctaaaggctgaaaatatccttttattgaaatacactcactgcagaaatcataaccttatttggtaaaagcctactgactctgctgttcatacagtaattatcatttcccttctgtcaaagtctatcatattttggaccattttgtgccagaagaagtatttcttctttttacctggcagttacttgaaaattttagacttctgaaggatctcatttaaggaaattaactcttaaaagcactaaaaggactaatagtgtccaatttacgtaatagtctatcctaaaaatcgggttgggatgtaggagtttgggctctatttcagctggttatttgaaatttgatctgctgcagtggtggctgagtttgaagtatttgtggatgcagcagcaacagccactaagttcttggggcttgatttaaatcaggcactgctcttcttactctcaagacaaaatctagacaagaaaacctaacaatttggtggtggcttgtgaatggttcctttcattttcattcacaaataacaagcccctatgagaagtcaatgttgagtcacacagacatagcccaggcagacatgggcagagcggagggtggaagcctccagtgtctttccagcctgtcttgctttgcatgtccctattcagtatgccatttttattctctttaattgttttgaatggattcctcattgatcacatgtattagtccattcttgcattgctgttaaaaactacctgagactgggtaggtttcaaagaagaggtttaaggaactcacagttccgcaagctgtacaggaagcatggttggggaggcctcaggaagcttacaatcatggtggaaggcaaaggggaagcaggcacatcttacatggttggagaaggaggagagagtgaaatgggagatgctacacacttttaaacaaccagatcttgtgagaactcattgtcacaagaacagcaagggaaagttcgcccccatgatccaatcacctcccaccaggcccctcctgggcccggggattacactggggattacaattttatatgagatttgggtgggaacacaaatccaaactatatcattacagagatgaagttgtagctaattgtgtgttttgctagaggttatcagtgacttaatgaagcccctggaaggagaagtggattcacctgtgta

SEQ ID NO: 93649 - DNA, 1045 bp, Homo sapiens
gaatggggggagaaataatgtggtaacttaactttctaaaaatattgctacccatcaccaaccagccctgcaagggatatcaacaaaaatgctgaaggcctttaagggaatattattctaatcagagacaagtgggaaagtcaaatcaaaatcatgtgtgtgtctgttctgcaaaaggacagatacgggttttccttcagatggaggtttgttttccctgctctgcctttgccacgataacttgaaatggtctgtctgctggcacagaaagccagggagcgggtggagtggccaggaccctgctgcaggaaggtcaagaacattcttagagtgccttttgggaaccagcagccgaagtatttttatagtcagctaagataacaggaaagaaagaggcagggtctgcctttttatggtataaatttttagaaaattcagtttgcccgcatttatatacaagtcatgaatatttgttcatctaaacaaggttccaattcgtggcacagaatgtgaatattattctgtcagcccaattacttgagtactgcaagttgttttacagaccaaagtgaatggtggaatacaactgaaacgcctgacttatttaaaacctccagcttgttgttcttccagcatggatccttttgctcattttgaccttttacagttgtaccgtgagatactttgagtgaccgtcacaaaattacactttctggagtaacaggctgaaggcctacctcttgttaattgcagtagttcccaggtgactctctgatgcaatatagtgaattatggtgatgaccagcaaagtatcaagctaacaaggttatggaatgtctcagccagcattctgcagttcaccttcctgtaatattttctaaaatatatgccccatggctagccttgtaaccagcgtaccacaagcatctcaagtcaaccttaacaataacgtactcttttcctcttgatgttctgaggttttatagaacttgggaagcacagatgatacatcactagatgatgttttgagagtggcatgaacttt

SEQ ID NO: 93650 - DNA, 1053 bp, Homo sapiens
gaatttaaaagctttcactgtaatacatttagagactttttagaaacaaacttaaagtttttaactgtttaatgggagtgttgggtgagtgtgaggtgacatgaggccaaggaagagaaattggccttgtgaaatgaccaagggccaatctaagaagtcaagttgaaaaaaaaggagatgactataggggattttgtgaggaatcaagcatcaggattgcgttacaggctgttgtgaagacaaggatgatgaagaaatgaacggttctgaattttcttctaaataaataaatgctaaataaatgctaactaaataaatgctcaccagagttgatttcttgacccttagcagggaggattgtgagaagatgagcaatgacatctttgttacaagcagcctcatccttgattaatattaggaagggtgtactcttaattatcagtcaaggaagtccagggtgttttcgagatggaatgctagagaattaatggagaaaattcagtgatcagtgaatagatttgctgatgatagcttaaattcatgaccacagaggacatttctttggattgcattataatgagaaaagagcgggaataatggagttaaaggtttctgtaatgttttctcaccttgacagagaatgccaacctgtagggaaaaaaacatttctattgttttgtttttgtaaaaagttacgtttagtatttcagagttctaaaaatatgtttaacaatcaaataaatcattggtgtttatgtgaattaggctgtctatataggcagtctctataggcatcactaaatctcctatattcaaagaacagaaattgatctcatagaactatatagggtgacagacaggagtggttttcttgaatataaatcaagtatgaagtagttggccggtcctaattttggcagagttaggtttctgtgctacctggagtaagttgtggtagtctacatatatgtgaaaacatttgcaagagtttgctcactgactgttagaatgacaattccagtggttacaatcaccagccacttcagggtaatc

SEQ ID NO: 93651 - DNA, 1063 bp, Homo sapiens
ttatggggataagttgtttgttggctgggaaggggcacaaagaaccttctcaggtgatggaaacattctttttttttttttttttttttttgagacggagtcttgctctgtcgcccaggctggagtgcagtggcgcgatctcggctcactccaagctccacctctcaggttcacgccattctcctgcctcagcctcctgagtagctgggactgcaggcacctgccaccacgcctggctaactttttgtatttttagtagagacggggtttcactgtgttagccaggatggtctcgatctcctgacttcgtgatctgcccacctcggcctcccaaagtgctgggattacaggcgtgagccaccgcgcccggccagaaacgttcttaatcacaatctgggtggtggttacaccacaagtagatatgcaaaaattcatctagttgtatacttaagattgatatattctagtgtatatacgttaaatataggaaacagaaatctaatctctaatttgtagtagctcaggaaatataaaaaaatagatgaaccaaggcagttgaaggaaacagtttttctggaagctgtgagaatgtgtcacaaaggaaggcccaggcttcctgggttcttcgggccaaaattaggggaagtgttggtgccagtgccggtggcacaagctgattaaaacagtcataacaggaagagtcttacacgattcttcgtctttgtggatgtttctgtttcttcctgtctatacctgataggtttgcttggtcattttgtttgttttcttccgtctgaattcctgtcctccattcccatggcatcagagtcaaggcagtaagcagtgtggagagtcaaagaaggggcattggaagagggtactaggcattggttgtaaatcaggtatttatgagtctggggggaaacctctacattaacctggcagccagccgcaaggctgagatggtgctgttatagaaaccacctagcaagggaaaattctgggtcctcaatcttatcatggaatgtgtagtggtgcagccaatgaacaggaatacaggcca

SEQ ID NO: 93652 - DNA, 1209 bp, Homo sapiens
atgtgctaccacgcccagctaattttttgtatttttagtagagacagggttttgccatattggtcaggctggtcttgaactcatgacctcaggtgatccacccgcctcagcctcccaaagtgctgggattataggtgtgagccaccatgcccggccacttttatttattttttaatgtggctttggtatataatgagctgcatctttcttgtctagtttgaaatttgccatttggttgacatgttcttcatgagtttactgccattcatttttaacgaagcttatctctcttaactctttgccctaaggtgagatatgtagaggtgataaaataaagacaaatgtagtaaaataaaaatgacagtctcatttattacttttaggtgagtttgttgagtcttttgaaatgttatcactaattactactcttttcctttaaaaactgtcaactgcagattaggaagttttacacgtaagtcctcttttctgtgttcttttacaaacagttctgatcatgaagcagacagacacctaattataaggctttcctaacgggtggtaaaattagaccataaaattacatttgcacacaaattacctttgaaactgatgcaaggatttggaaatttcaggccaaaaatcacattgttgatgacatccagataacttaggggatcatttttggctgatttgaatcacatgaataaatatgttaaatcattttataatttaaatgtaaagattgtagagtttggatatagagtttgttgtgaatgctttttccacccttttataatttgacttgtagtctggttacaattcttatattgaaggttgctgattaggtaaacttgcagaactagtcacaaaacgctctgtgaaactttgaccagatctgatgtctagagttgagggcagacatccaggttttaataagattatagaaatctgccaatgagatttttgaaacacttgcacatttccttagcatttattttccctgtcattgcccaaataattctgaacttattaaacaaccatccattcttatttgaaaaataaataattcaattttatggttcagctacaacagctgaactgataagtattaagagacgtttgttgctagttaagtgttccagttgagagttcgaagtgaaaacctgggctctttaccagtgttgagtgagaagatttatttctctttcc

SEQ ID NO: 93653 - DNA, 1030 bp, Homo sapiens
tagttaccctctgtatccatggttatgcatcagtggattcaacccaattggttggttgaatctgtggatgcagaactggatatggagggctgatcatactatgcaattttatgtaagggtcttgagcattgcagattttgatatccacaggggttatcctagaactaatccctcatggatactgaggaatgactatgtaaataatatgatatataaaatatatgctaagtatatgctatatataatatgtatattctgatttgggtaggataaggaattaacagatggaaaaatgtttagtaaaaaaaaagttggatttttttctttaaatatgcaagtttatcagaaattcgagcaatttgcttacattttgcacctgtttttgaagttttaaaatgtaactacattagtgatgatttattaagagctattcatcatgatattttcctctgtataagtttgcactgttagatttttaaaaggaatattttcccatcccaaatctagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaaggtgagagcggtaatggatcatggactctagacatctatctgtgtgtctttgctttgatttccctgtttataaccctctagaacagagtttctcagcctaagcactattggcattttagagtggagaattatttgattgggggctgccctgtgtattgtaaaatgtttagccactgctatagaataatatgtacctagtagataacaatattccatgctaattttagaatgctgtcctgatgtttgggggctgctttatcttggcgtttatatctggagagtaatttagatccttc

SEQ ID NO: 93654 - DNA, 1194 bp, Homo sapiens
ttaaatatagtaacatctctattatgcatcatttggtttgagttaatatagcattcagttattccaaaaaaatttattgagccattgtcatagattgggactcttctcagtgttaggaaaacaatagagaacaaataggacaaaaatctctactttcatgaagcttcaattctcgtgagaagaaaatgggaaactaatgggaatcaagggcataaatagaattcaatgtcacctgatggcctggaccatctgtgaaagaaaggctgtgacatgcttagataatcatgtattcttagagcacatatatagttagtgaagtacttcttagttcaactaaaatttaacatacatgtttgaattgagtttgagtaagaacagaacttacacttaaaagttacaatcaaatactagaatgttgctttttgaaaagtcagtctattggcttttgggcatagatgggggctatgaattgtgagacattttagtaggaaatgtaaacatttactggatctaagtcctatttatgtaatattgttccttctctgaatccggctttctttctttaataaaaacatccattttcattaaatgaatgaactttatgtcagagaactactatgatatattgctagactaaattatcgttgcattttgaaatgggatctcaatgcatgtaacaggctttaattttctttttatctccttctgcataataattacatgaaaattaggtaattattaaatatttatacatttatgtaccattctttaagctgacaagaatgcattattagaatttagatgaggcaatacatacatgagttattttaaatagtattctaaatcttataattatgggatagagtaacatatatgtcataacataagtgctgaaataagaaaaagagacttacaattttggagtgatagcactcgtccagaaagaggttatagtattttgagaccaaaaaatgtataacagatatgcatactttttgtgtacttttgaagctcttagcatctctaaagatcagtcacagcgagtagtttgcaattttgttgattttgaatttagtcctggttgatgtatggaagtaattatttagcttgtaggtgggccagccagcatcctggcagcctcatcacgactcagttcttctgtctttatgattgaatttaataactctcattaaa

SEQ ID NO: 93655 - DNA, 1752 bp, Homo sapiens
tgcctcacggtgatgggggaaattctgtaaactgcagtagtggattaacacctgatcctggtctgttccttgttggcattggccatggctgcagggaatggggtgcaattgagactggttgaggtcatctctagtaagtaatagaaagctagttttaagaagacagaggaaatgtgggaaaaactattaagtgctcagtatttgtaggagctgaattttggtaggtctactcaagttaagaagaaagaggaagccagttagattattacaataaactgaaaatgagagtgagtccggcctagggtggtgggatctatggatatgaaaaagggtgaacaactgttaagaaaaaagtgtcaatggacggggcttgcaatgaaaaatgaaagagggaggactaaaaggtgactttaaacctggatgggacagattaatgactgtggcactggtagaaatgaagttggaatgagagcctggatggttttggaagggtaggctggaggtatctgtgggatatctaaatggacttaccctgtaagcatttgtgcttgcaaagttggatttatgatgagatatccaggcagactatcttagaaaaagcagaaaataggtgatacttgaagccaggagaagaggataagaggttaacagaggccagaggagtaagctttctggaagaggacagaaccaagtaactcgatgagtacttgaatgtagtgatatgagctccctggtcacatctggtgtgagtgaagtcacagatccttaactaggctaattgttcagtctgcctgagccctgcacagttgtaaatggaagctgagccacggatgatggactgcttctttgcttgaggtccaggggacaagcgtgggcaccaaaatgtgtgatgaagccccaaatccttctccaagccagcacatttctgttgctctgcctggctaccactgttcagagagctggagttgtaaagttatcagacgtgaggttaaagaaggccatagtaactgactggtttaaaatattttaacttaccatgtgttctttgttatggcacatctgctatatccattatttaatctgcaaactgtggctggtcatcttagtggggcagagccacatgtgaatgaggcaatagtcctcgttgggggttagttttgccctgttgcagaccaaatatggacccctgggccaagacatttacttacaagatcagactttgggcctcagggaaatggctgaagatatgtgcgtggattagcaccactgggaaaaatttagggctttccatagtagcaccacatcaaaggttcttttttttttttttttttttgtaatttcacacaattatacatgtaaggtcctatgatatttctttgcctttctaagaatataattaattacataaaaatagtaatatgtgggaaactaaaaataatttccactttcaattcttttttttttcttattctcttttaaaatacaaccatccaggaaataccttcattggatcaagagaaaaccaaacttgagcctggtcaaccccagctgtctccaggcatttccactattcatctgcatccacagtttccaggtagcctgtgttgatctgtgctgtttgtcagagtattctgaataaaaatgtaagacgggaaatttttgtctttgactttgtgtagtaaattactagacttcataactgaagttcagtgttaagtatagtaatatacttatataatgttagcataatta

SEQ ID NO: 93656 - DNA, 1147 bp, Homo sapiens
ctttgtattcatgacatgtaagctggatcttactgattgatgcttctccttgatttataaattagagcagaaattgttttgggcagaaataggcaaaatgttagcaggtgttttctgagggactacattttttccctagtgtttagctcaggtcatacaatccctcatcctcaatagtttattatccacttcaaatatctatcatttcagactgtacctaacacacatcatccctaatgctttttggcaactcttgttggctcttctgttaacgtagcttcttctttcaagtcgtggatttcattcttctctagagagtcacgttcgtcattcggcactgtattccttggacctgacattcagcctggagttgctgcccactcgatccccacctttaatgactatttcatcactctgggttctggccagttccaaatggctatttcaaccaagtcctttcttaagggaagccaccctgtcaggtactcaatttacaggttcttcttggcttgtggagatctggcctgattgaaacccgatgagagccatcccccaaggaaactctctaatatttaattatttaaagatacatttgatattgctaatgtagagatcttagttccctgaatttagacagagtttgggctacatgacctctctgaagcttagttttattatctgtaaaatggggattgaaatacttgctgtttaagctttcttgccagaatgaagtaagcaatatgaagcacctagtaggcatctgacatatggtggaaccccatccatgctacaaccctttttccccaactattaccctcctctatactgctcttgtcctcaaacataagagatgcagtaataactggtacttggtaaagtaagttatgtatcacattctttttttttttttttttttttctgagatggagtctcactcttgtcgcccaggctggagtgcaatggcgtgatctcggctcactgcaacctccgcctccagggttcaagtgattctcctgcgtcagcctcccgagtagctgggattacaggtgcccgccaccacgcttggctaatttttgtatttttagtagagatggggtttcaccatgttggccaggctagcctcgaactcctgacctcaggtgatcca

SEQ ID NO: 93657 - DNA, 1057 bp, Homo sapiens
cttctctgtagggtcattagtgattcctaacaaatgttcaggcatctataataatgctgctatttccattcctgtactttattgtctctgctcaccttcacaaggcagaatatgccacctattggatatatgcagctagccttttgggggttgtcttgctttgtagttcagtttgtgatagaacttgagacccggtaacacaaaattctgagattttgtcagtgtaatctttcttttttaacccctgattaagttgagaatgactttctgactcccatttaaactctgtgaatgtaggtcttgggtatttgaagaatttagtatcattcagtctacttgacaactgattagctacagtcttaaccaagacctggcacagagaacttgaagaataaacttggacagaaaacatggagaactcattgttctagaagttcttttcacactaggctttattttcagatttgaagattcagtgttaactttcatggcttatatgaatattcatagactaatccaaaattgaagacttggtacagcagatatttgttttatagaagattgcaactgagtacagcatgtacctttttcatattttatgtgcaaacattagctttatccctacattattatatgctaaaggatgcttctaatcaatcactaagctatttattgagctgttgtctgtgtatctatatgccagagaagattggcagttataaaaacacccacccaaatgtccaacaatgatagactggattaagaaaacgtggcacgtatacaccatggaatactatgcagccataaaaaaatgatgagttcatgtcctttgtagggacagggatgaagctggaaaccatcattctcagcaaactatcgcaaggacaaaaaaccaaacaccgcatgttctcactcataggtgggaattgaacaatgagaacacatggacacaggaaggggaacatcacacaccaggacctgttgtggggtgaggggagggggaagagatagcattaggagatatacctaatgttaaatgaagagttaatgggtgcag

SEQ ID NO: 93658 - DNA, 1026 bp, Homo sapiens
cctaaatggtaatctgcagtgtctgttaatttactttacctagagaaagtatggtcttagaaattgattttgctgttatattctacagccttataaatcactttccctggtgcatgaataattaaagagagcaatccatacatttctgagcttgttaacatttttgaaacaaaaccagatactaaacatgacattttcctgttgctgtctggaatttctatgcctggtgtctaggctcattcccattatttactttggctccaatgcttggcttcttctttcaagttgtttgccttcagtgtttacagaagtggattcccacaaccaaggaaagggtggttaatgagtcagtctggaagtgctatttttgttatcgtggactagagtcagctcaccataattagtgatattttgtgaaagcaacgcagagcacctaggcagtgccatttccttggctcttctcagtatgtgcagggaacacacccgtgtgcacactcacagatacgtgtttgccacattttagtacaactccgtttctgcattccactgtaagaaagaatacagtcttaatacagtgcaaatgcatgcaatctagactctgggtttgtattgtcagtgtgcttgtgactgccttaagagggtagaaagctttgctgctttcgtggtgtagtgagcattgaaaagtgaaacagatgctgtcacgtgtcttttcctccttgtttgcctggcttaggcttaagatgctttgattatgttatagacccctataagattaagcctaattgtgttattgtatgtgtagttttagcattttgtgatttaagtttttcctctttaagttcttgcttattgatacctcactagtgtctgtcactgtgacatacggtggacctacccagggccattcaaatggagcacagaacttacatgtttatttatttttgaaaaatagtaatatgtagtagggacttaatattttttaatgaagtagattttagatgattattttcaatataaatgctgtgt

SEQ ID NO: 93659 - DNA, 1046 bp, Homo sapiens
agagttctttatacaactgtttggccttatagttcaacttctagacaaagtagaattatctgtttccttccataactgcctatgtttttggttttgtttttcaaattcctagtcgagttttccttctgacttctttcatgcaactaaacaggtctgcaaactatctgagcgacattatattgcatcaggttctgccttctgtttgcagctctaaaatatttcatgttgtattccaagacactgatggtgaggagtatgattattataaatagcttattgatttattgtctatttttagttatttctattctatagatcagtatactgaggttgatacaacagcatgggtggagtgataaatactaaagtgtgtagtgccagacataagaagtactattatttttgttacactaatcccagaatgcattgcagggagcactgcattctcctgggtagtctctttttcagaaaaattgccgttgttgtgtttgcagatattgatgaatgtcagcaagggaatctatgtgtaaacgggcagtgcaaaaataccgagggctccttcaggtgcacctgtggacaggggtaccagctgtcggcagctaaagaccagtgtgaaggtaagagggtagtaacatgaactactgaaacttcagcttaaagcacctggtctgaaaaaggtacgctcaatcaagtgagtttaccttttaaaaattacccagataattgcattatagtgccagaaagccaggacttaaacataagttaggaaagtcaataaaacaagattgaagacagttaaatttgaaaacctatggcattagctatcaatggctaggcattagtattaagaagaaaaattattgctttctgtgtaattctttactacagaaggtaatttccatttaaacatgtaaattaatttaaagtttttatatacttggatttcagcaattagaaagtcattatatcgggctgctttatgctgtggaatgttaataaccttaatttttgtatttaacgttgaaaaattttgtcttttaaaaaaa

SEQ ID NO: 93660 - DNA, 1015 bp, Homo sapiens
attctggatttgctagggttgaccttagactttttaaagaaacatttcattgaattgcacacagaaatacttcacttcccaataagtatgtgcttcctgaacttgaagatattatgatctcacctgtgtcaaccacaagtgtccagagttcttgagaggaaacgccatttcttatttaagaacagaatccacactgtataaggccattgtttcataaataaacaatatccacgtcttcatgtatactctgaatatttgagaagcaaaaaagtctcctgagatagtattacaaaagcgacaatacatgatggtcattacttgtatcaacattgtctttctagaatttacactgatccaattgagactgattgaaaatgtttttgaagcaccacttccacagtttctttgtattctcttgctcatagacattgatgaatgccagcaccgtcatctctgtgctcatgggcagtgcaggaacactgagggctcttttcaatgtgtgtgtgaccagggttacagagcatctgggcttggagaccactgtgaaggtaagaattgctcctgatttcagaatcataaaatgcccagatcggagggaaatctgggcatcatctcagccttgatctttgaacctcatctcttgatttcatagtgaagacattaggtccctgcaaagtgtcttccccggggtcacacaaataattcaaagaagggagtagagtccagattatctttgcactgcttggagctgtcttttagacttgtgccagccaaaggcataaaagaatcagtttaactttaccagctatagatggtttatcctgggtacatagttctgaactgtaacaccttatttatgcagaaccaacttctaaatgttccaaataagtaaatacaacttaattttccaggcaattagaaggtttttcagagccaaacatcaattcagtttttggctttttgcataaaatatttctgaaagatatcccacatgtccagtatcgtgcagtcatca

SEQ ID NO: 93661 - DNA, 1096 bp, Homo sapiens
ctttgaggaacatgatcaccttaggataaaatcttagaagttgatttactgattcattaacagtatacactttaaggcctttaaaacgctgccaaaattgccttcccgagggttgggtcatttacactcccagcagcaggaggatatggggctcagccacttgtgactgcttctgccaagttctctggtcagaaatgtagatgctgtaaatgacaatagatctttcccaatccactggactggtagtgaaaaaggatctggggctgctgaaatgtgtgtgtcatgaaaccattcaccaaaaggctcatccacttctctcaaaggtggggttcagaccctccttcaaaaacttggaccctgcatgggagacacaaccctgccaacatgcatatttctggtttcacaactgacaggctctaaatgcagtgaaacctcaggtgggctgggaaaaagcttgttacttaggtggacaatgaatgcagagaaaggtcacaagtgacagaccggtggtaaaagtgaaaaagaagcccactgggagaagatattccccgctccataagcaggcctggttcagtcacccaaccactgcagagagcttcttagccaaacaagtagtgaaagtggttgatgactgcacgatactggacatgtgggatatctttcagaaatattttatgcaaaaagccaaaaactgaattgatgtttggctctgaaaaaccttctaattgcctggaaaattaagttgtatttacttatttggaacatttagaagttggttctgcataaataaggtgttacagttcagaactatgtacccaggataaaccatctatagctggtaaagttaaactgattcttttatgcctttggctggcacaagtctaaaagacagctccaagcagtgcaaagataatctggactctactcccttctttgaattatttgtgtgaccccggggaagacactttgcagggacctaatgtcttcactatgaaatcaagagatgaggttcaaagatcaaggctgagatgatgcccagatttccctccgatctgggcattttatgattctgaaatcaggagcaattcttaccttc

SEQ ID NO: 93662 - DNA, 1043 bp, Homo sapiens
attacccatttccaatgagttatagattggagtctatttcatttatatattcagcagacatttgtgaagtgccatttatgagccaaatactataaataagacatgtctagccttgcccttaagaagcccacatcctagggatggataggcaggaatgtaacaaggtactacagactataacagctgtgtgcatggcaatgggagagggcaaagaaggacagcattctcaccaatgaagagcatctctcagagttgtggagtattcctcaagccccatatgtctaaaataagggtagctttgggttgaacctatgaaattgctttttttgcaggtcaaaaatgattgtacattggctatttcctaactcaacctaaatagtttctctctcataactcagcttgtcctgtggttgatttatggacaaatggtatagttgttccactaaataaatgtccagccatgtcataatagatttatttgccatctgtttgatagtatatgggaatgaaaccgatttttttcaagtttttaagactctattttaaattacagatattaatgaatgtgaacatccagggctctgtggtccgcaaggggagtgcctaaacacagagggttctttccattgtgtctgccagcagggtttctcaatctctgcagatggccgtacgtgtgaaggtaagataaaccatacgaaatcatattgttgtgtgataaaagagagaggagattgctttcacttatacaaagacttgaagacactaagaggtactgcataattcagagcctcaaagcatgtatgcatcaaagtaaaccatatctgaaagcatagctcaggggttgctgggatttacgaagaggataacctaaggttatgatgataaaaacactcacagatggctccacgactggtactgaattaatgagtggaaatgtgcaaggactgataggagacatgtaggagacctaaaggaaaactgtggcaacttccctttcccctgggactctgcttcttttgattgtgcttcatgtagatcgtctt

SEQ ID NO: 93663 - DNA, 1022 bp, Homo sapiens
gctgaagagctagtttccagcaggcattccacgttattttttcctattcattcaaatccaaaatattgctcatctaaactttctcggttaatcactgttacagtaagtctgagactgcaagacgcccagtaattcataaccagcttggggcttgttcaccttcaggtcaattatttggttcctgtgcacagtaacgagaaatcatcatctgctataattgcatagaattaataaaaaggaaagcaaggatgttccttcaggaatctggactgaaaagccaccaggtttctagtacataccttctctttctcctccttagctgtccttccactcattttagtagggaaataagttgctgatgaggttaagttaaaggttcctcaccctgagaaggagccctcgataagcacagcagtggcacaaaatgctctgggactggagaggagaggccctgagatctgcttgtggagtagttaaaggaggtgctgcagaggaggtgtctcttgggctgactcctgaagggccaagaggcatttctaagtaagtccaggggaaaggggtggcatggagattccagagacggaaggagtggcatggagattccagagacggaaggagtatgcaccaagtccatgaaaaattaaagaccgtaggttttcaaagacctctagtatgctaattgagccagagtgcaaattgggaaggaggttgtctggaaactgtggccagacatataggcaggaggcagatgaggaagggtgctccatgccctactaaggagtgtggttaccctttagccaagaggagattctgaacactctgagcaagggaatggtactggtgagtttgcattttgcagagagcacattggcagttttaggtggagaatggatagagggagggaggcaagactggagatgggaagatgacccaccaagagtatgagtatcaggaaagatagtaaagacggcatgacagggaaggacagagaataggagaaagtgaagggtgatattaagatt

SEQ ID NO: 93664 - DNA, 1050 bp, Homo sapiens
ctggatcaaggttatccacaaggttaagtaaactattgctcatttccacctgtaactatcagatgcaaatactattagcatttactgcaactaaaacaagtgacaatattttcacatgttttctctgtaggaatataaggtcccttggaaataaagagtcgagaacgtttaggtaatactgggcgtggcacttgcagccatcatttcagtctaaaaacatttcctaaggaaaagtactaaatgtttttttcatagaacccaacattttggctgttaaaccattttcatcaaaacattttatttatatgtaaaatattttaaaagctgttttctgtgtaaacatgttcatctcatcatcacacactaatcaggatgtgttgagtgcctctgtttatccattaatatctggtgtttgtcagcctgtgtttgttttgtgtctgatgttccatgtcttttttgcagatattgatgaatgtgtaaacaacactgtttgtgacagtcacgggttttgtgacaatacagctggctccttccgctgcctctgttatcagggctttcaagccccacaggatgggcaagggtgtgtgggtgagtttttagattttttcccaacgtgtttcacatgtccctagggaaaagaaatcacagtgaacaacaggagcttttaagcaggtaatttgggtagagctttatcgtaatttgattttgtcatacaatttgaggatgtgcaaaaatatcctatgttggctgggtgcatggctcacggttgtaaccccagcactttgggaggccaaggttggagaattgcttgagaccaggagtttgagaccagcctgggtagcatggtgagatcttttctctatgaataaaaattttaaaaaaaaaattagccaggcttgatggtggatgcctgtagtcccaactacttgggaggccgaggtgggaggatctcatgtgcccaggagtttgaggctgcaataagccgtgatcatgccactgcacggcagcttgggcaacagagaaagaccctgtctcaaaaaaaaaaaaaaa

SEQ ID NO: 93665 - DNA, 1033 bp, Homo sapiens
tgaaaagtcaggaatgataaaactagatggtcagtgggcacatactagttttgcagtacaattccagagtatcttttaaaactagattgggaattggctgggcgcagtggctcgcgcctgtaatcccagcacttttggaggccgaggtgggcggatcacgaggtcaggagatcgagaccatcctgcctaacacggtggaaccccgttgctacttaaaatacaaaacaaattagcggggcgtggtggcaggcacctgtggtcccagctattcaggaggctgaggcaggagaatggcgtgaacccgggaggcagagcttgcagtgagccgagatcgcgcctctgcactccagcctgggcgacagagcgagactccgtctcaaaaaaaaaaaaaaaaaaaaaaaacctaaattcggaattgtcttgaattttcatagtcctttcgtacagaccaaatctgacagctctaccttaaagagccccttccctaaaagagcagaaggggtttgactgctctctggggatcgccttcttttcagcaagacactattagccctggcacagctggtaaaatagagagctgtcgtgaatgaggcacacatctcacttggtctgtgctcccttttccagatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacaggtaagtcccagtgacactgtgcaagggaatgacaggctcctctcaaagacctgcacccacacagctttgggataaacgctgggagtgagataagaagcagccagatgtcctgacacagtgctgtctctggaagcttccatgatcttctgtgcctgccttgtcagtggaattaagatgtgggtgatgactctttgggctagatggcctctaatgttctatccaaaccagagatgcctccagtaaggtaaaggatccaaaatga

SEQ ID NO: 93666 - DNA, 1050 bp, Homo sapiens
tcatcgtgtactttgacagtcaggttctttgtgatattttggcagaaagttaattcagttttattccactttaaaattaaaatcagtctttgttgctgacaatgatacagcattattcgtaactaaagcttgtgtattgaagctatgatttcgtgtaattgattcttactaaacctttaagatactatacatcacagtagtggaaaaataatagttataatttcaagtaaagcatgagtaagaaaatattagtgaacttggaggttttttaaattaaaaagtgtaagaaaacctatgaagtcattagatttctttgcacttaatccatcattttttgagattgtactaaatttatttgctggaattgccttaaagttactgagtctgagaaagcaaaactgaatttgaaacatgcattcatggaagatgttgaatcttttttttttttttgtctcttctaaaatcagctgagttcactgaaatgtgtcccaaagggaaaggttttgtgcctgctggagaatcatcttctgaagctggtggtgagaactataaaggtcagaatcaagtggaaacaaattttcagcacattgtgtacatgtcagatattcaagtgaaaacatggcttgggtttcacagaattagagttctttttagtcatgaaaactgattacaaagtccttaattctaccattaaaagaaagtccccatggacttgcagtcagaacacaaactgtatgatgctcggagtttgacattgggaggtgaacttctgagtttctgtctcttcatccctgagataggaataatttctcaaaggttataatgattaagatatatatctgaaagtacttaacaaattctgtacctagtagatacttactaaatattttattctagatgcttaatagaaatcatatcaattatgatcatataaatttgaccactgtttgtctttatggtcatcaacaaagctaaggttcttgtatttttagactttatcctactgttgtggggccttttaccagtgtgcacaagttcataatgagaaat

SEQ ID NO: 93667 - DNA, 2059 bp, Homo sapiens
cagccattttaaatactgacccagactttaatgcttaagcagaaaaccatatacactaggcagaaaaacatagcaaaaggaaataattttaaaagttatcataaagagccatttaatcttaaatttctaagcatatcctgttcatggatgttttctttccttatttaatgtcagcagcagcagcagcaatgttgtttttcagtcagagcagcttacatttttatagacagagccactctcttttggatgataatgtgtggttaattaaaatttggcagcacctggaatctggactaaatatagcaatgtgtaaagtttgggaagtgtatgaggtacaactgatggctgattttctttagtaatacttttttttgctcttaagatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacggtatgtttccaggagatgcaaacctgtgtccaaataactatcataagattttccttttaactaaaatgtgaactattggaaaatagaaaaatggattccttgggtattttgaaataactaaaatgagatacaatgagatacttacagaaatagtaataagatgcatatcatcagtatgtaggagatttaatagcctggacatactcattaagtatggactatggagtggctgagcagatggcagggttgttccatggcttagggttcatcatccctaacctgcagaggcagctgagggaaatgtaattcagggaaagataattaggtgcactcagcagagtggaggatgtggataaggctcagcagaacagagggtggagttcaacagggtggtggagagccccgaagtccactgacaaactcctgtcctccctgatgctactgataattggcaaaaagccgctgataattggcataatctgtcattcgcctcaggagactgctttggatgaagtcaattgaaaggtaggaattaaagactctaggatgaagggtcactagtccagggctttggcagattaaatggataagaaggcatgaatccaatagctgttacatggaaagaaatggtagggtttgacaggagtaaatgaaaaagtgaagattaggagagtgagaagcctgatggcttatgaaggacaagcaagatagtgggcattttatataaaagtaggaagctatagagaactattgtgtcgggaccggatgggcagctggaatttcaactgatggaatgacacccagttggagatgacagagaattgatccattgaaagaccagactggattcagacttttacttggaagtcactcttagaaatagagatggaaactttgagacttgctggcttccaacacagtgtttataaataggaataactgtgcgattttcatggaactatgtcttccctttcagaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcaggtgagcccatatccaattccttctgcaggaggcctttggggacaagttcatctcacctcctttgtagcctgacatttctcttctgtatctttgccttcactcctgatatcttactttcatcccgtgtgtgtgtgtgtgtgtgtgtgtagggcagaactgcataaacatttggctcctggtttacctctactcccgaccctgtcgttaatttttgaaactctcattccattaccccaatgaatgataaatgacccaaaaaaacataacttagcaatcagtggcataggcttagaatttatatttcctggcagttcattttttactacaattcttctcattcctaacagtttctacttagaccaaaatgtgtattagagacggtagaaaat

SEQ ID NO: 93668 - DNA, 1080 bp, Homo sapiens
gtagacaaatgcagaaataattgttcttaatgtaagactgtcttttctagaccactgcttcgtaaacattaatgggcatgtcagttacctgggggagcttatcaaaaaacagattctggtttctcacttgcaaaagatggggcggggcgcgagacacaggattctgcatttctgataagtcccaagctgctgctgctgctgctgcttcctctgaggaggaagcaaagctctagagccatctaatagcatctaactttattttgttaaaacctacgttaatgctggtagttatctatcataaaggaagcaaagaatatgtgaattttaaaactagtttgttcatagtttctgccattgaaccttttaaatatactgttcccggatatcttaatcgttgagaaggaccacgttgtctatctcttcatctaagcactggactaatcccagcctgtcagacatcatgcatcccattttccttaggagtgcagtactgctttggggaacaattcgttactgatggaatcagtgctggaggaatttaaggaataaatcgcaccacttgtcatcagctttaagcattaaagtgcagtgtaaaataaagctttggctccagagcgagctttcacacttctggtccaacaggtcacgggcactaattcttgctaaagcagcaactacatctgagagtactggtaggtgcaggaggtaggagtggctgcttaaatagtgttctctgaagttagatggcatcttgcatattggtaccacatgcaggggaaatgagtgtgatggattgtgtcaggggagctttacataaggagaattgcataattgtagaattcatacatttctggggctgcttaggatcccatttcaatgctccactacagaggccagaccgcagactgcactaggaggaagttcctgatttttccttcaccatggatgtatcatggactgactgtctccccattcagacttctggaggccttccttgccccattgcagcccctgactcctcttctccttcccctttcacagtacccgctgatcctgcccactcttaaaatgatttgggtg

SEQ ID NO: 93669 - DNA, 1413 bp, Homo sapiens
taaattttgttttcttttactaaaagtaataagctattaaattataaagaaaattgtgttttaacgtattttaatcttgcttatttttttaaagcttcatagcagagaaagctcttctaatatttaaaactctcttaatattcagaagttcagatctcaaggttctgaataacaaagatataccactatccattaacattattggaagagcaagttctaatcaatgtaatatgaaaataacactaaacatagtcaatgactagtcatgaaaatgtatttcattcaataacaggaagtaagacatcactgcaaagtaaaagatggactatcttgaaatcctgattctgttttatgatttctttgtattctgccatttacttcaatctgagatgaccctcctctttccttcccctctggatctgttcactatcagatacagtcctagcaacttctgcctctggcagtgatttctttggaaggggctcacagattaccacatgaatgcattaaaagtaatggcagggccgggcacggtggctcatgcctatgaatcccagcactttgggaggccgaggtgggtggatcacaacgtcaggagattgagaccatcctggctaacaaggtaaaaccctctctctaataaaaatacaaaaaattagctgggcatggtggcaggcacctgtagtcccagctcctcaggaggctgaggcaggagaattgcttgaacctgggaggcggagcttgcagtgagccaagattgcaccactgcactccagcctgggcaacagaatgagactctgtcttggaaaaagaaaaaaaaaaaaaaaaaaaaaaagcaatggcaaaaactgaaattacttttgcaccaacctagtattttcttgaaatgagcagtgtacaatcagcacaactgctcaaaacagctcagcctgccactgagacttgaagcccagaaggaagcataaagaaggctttgttgtgtcagaagccctcccaatgagctaatgttttgtaatctgcttctttcttaaggtagtggctactgatgcttagcagaacaattactttctagcttctgctccctgcagatttgtaaatacaagaacctggtcattctaagaactttctagatgtttttctcccaatcataaggggcacaatctgtctgcggcataaaaggagaataaaatttacttcatccctcctctgcccggcttgcctgctctggccatgaggtcactgtttaacagacatgggcagtcagcagctttgttctagccatagttgtattattaggttcgttaagaagaggtcaaaagaaattcaaacgttagttgaattcaaaacctcaaacttagaacagtgcttaagcaattatgcacagtgattttctcaaagtcagactcatcacag

SEQ ID NO: 93670 - DNA, 1047 bp, Homo sapiens
acaagagagttagctaacacgcactattaagttcctacgcaccagacactacttttgcatacactgtttcatttaaaactcagaactctatgaaataattgtaattagctccttttgtttccaataagaaaactacactttttaatagcataacttgccttgcccaaggtcaggtgagggatttgaacccaaagtggtctatctgccaaaccatgttctttctactccccagctgtccttttgaaaccctgggaaaaaaattattaaatacactccctagaccttaagcatcaggtaagcacttagttcagcaataagcatttgtgactaaaattccagggagagtaataaccatgaatgctgatgagctcagctccaccaggggcagctccatcattagcaggatttatgtttattgaatttgctcgatttattaggtgaaagagatcaaattgcttaatgttcaattaaattgtacttgtcgaggacagggaagtaatgaagtctaaagtcttggcaaggtttatattctgtgggactcctgtaaatgttaatactctaaggagactcacgggccatagaccaaccacgttctccccactcccaaccttcacctaatgttaccctcctcattttagttactcccagagtttcccaacagactgctgtttatttagcaagacaaaatgaaaaaagagatttgttgggtagaaatgccaaaaaaatagtggttcctttgcattttaaaacctggatccaaacatttatactactgtaatagtattaaattatgccacacacaataaccttaaaataatgattgccaatgtatctggggcataggaaatatattaagtcttacatccaagcaatttcataggaaatcaggaatgaggcttctaaaattgataagagacaagactgaacaacacaataaacaaagaggcaaatgaaaagagtgttcagcatgttaaatttccaaactgatctacttcatattttttcagctgcaaggacaggtaaaccacttcatttcccctttcctgc

SEQ ID NO: 93671 - DNA, 1055 bp, Homo sapiens
gttttaaaatgcaaaggaaccactatttttttggcatttctacccaacaaatctcttttttcattttgtcttgctaaataaacagcagtctgttgggaaactctgggagtaactaaaatgaggagggtaacattaggtgaaggttgggagtggggagaacgtggttggtctatggcccgtgagtctccttagagtattaacatttacaggagtcccacagaatataaaccttgccaagactttagacttcattacttccctgtcctcgacaagtacaatttaattgaacattaagcaatttgatctctttcacctaataaatcgagcaaattcaataaacataaatcctgctaatgatggagctgcccctggtggagctgagctcatcagcattcatggttattactctccctggaattttagtcacaaatgcttattgctgaactaagtgcttacctgatgcttaaggtctagggagtgtatttaataatttttttcccagggtttcaaaaggacagctggggagtagaaagaacatggtttggcagatagaccactttgggttcaaatccctcacctgaccttgggcaaggcaagttatgctattaaaaagtgtagttttcttattggaaacaaaaggagctaattacaattatttcatagagttctgagttttaaatgaaacagtgtatgcaaaagtagtgtctggtgcgtaggaacttaatagtgcgtgttagctaactctcttgtttttaattgttcagtagcctgcatctacagcagttagcgccctactgcttcttttttttttttttttttttttttttttttttttttttgagacagagtctcgctctgttgcccaggctggagtgcagtggtgcgatctcggttcactgcaacctccacctcccgagttcaagcaattctcctgtctcagcctcccaggtagctgggactacaggtgcacgccaccacgcctggctaatttttgtatttttggtagagacggggtttcaccatattgttcaggctgctctcgaactcctgactgt

SEQ ID NO: 93672 - DNA, 1336 bp, Homo sapiens
atgtgccctgattgactatcatcacatctttccgtactctcaggtcccaccctgtccgtaatgaagcaatgaatgaatcacttttaatagagctaaggcaaagagtaccttaattccgtgcaataaatggagaaactaaggctaaaagaaccgtgtccagaccaagaaactaggaagtggagaaacaaggactagaacccaagtctttggattccaggtgtttgcagtgtatccagttttgcatcacaacaccacatattttagttttagggaaggagggttgctgcctgttcaccagagactgtaagcagtaatgtattccgggataaagagcaggacagacacccaggcagacatccagtctcacagtattgtggcaatacccaaggaggtctctcttccacctttctttactggtacagagtggaatgttctgtaaatggccaccgtttttctaatttcataacttttactaatttcatttaaagaaaagtgcccattggctgggcgcagtggctcacgcctgtaatcccagcactttgggaggccgaggcaggcagatcacgaggtcaggagctcaagaccagcctggccaacatactgaaaccccgtctctactaaaaatataaaattagccgggcatggtggcgcacatctgtagtcccagctactcgggaggctgaggcaggagaatcactcgaatctgggaggtggagattgcagtgaaccgagattgcgccactgcactccatcctgggtgacagagcgagactccgtctcaggggaataaaaaagtgtctattacaatgctggcttatcagtcactggaggagacagtcatttcattctctttatctcctccctctgtttcctagttgtgtgttttaaacaccattgtcgttaatccatgtttaaacctgtaagaaaaatacctggtctagaaattgtagtagcatgtgacccacttttctgcttctttttctcttttttttcttttctttctttttttagatagggtctcactctgctcaggctggagtgcagtggcacaatcacagctcactgcagcctggacttatctgggctcagatgatcctctagcctcagtgtgccgctatgcccagctaatttttgaatatttttttgtggagacagagtttcaccatgttgcccaggctggtctcaaactcctgggctcaagtgatctgcccacctcagcctcccaaagtgctgggattacaggcgtgagccactgcgcccagccctgacctgtttttcttaatgcatgaaaattggtccttgtttctcttatatttgaaaataacacagttcaaac

SEQ ID NO: 93673 - DNA, 1258 bp, Homo sapiens
ttatggaaggctttagacaggctgtatggagaggcctctgcgtaggtatctggttcctcttgacaaatctagcagttcctccatacctatgggaaggaatttggaagtaatatagttcctccaacttccttgaggttctactagaaaatgtcaagctcacaaaatgctcatgttttgctagataacagtgaaagaagttctagaacctccctgataatctgcctctttaagatctcaaaaaagtcatcttcgtcttgtctgtgactgaagcaatgacgagaaagcttccttggggtggtcgggggaagggcctcaggtaagcctcaggttatgtgtcctcacagaataatatccaagattgtttacctgcatggcttgacttattgcagatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggaattgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaa

SEQ ID NO: 93674 - DNA, 4637 bp, Homo sapiens
ttaaattatgttttcttatacatagttttctagttgaacacccttagaatcattttgtgaatctcaggatttctgcagaatatttttatttgtgtaagattagaagcacttttctcatactttgtaaatatttcacacagctgataaaagtaaactgaaattaagtatggtgcatgtttctcgttgccaaatggattgccttcaagccaaaaacttcactgggctgagcttcacacagtaaattatgggaaagataaataagaattgtgtacttcacatactcttcattatgttttgtgaatcagctttttgtcacctatcatttcattaattgttagtatattatatggaataagaacttttgactgttaaatggccgggatctcagttatgaatgacacagacgtagtttttgcccttttgggacagagaatcaagcagatttaaactctaactagtctttttaattttgcttcaggaaaagatagaagcaattaaccaagccatagccaatgaatatgaagtccggagaaagctgctaataaaacgtttggatgtcactgtacaatcctttggctggtctgacagagctaaggtacacattaaataatttaaaagagcagactatttatagacatgatccctgaacatctaaacaatttagctacttggcaactatgggagaagtacatagaagacacacatagggatttttccttagtgagttattgagtagtggctctttcaactattcagcaatgatgaaaacatttatttttcaattttctattttttaacaaatctgaattttacagttcttattggagagagaagttcttattatgagagaaatggagttattctgaaaattactaaaataataaattgatttcaaattacttgtttactttaaataatttaatttgctaatagaagttagaaatattggatttggtatgatttatagacaattggagaatttggtaagacttaagttttttttcagctaaatgagacaatccaggtaaagaccttggtcattcagcagatagttattacctcatagaaaccaaagataggaaaattaaaaagcaaaattgttgaaatagctttatattcttatatttaaatagagaaaatgagtatgtttgatctgagaccaatgatgggggaacctttttatcacgttggcctcataaccctaaaggggcaccctctcactccacccctgcccccacagtccctgtcactccttgttgtgtcaacaagtctggcagctgtacttttaaggtagttcttgactatgtaggagcagtagtgagtatataacttttcctaccatctagagcctagtaaatatcattatcagatattttggagacctttaacttatttaatatgtgtttcttatgtcattttgaaaattgacatttctctttgaacacttttctttcaacagagccagacagaaaaattagccaaggtttaccagccgaaacgttcagtcttatcccctaaaactactatttctgttgcccatcttttggctgcaaggcaggacttgtcaaagattttaaggacaagcagcggctctataagagaaaagactgcctgtgccatcaataaggtgattagagtacctttaattttttccaaatgcatttatttctgttcataaaataaaagtttaaaatatctttcctattctgtaggtgttgatgggcagggtgcctgacagaggtggtagacccaatgaaatcgaacctccacccccagagatgccaccgtggcagaagaggcaagatggcccccagcagcaaacaggaggccgaggaggagggagaggtggctatgaacattcctcatacggaggacgaggaggtcatgaacaaggaggcgggagaggtggacgtggtggctatgaccatggtggccgagggggaggaagaggaaataagcatcaaggaggctggacagatggagggagtggtggaggaggtggctaccaagatggtggttatcgagattcaggtttccagccaggtggctatcatggtggccacagcagtggtggctatcaaggcggaggttatggtggcttccaaacatcttcttcatatacaggaagtggataccagggtggtggctaccagcaggacaatagataccaagatggcgggcaccatggtgatcgtggtggtggtcgtggtgggcgaggtggtcgtggaggccgaggtggtcgtgcaggccagggaggaggctggggaggaagagggagccagaattatcaccaagggggtcaatttgaacagcatttccagcatggaggttatcagtataatcattctggatttggacagggaagacattacactagttgaggctaccgaaccttacattttgctagagctcaagtaatagaaacttagtttcagaatcctgaattcagcacctattttgaattaatgtgagaccacaggtggcaggcagattcctgcttggcataagcatttgtaggtcttcattcaattctgttagatttttttattggacttacataatgccgtttatttgagaaacacataacatctctcctttctatgaaaaattttttaaaaggtggttaaaattgcctttaattgcccagtagactaattccacagtcagaacatgcaaacttttttgaagaaattacttgaataagtagttttcatgttttcaatatgcagttttgaaaatgaggattcacctagacttttttagatttactactaggaaaccttcctcatatgaataaccatttatatgtgttttgcttaaagtattccaatgcctattttccaagcacagttctgccccccggttgacttttatgccacgtgtgcttcatgatggaacttttaggtcagttcctattaaatgagctcttttgcagatagcacattcagtagccttattttgttgatggaatactgtatcatatgctcaactctgaaaaccttgaacacggccaaaatccataaagattataaaagcaaactaagttgtgaagctatagtacatgtaggcatttagttaagtatagcaattcaaactgacctgcatccatccaaaacaaattcctccttcaaccttatttttacttgaaatttgctagaagaaatagcaaaccgaaatttgttttatgcatgagttaataccactggctcagcaaatacaagttagtttgctttaagcaggtaactttttttgtaatggaagaaatgcactacaaagttaagacagatttttgctaagtgcaggaggccctttattattgctgcagaaaacaaaagcctggctgagttgatgttttacattctcccttactgaaatctacatgacatgatgcttcttgctgggtttttgtacatgtaaacattgtcaagctgtgaaagaaaatggctggaggtgtgctttgtgtgaaaggtgagcaataaagtatctgttaagttctctctttggtttgagttttattttagctactgaattattctggactcttgcgtcaagctgatgagctaaggcttttgttcccaaagattcttgagtatttccttaaaacctaattttagtgaaaggtgacttttatcctaaaaccttaaataaatggaaaaatggctctttccaggttttccttttataataatatagctagaaaccgtcaccactcatctctggccactgggtgtagctgttgctacacatactaggcaaaaatgtttttagggtttttttgttatttgcttctccattcttcctaagattgggggactttttttaaaaaaggaagtaactgaaaatataaatatgtttatcaaaagagaaattgtatttcctttctactaaattgggcttttttaaagaatcaactcatgtcatgccatttaaaataatctacttgctactgagataagcacattcttctaatactaaaaccatctttgaaaacccacattgatccttttaactttacctgtttatttttcagctaacatttacaattattttaaaatgttcaaatttgaagacaatttcaagtgttttatcattaaagtaagttaaggttttaagttgtcttgaatgttgtgttggtttctttaaactgttaagtaattatgtttatataggatttcctattaaaattgtcaaggtttcatattttaaatgtatcatatcttaggatgtatttatatttagtatttgctttgatctgttttgtagcctcagactccacaatatagctaatgaatacaggtttcattcttttgaaaaatattttgatttatctttacggttaatagattgctttttcgaatataaggatgtaagaacacaaatgatacatttcgccctgatagttctgaaatctgcagctcctgcttcaaactagattttcccccaacattattattttttaaaaaacttctatgttcaggggtacatgtgaaggtttgttatacaggtaaacttgtgtcacagcggtttgttgtacagactatttcatcatccaggtattaagcccaacacccgaaggttatcttttctgttcctctagttcctcccaccctccaccctcaagtagacccctatctgtt

SEQ ID NO: 93675 - DNA, 1227 bp, Homo sapiens
actttcttaaatttccaatttaggagctgagggtagacgtgtgcactggtagcattattgtttttgtaactgatactctttcaatatttcagcctcagtggtactcaggccgttgtgcttctcctaatgtgatcactggtagttttggagtgttgctcaagtgtgtgatcattaaacttacattttagactagaagcacatttttaagtatattaggaagatagtatggaaataatggagattttgtttagaaattcatttctttgaggagagtaagcatttataatagtagatacagttaatggttaatgtaatttaaagtattttgtcttgttgctatttctttgtggttgggtaattggggattttggttttgtttgtaaatattctggaataatacttgcattgttctggtacttattctgagaaatgagtttttatgaaaagttctttccttccatgttttttacatacttactactgttttgtctcttcacactgaaaaacagtaagtagattcaaaaattttattgccttctataaactttccaataaatacaacctatagtcttaactcagaatttatgtagcattctgaagcacatttacattaagctttggttaactggctattatagttctcattatgacagacaattcagaggatttttaaaatctttgtttttacaactctattatggtttctgaaaaaattatacaacttcagtttttaaggttctgttaaaaaaaaaaaaagtgttcatagccattatacttaggcactaagttattccagaatcacttttgtaacttcccctttgtctgtcaaatgattgttattgtgggaatgtgcacgtaaggttaggtgttgctttagatactgatattgctgctggtagttcttacatattcatttaatattcttcatattgtacaatttctgtaactgattcaatagcagtatactcagctgattcttcctttatagcattgcttatcctttaccaatatttggcacttagaatatgttatctacataggaagataatagctgtgtggaatgcttactaatgaccctgaatagctaattcttccaaagagctcagagtttggcctttttagcactgatacttatacaaaccacttgaatgtaagtataaaatgcctttcacacttttctgtttcttaagcagacttcagtgaacattattttggactcagggtcat

SEQ ID NO: 93676 - DNA, 1078 bp, Homo sapiens
gcacccaggcttcgctaagccacttgtatgggcgctgcatctgttccgctggccagctcgcttgtgcatctaacctatcaccacgtccctgggaaccaccagcagtttgctttgactctgtgatactctgcctcgttgagccccattagaccagggtcgtcttcacccacgaagaacctgcgtatttgttttgcattgtgtctctccttctcctgatatttattcaaccataattcatcagtatctagaagctggaaatagggtttgttatctcactgggtcacccagatcagtgtactctattaaacttgagaacgtggaccctcttgggctaaatgtggttccagaaacaaattgtatggttagatacttacctacaggtacggtatcaaaacaaagtacagatttagctagctgtatttctaagtaacaagttctttatcaaaattttctcttaggtttttccatgacaaggaaacctttgagagaaacctttctttaggaaaaaacaccttgaggattcccaaagtctgcctatttgaataatttactaccctagtagaaatttttaggaacgaagtagtcttgcttatcatctgtctttgtcacagtgaaatactattgttcttttcttggaaacttgctctgaatttttataaatattccagactttagggggcttctttctttcattagggcatatgttaaagtcattcagcaaaatagtctctttagttgacatctcagactgaatcgcttgttcacacatgaaaccattcattcattaggacttttttaggaacagtttctttgtggcagtgttaggcccttagagtacaaggtgaggtggaagaggggttcacaggatactgggaaaatatgctgtgaggagccctgaggagggtccctttactgggaaaggaaatgaaatcctagaagcttctttctggaataaatgacactatagtactgtagtggaatgagtggaatgaaaggaagggggtagaccttattaaatgtagtctttctgcatggatagtggtcacttaagaattggccacggatgctgtttcttccc

SEQ ID NO: 93677 - DNA, 1031 bp, Homo sapiens
ctcgttggggagccaatgttagtgcgtgttggctttaatccctgcccgcttgcgtcggccttcagggtgcctggtctggtttggggtctagagcgaggcagtgagttattttgatgtggctaacgggggcacggttcggtaagcatcagttaaaagtgggatccctgctctggctgacgttgggctgatgatgctgttccgggggcatcctggcgagtgagcagagcgcacgcagcagcctcgtttctggggaggcggcgaggagggacaggcgccctctgcccggcgtgccttcctcactactcacagccagcaccgtccagggaacggtttattccgaagcatctttgtgtgtgtttgtttagtatgctgggatactgaaaaaggaggtgacagccttaaggataacaatggacctattaaaaggcttcagtgctgtgattctctctaaatacgcacagacacacacataggtacttatttatacctgaatagtttggggtttggacagttcaggaaaataggggagggttttctggtttggaagctagtgggcagtgatgagtgaagggaactcttctcagaggggagggacttgctcttgctttgctgcacacgtaagacattgggttagaagagatcatttgcctgaagtacaaaaaagcctctcacctggtattgtccccttttataacttgtttttatgccttacctcaagaaaaatggccatgagattaacttctgataccattgtatgtgttttgactttgggaattctgaatgacctagactaaaagatgcatctttgaaccctgccgcttcaagtgtataacttaatccggcctctcgtaaatctgaaaagaacaggcgacatgaaacacagttaaatgcagtggaaactgctgtgttccaagaaggacttttgcaggttctgaagattctaacccttgttttgtttcttcttagtctgtttctggtgaaggaagtgctcagggaacatttacagtaatcgagtgttgtggcagcaatat

SEQ ID NO: 93678 - DNA, 1932 bp, Homo sapiens
ggcacttcctttaaaaaaaaaaatactgaaaacagcagtcaacttgcattctaaatctgtgaaaccaaagtaaggacagtgttacctggcatgatataatggttggatttagacagatattttcaatcgtgtgtttacaatttcagtgttttcacttaacgacaagatttatggaaagcatgggataagtgataccccaaccgccccccgcctgccatttttaaaaaaagaattagaggagccttcagatgtcagcagttacctagaaggtattgattatctcttgtttttctgtgagtttacaagaaatttcggaatggccagtgtttccctcagtttccatttttattcagaaattcacgtggtgaagcatggttatcataactaacatgaataggaatcaatatattttattcatgttgaagtctcttttgctgcaatttttgcactaaaatgacccctactggttgtatctgttaatgaaaactcttgaaaacttatttaattggctacgttgtaaaaacatattgcatgttatagaaatattatcatgactaatctccctgctttcgatgacataatttaaatacaaattatattctctgtttgccaacttgcagtaatttttagcagtgtttactctcatactggctttgtaggggaaaaaaattacgtttttaactgcagttcacaaaatgagttagataaatcatgggcagaaatgggcccctttcagcttgtggctcacagccttaggtttttaaggcatgctggtctagttggctctcagtaaaagtacattgaacaaacggaagaacaatcctatccatagaaagaatgctgaaggaaaaaaaatattttctgaatgattaaataatgtgatgagttgtgtcctgtgcaccatgtgagatgtgcacttggatttcttttccgcattgtttagattgttattaaataaattctaattgaattattccttttgtggtgggggctgggggtggtaagtgcatttgaaaaaatgagcatggagcctgatacctaaaagtttttcctactttctgtcagtctagaaagtgctttttggaacttaggagagtgcaggtctttttcctctttccattcgtctgctaagacctcctgttgctctttgcagcatcctaactggcctgttttcttggccaggctgcctgcctccaggaaaatcacctagaagccagagaaacaagtgtggatcctgaacccctgagaaagaaatctggatggaagacatctttggaggatcgaaggcagagtttagaaaaattaatgaagtgagattttctagaaagaagattttgattggacagtgagaattatgttttgagctaaggggttgagagccatttcttctcccatgtgtcatagcgctttatgcttctataaggagtgaggcaaggtgagagagcatgaccagcctctctgggcagttaaagggcagatggtgacttgctttggcagtttgtacagacagagtgatgaggaaccaggtggagactacttgagtcactgttccgaggactctgttgtattagattcaggtgatagctagatcagataagcaccaatttttttcttggtgactatttactcagtagcttcatattttggaacttagcattccatctttttcaccattgctatctaaaaacgacctctttcagaacgcaatcctccttttatttcccccaggaattttaactgttccttttacccatttttcattgggcagtgtgtaagagaactatgtatacatagtggggtacttacagcaaaaaacagaattttgtttcctgaaacttgccatgcaaagtttctttgcttatccctggaagacagtcagtgaagatgatggctgcttggaagaaaatgtatgcgggatctgctccagaaagc

SEQ ID NO: 93679 - DNA, 1040 bp, Homo sapiens
caaaaatcaggcacttttatttcagccctgacaacagtgcggccttcccaaagtatgagaagagcagcgtgcagaggtaatgtgcagtcttccgaacagagcactgaactggtttttaatgaagggtaatatgtacttggggtccaaactctagttaattccggaaaacatatcctctcactagtgttgggtcttagtaaatgagtgttctgtgttgaatccttgcttgagaggaaggaggtcataattggtcagggattctatttctttctttctctcttttttttttttttttttttttaaagaaaagcaattgcttagaatgagatgaatctatatcagggtatgtttttgtaggatcatattaatcatcttacccacagactgactttgtggtcaaactttactcataaggatttattaaaagcaatggtttggttaaaaaaaaaaaaaaaaggtatgtttatgggaggaatgtagacatttagttgaagtacagttgatagactttgaccactcagggatattttctccatggactgtcttacagaggcagagcctaactgcatatgcttcttatgactctgatgcatgaatggcagccctaaatgggctcctcttcacttattccttctccccaatctccccagcactgtgttctgtttccttccctgcaagagtctgcgtttatcagtcaggtactcctgtcctcagagtgccaggccagctctgcatccttctccacaagaccaggctgaagtctgcctgttcacctgttgatgctacacagtttgagctcaagctccttattctttgccggcttcccttttttgagttccagtggagtggtactcttgtgtcagagggattcagcactgcccactatgtcatggtactctgcgctgctcctcttgggtctggatggggccacagttgtccagtcccatcatgctgcagccctaagctccagagggtgaccttgataggatgcacatcctggagcttaatttcataagccttgggggcctgcaagcaggagg

SEQ ID NO: 93680 - DNA, 1064 bp, Homo sapiens
ttacataggatatggatttgatcagagcatcctttgggagttgtctgcatttggtatttccttttatatcctgaaagctgttagttcttgaaaggtgtattgaacctaataaaatagtaattagaggtatttccacaaattgtgagctttgtcatttggatagtgtttttgagacttcttttccactctaaataccaactttaaatagaataatatgacagaattatgatcttgaaaaatttatctacttaactgcatgtgggaatacatatttctgtagcatgtggaaaaaggactgagtgatgcatacctgttatatttacattttcttttggaagcaaattattttctacatgtgtatgtttatgcctacatgtgttctaatttgaaatgtaaaaatctataaaaaatttttccttgactgctatgttttaaaatatctgaaagttacctgcttcctagtccttggaaggcctgaattattataaagtttatttctttgcatctcaatcattcccaaaagattttaaatatgaatgcataagtagtgaataaacaaacctgaaagtttgatacctacagaacatttttaaagctgcttctttttttccatgcagtattgttagtagagtataatactagttatgtcgtagagcagtcacttactcatttatttacttcagcaagtggatattggggcctgctgtgtgttcagcacagagtgagtatagaaatgagggaagcagtttctgctctcaagaagctcagcaatgccttaggataagggaagtgctgggggcgggtgtgctggaaagagagagggatgggtggaagaaaattgaaaatcagacttctttgaagaaaagatacttaagctgggcacactatggtagtagcagctttctaggtagaccggaggaaaaaaaagtgttcctaagcagagaaatgggatccgtaaaggcccattggagtgaacatgcatagtatactcagggaatcagttgattgagtaaatatttatggaggccctactatgtgctgagccctgttccaggtgcagaaga

SEQ ID NO: 93681 - DNA, 1039 bp, Homo sapiens
ctaagatgcataaagtttaccaggtgcttatgtggtgggtgtgtttccgagacgctatggaatggcggtgctgtggtggtgtgagcagggccctctgtgccagccctcctaggccacctctgcataatggatgatttcacaagcggtgtgcttgagatcagcatctgttgtcaccaggtccattctgtttgatttaccgtaggatggtgctccatgaggagtctgctaattagaaatgcggctcatctggcatgaaagagttatctctttagcagaaatgggagaattatgcagtgatgattgaaggcttaggttggttttgctggagggcaggaatcacatagggcgtggagggatcattaggctcttcacctctggagataagtcagaaattgcattcaagtaacaagaaaattatactgatatggctcataacttttgtacattcatacatacaaccaagaaaaaacttcaagaaattgaatatatgactcatcaccacagtaatcttgagtgaagtacccagagcttggtgccatggctcatagccaaaaggggtaaagcctgggtttgggtctcagctctgccgctaaccagcattaaactctcgtagccccagtttcttcttgagggaaaaaagtactgaaagaggcattcttaaatatacctcttatctctaaaatgatgtcgttgtaagatggagtgattggtaatataataccaaggattcttaaagtccaaaaatcaagcttataagggcagtaaagcaggactgaagttttggaaatgtacttagtttccaagttatattaaatggtaaggaagaagaaatttgcagtagcctacaaaataacatttctctttgtatttaccagtgctcctgaatcattagaaaagaatagagtagaaaacaatagaaataacatttgcgaattgcagaggatcctagagaacatttagtccagtccttgaacttgaacactgggaaactgagtttccacgcatttgatgagtatcagtgctagtactaatcacacca

SEQ ID NO: 93682 - DNA, 1046 bp, Homo sapiens
accgtatctgattgaatttctttacttgttattttccaacttattatttcagatggcttctatgtaatccaaatgtggaattagttgaggtcatttaaggttaatgtatcttctacaaacagtgctttgttattcaaaataaagtaccaggcagtatgtgagatcttgtaagaagtcaggattaggggatttcccttttctgagaaggaattttgaaggaaaaagcatacttatattcaggtatatattgtatatgaaagaattagtgatgaaatcatacttaataaatagtcacgtcgttaatagtgacagagacttggaatgctataggacctcaatgccaagaaagtatgatttggaattgtgtgataaggtatcatggagggtagactgaacgatttagaatagtgatgatgatagatttcagaagtgaggccaacatggacgaaagaagaaaatgtggaagtgggaatctgcatgacttacatggaatacacttgggaaactggtctgaaagagcagagttttatgttggtggacaataggaaataaagattggagggaggataggaccagattatgaaatgtcttaaacattgtgcaacaagcttaagccgggtaatatgagcaatcagaaatcattataggtttatgaacagacagaatcagaaagaagatggtgaagtcaacattaggcagactttggttgtggtggaatgcaaactggattagcagagggagataatggcagtcaagaggctcgttggagagcttttcagctgtttagatgtgttaccacaagaaactggactagagtggcagcaggaaaacagcaaagaagagatggatatgcaccattttgatggaagaacctacggtatctgctagcaggaaagggaaggatgaaaattacacaaagatgattctagggtttctaacctgaaatagaatgatagtgcaagtaatagaagtaggaagacttttgaggagtctcgtgataaaatggtactgaaaataggggtaattattttagggcaatgtagagg

SEQ ID NO: 93683 - DNA, 1043 bp, Homo sapiens
aagcctttaaaagtatctgactatagtagagctggtcagacccacacctggaattagggctagttcagagtagaagcactgaaatgattaagtaattggatagagaggtcaagaaataggattatagtcatagactctttcagtccagaaggtactcagcattctctacaagtaccttccgaggcgaccgctttcagtttagagctgctttaattgttgattcattcatgcatttattcatgtattcattcaaaaagaatgtattgagcacatgccatgtgccactacacctcagattcactagggcaaatttagtttgcttttacctgaggactattttctaaatgacctaaattgcaacacattttcaatatactatgggagcttgctttgtttttttgtttttatattttgattttacattgtatggctatgttctctgaaatgaaactaatttttacacaaagacttctgttttatagccttttttcttttcatttttaaaagcgcagataacagttgcctcagatcattaacttaattatcctgtactctaaatttactatttcagtgctacctaaggaaatggtaatatcatgagttttttattccatttttagttttttacatttcacttatttcacttcctttttttctttacacaagtaaagcgtacgtgctaaattttattctcgattgttacctcgtccttggtctagaggctgtagtacaaccctgtgctgtgtgtggcctaataaaatgttgtaaatcttatgtcatctgtaatgtttgtcagtaaacaaatctttagtatttagaaagaaatattatgccattttttatttatataactttttttctcaaaagcattttgggtattttttatgtgcgtgggagaaaatgctcacagaaaacacccaagtaaatgtgatctggtggagctgggagtattagcattcatgccgcctttgaaatagtgcaacagaatttcctcttaatgttcctgccactagaaccgcttcatggagacacttttcagctgt

SEQ ID NO: 93684 - DNA, 1017 bp, Homo sapiens
acagaccttttataaatatcagagttgtggttttgcaacagtgtacatgaaaagacacttgtttcagtgtttgagttcatggcagggtgcattaacgtggcgtctgcaagtatccttgaagccacattgaggagggaacttgggacttgttccatggtggtcctgctctgacctcagaggaccttgcttgctgacttttttaaggcatgaaacaaattctcatattctcagtcgtgtctgacgcagatctgggtactagtcagggttctaaactgcctaaataaatatcttgcatataacatctaaagtgacatttatctctgtggtactaaaaagaaaatactattccacttacatgttcttggtgccctttggcattttgattgctaattacaataggaccttcagattgccttctgattgagacctaacttatttctgtttcatctggaatttttcaaatacaattattatgtggtgttaacacttcattgcagcatggaactcccaaaaatgttgtgtatatattctttcatgcctctcagcctggcttcatgtctgtctaggtacaggtcttattataatgttgcccttgggggtccttttgatatatcaagaactaaacctctttagtcaggagagtgtattctgtatggatttataataaatagtctgtgttcatatgcataggaaataatgcattttctgaaaaaaattatgcatgtcacttgtattttttgtactttatgtgccggaagaacattgtatacaaatatgtcccatgtgcatgtatgaatttatatagctacatgtatataagcacatatacatccatgatgatatcataggtaatatgtggaaataagtgcaaccatgtgattatttttatcttattctttgtgtgtgtgtgtgtgtgtgtgtacagttacctgtgtgctattaaatgtgacagtgccgataatagtgttacattctctggttaagtgtttcctgagaattttggtcttccttaatggt

SEQ ID NO: 93685 - DNA, 1048 bp, Homo sapiens
tactggcatttgggagggactcaggctgtcaggaaaatgaaccaatctgtattaatataaagcgctagaaatataaataaatcatgtttgaaagcgataccaggattttccttgaatgctgctgaataaattctgcttgttaaatgtcagtgaaatgtatgtcacctgcatgcataaagtgagagggccacaaaaaacatccacttaccactttgaaatatgtaagccctttaatgttcctttgaccttcagttaaaggacatagtctcatagcagaggaaatgcctcaaattctagcatctgggtttgtttctttatacttttttggcatagttacaacagtagggcttttctgtcctttaatttttttcacagtacagtcaacacaggcttttcacacaagcgggaaaggacggttgtgaggccaaaagcaatatgtttcttctctgtgctccacggcagagcctaattgaatggcttgttgtttcagagagagcccagaaccaacaagcagacaaacagaatcccacacaaatacaaattgcgtataaaattagatacctacacacgtgcgtatcaatggatatgtactaaaaatgcagtcagcgatctcttattttgagctcattggcttagtcaccgtgttccaattctttcatctttgcagtttttggattttcatctgaattttcagctggctaaagatgtttcttctacagctgaaaagagaacctagtttcattacatacacttgtaaagtgtatgtatttggatgggggtgctctatttcagccctattcatatgtcaaccatattgtcatttatcattagcaaaaggtcacttttaagctttgcagaatgaaacggtgagatccgattttccattaattaaaaaatatacatcataacagtatgctggagacatcttcatatatttgtgttttccctgctttacatccaataggtttctgtgtatgagcttctcctgagactgaataatagcagcacaccctaatgcaccttttttaatgggaattcagttgggtac

SEQ ID NO: 93686 - DNA, 1075 bp, Homo sapiens
agagagaaagcagctgtttttagggggaggagagaagatggtggagcttacaagagactgatgtttgcaagtggatatggtataaagtagtagttctcaaagcacggtgcctagacagcagcatcaggagcctgtgaatttgttagaagcacacatcctgaggcttcacccaagaccaggggataagatttggcaatctgtgcttaaaaaagcgtttgccttgctcacttctgagaaccagtggtctaaagagtgttgggaagcctgacagtggtagttacaagggtgtaccctgatgggagtcctgggatcaaaaagacttgaactagaagtaagggaccaggtgagggagcattcccttcagagagagttgttaaaataagccggggttctcatgatgctgctgaaaggagtgtaagtactgtacctcctgtgtttgggaccaagggtgtatctagccttaggcttccattccagcacatcccgtcagccagatgtgcaaaagttcctccgtatacacactgtactgcttaaattgctggtattttgaaatagaaaaaggtgcttataaacccatactgactgtgatgaacagggagtactttttccacctacctctgcttgggaggctgaaccccatcttgccctggaagatggctttgagccagaagccaagccctttaatggctatgaaggggggaaaaagtatgatttccatgtaagggctaccaagaatataagtacctatttaataaattatttgttgaaatgccttttctattttggtagttgaagtttgaaaaatgtttggagtactataattatcatttctgggaaaaaaatacacattgcagtatttttgtttttgctacaggtcaagttgtagttcaggatggaaagtaaacacatccctttgctcagctgcagctcacatatttgtagtctctgggtgccctcttggcagtcgtggtggatacccaaaggacacaaacagggcatagaaacgcggggctccatcaggggcttgccccagtgcaagtctgattaggaagtttgctggagccgaaggaatggc

SEQ ID NO: 93687 - DNA, 1035 bp, Homo sapiens
ctttaagtaacaaatctctaatctaaagcatcattatgaatgcaattccataacatcgtttgggaagaaaagatgtgtggttcaggagattcctagaggcacggtggggccgatatatgccttagacctggtggcaggcagagatctggagggctcagtgcttctttggcacttggccagctgtggcttgccagggtgttggaacatgcccttggcgaagctgtactgtcaatagggagcttcattgtaaagattctctgtttgcttggagtaaggcagtggttctcaggcccaattgcacaatagaatcaccctgggagctatttaaacaagtactaatgcccaggctcctcccccagaatttctgatttaattggtttgaggtgggatccagacagtggtatttttaaaatctttgtgagtgattttaatgcacagccagggttgagaaccactgaattaagaaatcacgttacagtcttacagatcacttttttccctttatatttggctaagttatactgcacagtgatgcaaactagctttattaggtagtcaaaaacaatttaatatggcatttttgacaaaccaccaagaaaagactctgcaaagattccgtcgctgttaaatcctaaattcggagtcttaagatagtgctgggaaagtgcagtgggtgtttctgaacgagcttgaaatatgaaatatttctgggactgtatcaacaagtctaattttttccccttggggttatgattgtgcggaacaagtcttcacagcaaagcttgccaaaaaaggttatgataaaatcatggaatgtgtatgaaaagaattcacagtgtaactttaaaggagtcagtctctaaatttaaaaacttagggatgacatacgtattacatttgtaataaaagttttaagaacaaagtaatgctgaatataagaaagttcctccttttatcacatgatatctctaaggccaaggaacaagtgaaatagaacagccagcaagaaagtaatgaggatacgctaaagacact

SEQ ID NO: 93688 - DNA, 1059 bp, Homo sapiens
aatttctttccctaccgtcctctttggctacttaaatagatcatcaggactgtttgttcttctgttgaaagtgccccacactgccctgggcataagctaaattctttctctcccttttagaagagaagccagattgctccaaggcccgctgtgaagtccagttctctccacgttgtcctgaagattctgttctgatcgagggttatgctcctcctggggagtgctgtcccttacccagccgctgcgtgtgcaaccccgcaggctgtctgcgcaaagtctgccagccgggaaacctgaacatactagtgtcaaaagcctcagggaagccgggagagtgctgtgacctctatgagtgcaaaccaggtatgcacgagctctgtctcagcagccttgttcctttgcatcagagggtagcagatccctcctcagccacccctggcctctcctttcacacgaagatgggccttctcaccggtgtcctgtgaatctgccactttgggctaatggcagcttgacttctggccttctagtcagagaaccagagtgatcatccactggtacataagcgccttcggagagcgagcgtgtcttttcctcttttcttctttttttccttcaaagtatgcttgactggggaggtagggttaaaatttatggtactatggcaatctgcttcatttccccagagaaggtcagagaccttatttgcagctatatctgccactttgaattattacatttaaaaacaatcatcatacgtaaaacagaaagttatttttagatgaatacatgcatcaaaacgccagaagtttcataatgcaacactcagccccaatctttctctttgccaattcccccgcatctgccctctttactttatagcatgtgccaagtcatctttgactgtttactcaccctctttgccaacatttgatgtactgttgtatcccagctgtttcttgctttatattatttctaacatccttgctcttgtggcagcatttccgatgtggtctgtgaacacttctgagttatagcgatttcctctttgcaagtttc

SEQ ID NO: 93689 - DNA, 1033 bp, Homo sapiens
ccatgagaaacctagtcctttcctgtttctctggaagaaatcactgaactgtttgcattacttggtatttatatgtatctttcctcagatcaaaaccaggtgtcatcaggttaagtcgttaaaccttatagattctttctgtaagggtgcctgtacacttttgagggctgggacctatataagcaaatatgcccctctgtatatagatagggaggcaggcagtgaggtgtctatcaagagtagacacatcatttgatcctctgcagtgaatcttgtaggtgcttaaacaacatgttcaatgtgatgaaacattgggacccttgatgtttggaatcacacatctacccagacccatttcttgctgaggtcaagaggagtcttaattcttacaatgctttctggaataacaaacacatctctctttggcttgactgcggggaagagccactgtcattttaaccctagtagcagggcatgcacttagccccctagaactagtttttctctagaacatgaggatctccgggtcctgtcctttttagtctacaaagcaccaccatagagctgtccctccttcgtacttggctttggggaagactgttcttggaaatgtagggtttacagtctgttttcccccgactactcacccctcttctctgccatgacctcccttccatcttttgcaggtcaacaagccatctttatgactaagtcatttcatgtttttcagctttcgttctgcgtttaataggatgagttaaaactgtgccttatttaactcaatttccaacctcttcttcctcagtcccagtgctaggcatttagcttctgggtttgttgcatgagtacctgtgattatgcaaatggttggataagataggagtagatgtggtccataggtaaggtaagtatcagttatctgtccgtaattgaagagacatccagaatttgttctgataattactttttccttctttcttctcataaaataagttaaatccttggcatctcctagcctttgttctgtcaaacc

SEQ ID NO: 93690 - DNA, 1117 bp, Homo sapiens
gacagagctccttggagctggatagatttctttccgtctggatggccacctgcccggaatgcttacaagaattgtattaggttggaaaggaggttgaactagctgccttccattttatcctcaagcttctgtgagtctagaaaataaaacttgaagatgattattactgtgttgacataattttgacttcagcattcaaaaatgaagaatggccagagttaaatttgcctctaatgaagacattgaaaacatagagaaggaagtcattcaacatcccactgtaaattatttgcagagaagggataggttctcacagctctttagtttcctgtatgtcagatcatcagtgacccatactcatcccctgctcatttgttcgctttgaacagggtctcctcctccagctctctcacgagtcctgtgcctttgcagttgccactacctcttcccggactcccttctgcatacatataggcagcttctacctctccttcaagactgcatttcctgctctttgaagtgttgtcactcttcggcccctgaagatgacttaagtgtccctctctgctcccttgtcatccatcccctgtgtatctttttatcatagcacttttcataacacattgaacatactgatgtttttttgtctgtctctcctgtcctgtgtgattgtcaaggaaagggagtattttgtagcctcttgtacctaaatataatgtgtcagcccacatctgttggtgaatgaatggatgaacaaacaggccctctcttagccaagatgatttatatgttgaagaaaagaaaaagaatgaatatttttagtttctagttaccttcctgccattgggttgtaatactactccctgtctcattttcaaatccttgcacttttcccccagtccccactttatggtgcggtactcctcaatcctgtagaaaccctccattccaagcacagcagtcatctctcacagcatgggatgcctttcactctccattccatctcttttcatattgctcatccagcaggactctaattaatttctcctctgtccacgtggtcttcatgcttcaaccaacaggtcccactgcctagaaacttcccacataatccttt

SEQ ID NO: 93691 - DNA, 1096 bp, Homo sapiens
ggtgaggcacgaggaaaactgtgagcctaaggaactttcatagggaggagtgctgttttccataagaagggttggaccctcagataggaaacctgtttctttttggatattttatttgcagcctttaaaaaaaaaaaaacttacacattcctggaaagagtaagaaatttaatcagtagaaagatagtacatcgaatttaattaaagttgcagctactttttatagaatagcactgtgttttatatgtcattataatttccattcccgacaagctatttcattaacacactgtgtagaatcctagtaacacaagggctttgccctttttgctcctcatttatccttgtttcctgactaaagggcgacctcccacccacctgtaagtagtttttaatttataggcggtcatgtctccacttttgaaggcctcaagcactcacttccggtgtgtagtagatccagtattgaaagaaatcttttccagaagacctcactgacttgttttcctctaggatacgggcagaggaagatcagagtctgctggggaagatgaggaatatgatggcttgctgcttccgagctgcctcctctgcagaaggagcctactatggggaatgttaggataacatcagcacccacaccaggaggatacctctggggtgacggggcgaggcagaggttgaggggcattcctgttctttgctgaaagggctgtgggaggggcaaacaggactcctagccctgtggcctcctccaggaatctcctgtaggttatcttcctttaaggtttttctggtcattgtagtaaaacaaactgttgacccttgcgcttagttatgtagggtctgaaacatgcctagtggtagggagacaacagcatctagcatgttgtttcttttccggccttgcttagagttctttagtagggaaaaaaaagttatataattattatgcccccacgaaaaacaaaacgtcaccagtgcaaaggccctatcttgagctgggcctgaaggttgaggtgcttggagaggaggaggatcaggggagtaagggacacaaggtgactgatgttcctgaaggacagggtgcaggtga

SEQ ID NO: 93692 - DNA, 1060 bp, Homo sapiens
ttggactagaactggaaattggggagagggcttcagaaatgaggggtaagtgttgaaatcagctcactgcagcttttctcatgaaatgctgtttgctctgccccttttgtgttctcctttcctttgcttgctccttatccagagatggggataaagggagggaaagattagggaggacaaaaagaattaaaatgaagagaaagaatgtggtgaggacggtacaggttgcatgcgtcagttcttctgtagttcagcatttcctgttcatgactcagtagaggaaaatctagtctcttctagtggaaaacacagagaacaggaaaccctatttaaaatcaggtcacttgactaagctgtgtaactcctgttcccatcggtgaaagggaagaatacctcctgcagtgtgtgttaaccagagaatctagaataatcttactgaagaattttttaaaactacatgggactcatatcatttgtagatataacagacttcctgggcaaatatgggtcatgatggggtccccttttgttacctgacagagtgaatgtaaacatacctgttaaaagataactcatgtgagttgtattatgttgaaaataaggaattgctatttgaccatttcgaactgcaaaactggcagtttcagtaaggttttaacctaatagatagctacccaatagatatctgacctaagcccagatttttaccttttgtggttctttcatcagctctttcttgattaagatgctaatttcacgttcaggggaagctgtgaaaagtcaaaagatggcaacaggtagatcagaaggctttgcagggaaggaaacaaggagacaggagctggggtcacaccagctagcaaaaccaggatctttattatgcagtcagtttagttgtaaagattcagcataaaacattttcctttcctaggtgggttaataggtggttgggtgcaacttcagctcttctgtagcctgctggagacaacttgtaagggactttaaaaaaaaaataggaatatttaaatgttaggaagacgtaatgcatataatgtttact

SEQ ID NO: 93693 - DNA, 1020 bp, Homo sapiens
aggtgagattctgtgaatacttgtaccactggagacagaaatagtcactgcttccctgggttcccagcatctcagatatgcttcatccagtgctcatcacttggaaaagacttaacgctcatgcctgtctctcactccaaaatgtgaactgctggaggacaggagtctgtcacattcatccttgtgtctgtagttgttagcctattatctgcctcacagaggacacccagattttgttgcatgagccagtgaatgatctaattcgtatcatcttagttccctctagaggtgtctgttaaatgtcagcccataaatgggttactttgtaggaatcctccatctatttactgccctacactttaatcttaagtcatttgtcccctgaaaatatcatctctagtagaaagatttgctggtgtttcctatgggtgaggaaccggagtgcccttcttctctccttgcttcttggttctagatacccatgggtcattcctttcttatcagaacatagactttatgtcttgctccagtctgatgtgtctcaaactactaatagccgtacctccaccttagcaaccttgggatcagtctgcagggcctgtcctcatttattgccacttattatagagccctgacttctggaataggatttgccatctgtcctgagaagatgttgagtggacaaaacacagtcactacatctctggtcgttgcttctttcttgccaccataaacttgttgagtgatctttgctttcttcctaatcctgtggaactgtgtctattgatatatcagtcattcacctgtagaggagactaggaactaatactgtgaagattcataatcctacagaatattgttaagaacattgtctcaaagcctgcatttttcttcttttgatatatacattcatactcatacacacacatatatattgatagatgaatgtgtctgtgtatgtatatataaatatacttaccacctagtgtcctggaaaaatctgttgttgtaaggtcacca

SEQ ID NO: 93694 - DNA, 1028 bp, Homo sapiens
ttttaagattgttttggcaattctgggtcccttgcattttcatatgaattttatgatcagcttatcaatttctacaaaagagccagctaggagtttgatagagattgcattgaacatgtagatcaatttggggaatatttccatttaaacaatgttgtctttcaatccatgaacacgggatgtcccgtttacttaggcctttttagttttttgaaaatgttttgttattttcaaaatacaagtttgtacttatgttattacatttattcctaagtattgtatactttttgatgctattgtgattggaattgttttcttcattttctgattgttcattgctagggtatacaaacacaatttggggagttgcaattgtactctgcaaccttgttgaacttgtttatacattctgatagttttttagtggatcccttaaaactgtttacatacaagatcatgtcatctgcaattagagatagttttacttcttcctttccaatctggatgcttttaatttatttatttttcctaattgctctggctagaattttcattactatgtcgaattgaagtggtgagaacacacctcattgtcttgttcctgatcttagggggaaagcacttggacttttgccattaagtatgaggttagctgtaggacttttgaggatgccatttatcaagttgaggaagttccgttctattcctagttggttgagcatttttatcatgaaagaatattagattctgtcagatgccaaaaactgtgtctatcgaatgatcatgttgctttttttccttattgtgtgacatatcgtattaacattaatattttggatgttaaaccaaccttgcattcttggaataagtctcacttggtcatggtgtataattttgtttatatgttgctggatgtggtctgctagtaattttttttaagatttttgtgtctacatttataatatactgatctgtagttgtgttttcttgtcttggtgggagttattttaaatcaactaaaattaaag

SEQ ID NO: 93695 - DNA, 1095 bp, Homo sapiens
tgaacagcattttggcataagaatatagcctctaaaagtgagtacttttatcaataacacttatttgtaagtataactcctggtgtgtttataaaaaaaatcaattcacctactacatagtatttttatgacttctagggattagaggcatgtatttaaatggtcatatactgtattacaacgtttttctgaaattgcaggtgttctattccaacatttttttcaaatacattagactaaaataatttgcctacagaaacaggtcaaaataggttgcgattctaatataatttatttttagtattttagttatccaattccacttctagttataccatactgtttcctggtatagtcttaagtatatcctataaaaacagaatgatttcacattgcttaatatatgagggttagcactgaagatagtgaaaaatccagtgagtcactgttaaacccccattagaacttttctgtgttgtatctatctgattattgaagatacagtgtcacacaagcatataaaccatctgttgcaatactattttaaaatcgtaggacaggttcaaagaggggaaatgtccattaaagaacgcctcttgcgcatgtgtgggtctccccatcacaggtggctgatgaggtggcaggagcagcatcatacccacctatcagcctcttaatttgagagccccaaatactcccctgcatgagctcccagaatgcagattgggaaatctgttgccaggggactcagcaaagccagatcttggtccaggggtcataccatcagtttaatctaaatttgatgtgctttgagcaatacgggacatgtaacatgtttctgaaatttgccagaaagcatgcattttgttttataaatattttgagtttaagttgatcagcagtttgaccaaatttttatttaccatttatatctacagaatacctgtttacacctcagtggagtttaactttcgcatctgagagattagctggatttatctggtttgtttgaaacagcctagttcaggtatatggaccatttgagatcacagaatttaatgctagctgccagtaaaaagatgcagtcccaggctc

SEQ ID NO: 93696 - DNA, 1079 bp, Homo sapiens
caaaatgattttttgcttcttgcatgctacagcgttgaggcttggaaggtatcccatgggacttgttttacctgaaatatttaacacacacattgtaagaccagcacatactgaacggccctttatgcaattttatttgttcaagtgaacaaaacctgttatgctgaatattttaggaaaacatattgaacatatttcctctcctggagaaatgtgtgttagatgtacatctgtgactgtgtacctaactgttgaagccatttggatagattggcttctgtgactgatacggggctgcccaagtcagcattgtggttctgatcctcaaataacccagtccatttgttcctttcactttctagccacagatcacaaccttaatcgcatgttaatctaatatattttttaaaaaacagcacatacatcactattgagagcaaatatcatttagaggtagaagatcatctttgtaaaagttggacgatggattctctaagcaaatccctaaaattcactgctgctaaaattccatactaccctatgatatgatgattatacatttttcaaggtcagtttaatcttcagtatatacttttccatagtatgttttctgaaggcaaaattttctcataaatttcacatattaaatgtcagtaaagaatagaagattttggtatgtgtagatatgcttaagacatttctttacccataagctgtccaggaaagcagtgtgcctagagttcagaattcttccctcaactttggcctaatcgctctagaacatagaagtcctttctcactgggataacctgtggtgggtttacttaaacctgatacttgccttctacgctctctcatatttgtggttagagtaattttgacaaaacattggcagtcttgggactgaagactggaatagaatcattatttggggtagctaagaaaagtagtgataaaagaaagactaataggtttgagaactaaagatgtttgcagtaaattttaagagaatggaggggagcagcaatacgctaactcaggatgtcttaaaacaactaaactttagttattttttgatg

SEQ ID NO: 93697 - DNA, 1015 bp, Homo sapiens
tgctgaacatagctgcttacagtagtcctaagcatttataccttgagtagagttatttagctgacaacatatatctccacaagaaatcttgaaagacacttcgcccgtatcttgtctgaagtcaaaatatattgcaaaatacatcagagcattcctttgctggaaaccctatttttaaaatgagctgaagttataggggcctggcttatttttccagaatctgtactggctcctggtagtcagtgctttattcccctaaatgtcacaaatcatatatttaacaattatttctgaagaattttcagttgtgaatgtcaatttatgtagtttttagaacactttgtcccttttgaattgacatttggcctattttcttaaatctctttccattctcttcgatctctctcacacacagtactggttctgtaataagcgggctttctgtgggcctgtggttgtaattaccatggctcagagacttggacttaacgtagacagatgctcactttctgatttatcagttatctcaggctttaacataccacttaaccttaattatttgtcactattttaaaaatatttttgaagaagatacaaaataggagttaagccattctgcttcctcagttacatgtgaccatcacactatctacagtggcgttagtgctaaaactgagtttataaaacgcctgttggccaggcgtggtggctcacacctataatcccagcactttgggaggctaaggtggatggattgcttgacctcaggagttcgaaaccagcctgggcaacatggcaaaaccccatctctacaaaaaaaaatacaaaagctagccaggcatgatagcaagggcctgtagttccagctactcaagagtctaaggtggggcgatctcttgagctcgggaagtcgaggccgcagctagctgtgattgtgccactgcactccagcctgggtgacagagcaagaccctttttcaaaaaactaacaaacaaaaaaaaaactcttgttgag

SEQ ID NO: 93698 - DNA, 1050 bp, Homo sapiens
gcagcctcgacctcctgggttcaagtaatcctcttgcctcagcctcccaagtagctgggattacattcactcaccaccacacccagctaatgttttattttctggcagaggcaaggtctcactatgttgcacaggctggtctcaaactcttggcctcaagcaattctcccacctcagcttcccaaagtgctgggattacaggttccagccagccgcagtcagtctcctctttatttaaatgtttgctatgatgatgcatttctcttaagaaaacttcataattgacatatgtggatttaggactaccttccagtttttaatgttgtctatttctgaactagaagatggtattttgagatgttttggcaagtgctagtatttcaggaaaatttcaatgttatcagagtaagttattttcatgctgtcatttctctgataatatagcagtcttgatgacagtggaggagtaggtaacaagaacattgattgatgcatttagttagcaaatgttgttgaatacccactctgtaccaaataccatggttgtccctatacagtgtgtgcctaaagatactagggcctgggcctagagctccctctattgggaagctgaatgtagatgggccagagcataacatgcaggagaatggtcccaattcagggcagcactagagcatcccactcctaggaggcatagccagtctccttctaatgaatgtcctgtatttttatttaaatgtaccagcctttgtttgaaattccattccattgcaaagcagaggtagattacagactagtttttatcacattgtttaaacttgaatggagacacaacagttttctttaaaggtgaagcacattcaagatcaaggtctgtggaaaaactccttctttattgcaggaccagaaaaataaaggcaccaaggtgctcaggctccaaaattgcagggaatttaatcccaagggatgttgactgactctgggaggttttcagggtgtttttaattcatctgtttcccaacataattcatttgtagccatgacctaagc

SEQ ID NO: 93699 - DNA, 1087 bp, Homo sapiens
ctgttgacagacttaaaccacttgaacctcacgtcctaatattagctcttttgccattgtcttctgtttccatgcatggaatattttcttcactattctcttaataagaatagagcgagatgctcttcacagttcatctcttctatcccttaaagcaaacagcaccaggctttcaagagttggaaagattgcagatgaataatgtgttctgattttgtgtcatttcccagatgactttgtggtgcagaagccagagctcagtactccctccatttgccacgcccctggaggagaatactttgtggaaggagaaacgtggaacattgactcctgtactcagtgcacctgccacagcggacgggtgctgtgtgagacagaggtgtgcccaccgctgctctgccagaacccctcacgcacccaggattcctgctgcccacagtgtacaggtaagcgacaccatgccttgtgggtgcttggtggggaaggatgcagctctgggtgttgtcattctgtgggacccacagggcaggatcagccccatatgggagtgtgccaaacccagtatcccatcaggaacagctggcagcctgcttcctgcatgtattctctttatcaaccacctatttatgcagtcagcatgcctcacacctgagatgactgtgaaacaaaaaaggagactgttgctcttgccaatttttttccttaaccctgcatctcaaactcgaggcgtatacctaagtagagaaagtcccaccgcaccaaattaaccaaacgattctgttactgtgaaaagtcatctttatgtaacaaatgagaagaatagttatttataaataatgtaaacaaaattctttgtaaataaaattctttgaaatataagggtggcgaagagactttgaaatatgcataatgccaccccctccaagttgggatgattagtaagttaatgccaaaaagcattaagtgactagcactgcacatgtataaggagtgctattattttctactttttatttctcagataatctgaccttagcaggtaaatgtatggccatgaaacttgttagaaggaaatttgtcaagatgt

SEQ ID NO: 93700 - DNA, 1055 bp, Homo sapiens
tacagatctctaaaaacctcaaactcacaattaagggacctcttttattagtggtcaaaaaaaaagtatgcatgtgaagtatccttttttcctactgtaagaaaaatgaaaagtggtgattctaccaaaaatagttttctgattacaagtatttgtgttccttgtgtcaaattgtcaagtcactaatgagcaatgataatgcttctcttttgatgttcgagggcctcatattatgtgtgctaatttaataggatatgtaatatagacataattaataggattgatgattaattttgaaaagtgaacagctttgtctagtttcttataatatccatcattagggaattcattgttctactagaaagaaactaagtagtaattacccattcactttaatggaacatcttctgattccctaatttttttttgtactctggttttctaagtaaatacattcaaacttagattttattttcataagctgactataatgaagggttaaaggatgaagaacaagaatcaaaagttgacaagtatgacgcaggtggagataaaaggtctggtgggaattctgatgggtgaaaagagatttcatatgtggttccttgtaaacagcaaatgcctctgttatgacctacttagccatgcaagagtgtactcgtttctaaagcatcccatggccatttcactgatgacatgctacatgcctttctcaaaccttgccagagcaaaaattatttcagtgctttcagtgaagtctttatttcatgacttcaaggaggatagcagagaagtaaattagcagccctcataccacaccactcatatgcctgtggggatactcatatccccatatgagccctgaccacatcaaccttgctctaatgttcgtgttggtgatgcttctgcccatactgagtgccagactctggcagcttctggaggggggaccgtgagtctttcagtggatcctccctgtgtccaggggtcagtcattcctggtcagatattaaaaagaaaaagtactactttgatcgtaacgtctatcttaggtt

SEQ ID NO: 93701 - DNA, 1035 bp, Homo sapiens
tgaggtttcaaaagacggaagacgactaaatctgctctaaaaagtaaactagaatttgtgcacttgcttagtggattgtattggattgtgacttgatgtacagcgctaagaccttactgggatgggctctgtctacagcaatgtgcagaacaagcattcccacttttcctcaagataactgaccaagtgttttcttagaaccaaagtttttaaagttgctaagatatatttgcctgtaagatagctgtagagatatttggggtggggacagtgagtttggatggggaaatgggtgggagggtggtgttgggaagaaaaattggtcagcttggctcggggagaaacctggtaacataaaagcagttcagtggcccagaggttatttttttcctattgctctgaagactgcactggttgctgcaaagctcaggcctgaatgagcaggaaacaaaaaaggccttgcgacccagctgccataaccaccttagaactaccagacgagcacatcagaaccctttgacagccatcccaggtctaaagccacaagtttcttttctatacagtcacaactgcagtaggcagtgaggaagccagagaaatgcgatagcggcatttctctaaagcgggttattaaggatatatacagttacactttttgctgcttttattttcttccaagccaatcaatcagccagttcctagcagagtcagcacatgaacaagatctaagtcatttcttgatgtgagcactggagcttttttttttttacaacgtgacaggaagaggagggagagggtgacgaacaccaggcatttccaggggctatatttcactgtttgttgttgctttgttctgttatattgttggttgttcatagtttttgttgaagctctagcttaagaagaaactttttttaaaaagactgtttggggattctttttccttattatatactgattctacaaaatagaaactacttcattttaattgtatattattcaagcacctttgttgaagctcaaaaaaaatgatgc

SEQ ID NO: 93702 - DNA, 1032 bp, Homo sapiens
aagacacagatacccagtatgcttaacgtgaaaagaaaatgtgttctgttttgtaaaggaactttcaagtattgttgtaaatacttggacagaggttgctgaactttaaaaaaaattaatttattattataatgacctaatttattaatctgaagattaaccatttttttgtcttagaatatcaaaaagaaaaagaaaaaggtgttctagctgtttgcatcaaaggaaaaaaagatttattatcaaggggcaatatttttatcttttccaaaataaatttgttaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaagaaaaatataatttcctgaagaataaaatagatatatggcacttggagtgcatcatagttctacagtttgtttttgttttcttcaaaaaagctgtaagagaattatctgcaacttgattcttggcaggaaataaacattttgagttgaaatcacacagtgtaacttgcaaaaagattccatctctgagatccgaaagacttttaaggttatcagtccaatgaacccctggtgtaacaagaagtcccgtgcttttgtcattaggcgggtctttcccaaggtatccttgcaaaaagaaaagtgtctcccagagtacagagaatagcgatgctgtttttagggagacaagaaacctacctgctgtcagaaacgtgctcatagctggtatcaaaattaacttgctacgcacaggaggactgtggtgggaaatcctacagtggttcgatgctgaagaagaaagactttaccgagcacgatcaggggaa

SEQ ID NO: 93703 - DNA, 1798 bp, Homo sapiens
gcagctcatcaatgagctccatgaagggatgtttgagtttttgttttcattccgttgcctctcacctctctcaacctcaaaagaagacaaggaatcttccagactgtcagtggagcagggaggcctgaagatgcagccaggtagccagagagcgggccagggtgcagccgcctggtgcctctccaggttgcctcacacatgcagagtgaagccaggaggacatcatttctggccttttgttgttgttgttctttacaaagaaacattcgattatacaattgggcatcacctgcaagaagtctacgtcaaaaagacggtgggacacttaacgtgtctcagagattgaactatgcagttttaccacttttctggacttagggatccagttactgtaaagcagctttctttatcctgtttttcagttatgggcaggataagatcactcagtgaggattagccacagagctgagatttagggcacgaggttaaataatgggtggagctaagagattccaggtaaaaaccactggctttctatatgagcatatgtgaaatgcacggaactatttttttggtgggatggtaagaacaggaaaatctggacaatcatttatggattatgctttcatgggattagttaaaagacatggcgctgttacttgtgagcctttacaagtagtgaactaggaagtttatctcaatttcagacattaattttcattattcatttccccttaggccattctctactttaacttttctcctttaatgcctaaaaacgtttacaatgacttacccaataatttaaaataatagtaacgcatttctaaaacgatttaagtgtgtctttgttagcttctgaaagaagctagtgtgtgtttttcaaagttgtcatgttatatatgtggaccatttgttcaaccagaataaaaatggtctgaaacagaattattttgctgttggaaattactttattgtgcagaactgttaaaactatgtttttagtttaaattgctatttttaaaatgtgttgaaaaatatgcaagtagaatgtgagataatacttcactttaaaaatgaacaaattgagtaaaccatcctcagacttagtcctatgaaattttcaataactgaaatgcaaaaaggtggttgtttctgttgacattaggtttgtatgaagcaaatagaggtgggcaaaaaaaaatgagctccatctgagatagtaagataactttattcccatacaatacctgtgttttcattaccaaagtagcttgtgttttatattatcagatagaccttctagtaacagtatcaaattttttgcagataaggtaattccgatttaagtgacactttttttttttaaacttggcagtatttgactacagtcattccttatgagaaaaaaaacggaccaccgtctgttgaagatcttcaaatattaacaaaaagtgagcaaagacaaaatgaaactattacctgatttccttttgctgattggtaaacacctgactttagttggctgattttgttgttagtgttttgtcagtttaggatgtaaatgatgcatataattgtttatttttataagaatgaagccaaaaatggctgtgacattaaatacaacagtaactctagtgttgatttgtactttttctgtttttcttaccttgtgaaatatttatgagctaaaattttgggaaaaagcataacctaaatctccatcatctcttacatgtttaagaacatatccatttatcataaataaaattccttatggatcttatatatctat

SEQ ID NO: 93704 - DNA, 1076 bp, Homo sapiens
gcataattatctttgtatgttctgcaggatctagccagtgctttgcacgtgagaggtaaaatatttgaggaatgaacttcggtaccacctaaacatttcccattgactctggctgttattctggttggcaagttaggaaaggagcaggttaccttggggaaaacgactttcggggcgtaatctgatattaggtcgtaagtttaaagaagtcctttattttagccacatttaggccaagttgctaataagggaagctaacagggaagttattcctaaatgatagagaatataggaagtgactcaaggcagttaaggtcttggctttctagtagcaccgcgttcaactccaggaagactcaggccaccggagacccagggttgggacagcctgggatctgtcagcacggtagcgggcgggggcggggcttcgggccggggcggggccgggctgggcgggctgggccggcctgggcggggcgcgcgactgctccgggcggcgatggcggcggacggggactggcaggatttctatgagttccaggagccggcccggagcctcctggaccaggagaactgtaacgcgagccccgagcctggggcggaggcgggggccgaggcgggtgggggcgccgacggtttcccggccccggcctgcagcttggaggagaagctgagcctgtgcttccgcccctcggatccgggcgccgagcccccgaggacggccgtgcggcccatcacggagcgcagcctcctgcagggggacgagtgagtgcggggccccggccgggagtgggcgggagcctcccctacccctcgcccgaccggcagccctacggccgcagctcctccctgcgccctccttccgcccggacgcgggagtccccgccctctcgcctccttcctccggccgtcggcctcggctcgcccagcaatttaaatcccctgccccccgccgccacgagccctgaaaacctccgcctcggtacctcccgccctccttcctgcaaaccaaaccctcgtttgtattagaagggaatcgcccatgcagagcccatagttagagacggcacctcctg

SEQ ID NO: 93705 - DNA, 2614 bp, Homo sapiens
ctaaaatgtatgtatattttataaatatatattatatatattgtaagaatatatataatatataaactatatatatatatatatatatatatatatatatatatatataaaccataggtgcattttactgttttgtattttcatttttggaggtagtatacacagcagataatgatgagtatgatgagtgttgtgctgtttgcttttgcagtataatatatagttctaagtgtttaaattactgtatatacaatattcattataggctagcatgcttgttttaaagactgtcattctagtgtattaaaatctgaatgtaagaaaacctggctattcaaatgtgaattgaaaaatattttattctcagtactgaactatttccattgaacattcagactttttaacaaaaacaaatatcatcaagaaggcaatagctagaaaatgagaggtgcctttaaaaaaaaaaatgcagccttacagtgaggatgaagattgagtttggggagggggtgggagggggggcacagagagagagagagagttagtgtgtgtgtgtgtgtgtgtgtgtgtgtgtgtgtgtgcatgcatgcgtgtgtgtgtgtgtgtgtgtgtttaccaatctgtgaaggtcctgatttgtgaccatcaatgtctttttaatgtatctgctcaacttctaggacttcaggggacatttcatgcgctttgtgctcttctgagcaccatatatactttccaagaattttgaatgtgaattcctagaaatttcagtagagaaaacaatagctattctttaattatagtaaagttcaggtagaaggagaaattatttgttcaccaaaattatgggatctcattaatgttggctaagtaaatgtaattttttaaaggctcactttttaatacttcatatatttccctcttacaaaacagcatgtcatgaagttcttatgtggtaaagattcaactagtaaatatttttaggttaaatacctgaactagttaaaattccacctaagaatagtcttaaaatatttaaaaagcatctctcatatctacctctttgtcattgctgccattttaactgaagcaaatctttatgacatctgaaatgatggttggatgcaattaaaaaaaaatctatgttggtgcttttctcaggctttgtcatttaagttatattgtattaagatgtcacaaatcagactgaaaggcttagaattaattttgtttttctttgaaagaattgcttaaaattaaccatcaatgtttttagcgagtggagataatgaatctttggttggtgtctgtctgtgtgatgttttcaaccaatagccaaataattattgaacttacatgaaaaagagtgctaagtataattttatttagattactttattctttgaaagtgactacaaggctattaagtacataatcattcattttatttactcagaagttgcctctccattactgttaacttgtttagtaatttatataattgcagtacttttaagtgttggacactgggattcaggttgtatacaaagtagtagctgacgaaaaatatgtatatttttgtgaaatgtatcaagccctaaagttcattttagagaaaggcccagaaaaacgtatctgtgtttaaaaacaaaggacaggtcattcgtcaatttgaatcatttttacttttgccactacaaactttttaattggcaatatccatcatccaactggatcttcatgtcagtgtcagggatgccaggttgacaaagtatttaacagatcctttcagtttttgttttgtttttttaattctaaaaaaaacaaatgttaggccaaacagatccctagatcccactcattgattctggcggtattcctaaagtggtgcttagggggtcagaattttctggatctttgctaatccaagctttagatttaatttaaccaggaccacatgcttgtcatctctctgatgcaaattttcaaaatcattttaatttagattctaatgtctgcctgggtttttaacaggctgtgaaccagtgagtgccttgttaatgtagaatgatttttcccccctgggtgggtgttagttagctcctctctgaaaatgtctcagagaatggtattttaattgacttgtagagagctgctaaatttgttattatcagcaatcagaaagtctttggtctaccacacatctccctccctactatctcttcattgtttggctgaagtttgcctcttgtgagaaaacaatacaactccccttctccacacactttttttccagcccagattaataggtatcccctaccctaatcccaactctatgatctaataccttttttaggaggaaccacttctttttaatattgaaatctgctggttactttatgttttctcaagttcagttgactagagctgaccacagggtgtcatcaattcagattcctaaataaccctttctctccacacccagtcctccagctggtgagccctgggccagattgtttgatcttcaggtattttaaattttagttacatcaattaatgtaaattaatccaaatgctaatttttgtggtgcaagaagtttcttatgtaaattca

SEQ ID NO: 93706 - DNA, 1028 bp, Homo sapiens
atgacagagaccaatctagaaattggaaataaattattaacgtccaactttccaccaaaaaacatataaataggctcttagattttaaaaatattaaatctatagatattttaaccaattaaaacaatttctacatattccattccccacattttccatcgtcataacaatgatgcttctcatgatacgtacatctactccttgaaaaagtattctggtggtggtgtggctaatgattgacaaatatttctgtaaaatttctgcctgtttgcctctagaattctgcattatacaggcaaattttctttaaagctagagacttgtgctaaatttgcctgattttcatacagatatgctgtagtaatacagctaccttttcatttcatctttgtgctttggttaacaagcaggctcaagagactgctttgtgtaattaaatgaattgacctaaacatgagctgtcaggtgaatacttaatatttccatgcagatacagaattccatattgtgttcagtaaatttcttttggttcttcacagtgaagaaagaatgtttctaacctaacatttgtagaaggatactggaaaattccttccaggaaggaaggaaggaagatgccattacttggtgtatttatgatggatgaccacaaagctattgttctaccagttattaattaccttctaagatcttcagttactgctttattaatgtcactgaaattctaaaaaccaggacattcttcccccgttcattttatgcttcatggttgaaatttttctgtcagtgagtggaaaataaccatgagatacatagactgtagcgcaaatggaactgttgaaagttccttagaaagccagtgctgtggcattggagactacggagagagtcttctctaccagcactgcatgatctcagcctagaaatgagccaaagctgtcttccaaccagagtagcatatacatgtgtctgacttttcccctagcctgttgaacattcaatgaaaattcacagaatgaacaaattca

SEQ ID NO: 93707 - DNA, 1111 bp, Homo sapiens
cattaataaggagtaacaatctctttttccaaaggcaaactgatccactcgatggtagcccacctagaagctgttacaagtttagcagttgatcccaatggcctttacttgatgtctggcagtaagtacctcaactatggattatttatttgtccttaccattttcatgttaatgtaatttttccttttaattttttttttggatataggtcatgactgttcaatacgtttatggaatctagaaagtaagacgtgtatccaagaattcacagctcatcgaaaaaagtttgaagaatcgattcatgatgtagctttccacccatccaaatgctatatagccagtgctggagctgacgcactggctaaagtctttgtatgacgcaatgcatcatcttcaccttctagctgtttataagtaatcaactgcacacaagagatacagaagacgagggcaagaatcatctcgtcctgcccttttgttctgctgaaggagcacagagaacatttgttgaagtatagttttgcaattcatatactgttttctaaaactaaggtttgttcaggttgctgcaagctcagctgaatctgtgagcctgaggtctgtttcaaatttctccccaataggcgcctttatttctgaggtggttctaattcgctaggcaggcctgagcgaatacaagtttagcttgtccctgttgagtaagtagggcatgctacaatggataatttaaaagcttgatagctgggactgaatagaagaaaacgggaaacttagaccaagttctcccctgagaaatcttgttaaaacacattaagtagtcaaaatagtaatctttatcatatctgccatattaacccctttgtgtataatgaccaggcagtgttaaactgagtttttaatttgactctcctttcagctgttcacataaagcacctggcaaagcattttacctgttagggggagaaaaatgcaataatatgttaaatatattattattcagaaatgctagacaaatagtttgcaagcagatttctatattgtattacagttttgaaaacagatttggtatcattctaaagtttagctatcaagcactcaccattgtgaaga

SEQ ID NO: 93708 - DNA, 1302 bp, Homo sapiens
gtcatacatagggtagatgaaatacttgatttatcagtctgcttcagatagctcaaccagatgttgctaaaaccagatggactttcacatagattaggtgttttcagaagagaaaaatagtttactggttatacattgtgagataacatgtctatgcgtaactgcgatacagtgtagaaaacagtaagtacgtgactttaaatccagtttccatcaaagtcatagccagtattagggtatagtgtacctataataatggtgttctgagtaatgaataaactgataatttggacagtctcttcagtatgaaggatagacatattatccttattggaaaggcaaggaaataaaagtaccatttgctgatatcctactatgtgcatgattgtgtcctggggtgttttttaaattgtagaatcctatttaatcctgtgattatttggtgttattcccatttttctgttttgttttaaacggagtaatctgaagttcagaaagattaaataatttgcttaaagttagccaattagtgacagaactggaaattgagttcagaaatttatctcttcaaagctcatgctttttctcttgaatgaagctgtctttccctttagtcaaatagattatgacagggctaaaaatactgtaacatgatattattactaaacaagaatcttgtttcttgatgccatgaaagtataattggtgttaagtaagctttcttacgtatcgtgtagttgagaatggtatattcccataatgtttgtatttttaaagacaattttatgacatatgtttaattatactgtttactgacacttagaatggtaaagtcatctctctctgatttaggagcacttctcttgatgtagaacctatctatacattcagagcccataagtaagtatatgttttttctttattttaaaccgatatctctgtaaaatagcctggttaggatattttattttctttcacttactaggtattctttgtatttaggagtgtttttttaatgtaaaagaatttgacagataatataatgctaaaacgaagttcatcattgccaagtagggatttgtgcttaaattagattttatttacatggtgtttaagtgaggtacgtatttatatctttaaactagagccaactaggtttaaatattagaaattccagctttttttcctcatataatttggattaaaatattcaagtgcctcctttggtagtagataccctacaattggaaagatacagagattagcaaggcctcagtacaaggatgacacagattcacgaag

SEQ ID NO: 93709 - DNA, 1456 bp, Homo sapiens
tattttaaagttgcgaaagactggaaaggtatgctttttctttttctctctctgtagtgatgctaaagcttattaaagaccagtcattcctgttaggacattcttttaaactttattacttaaaagcatttaaacctttatttaaaatattttagaaattacaagcgtttagcttgatttgataaaaagtcagtgtctgttattgatgttaaaccattacataatgagagatgatgttgtaatgctatctcaagatagattaaatcagaatgagaaagattaatattaaaacataagcacatttcataccttttcgccaaatatacttactgatagacaatttaatcttaacaagcatagggagatgatttgtcttggcttttgagagtcatgacaaaaaaccagttaaactgaaattttgaggaaaatttgaatgtcatatgtgagaaataatttccagattaacttaatgttgatatttttctttaggtcattatgctacaaaaatgaatgtcttgaaatacaaaagatcctttagttggaaaggtaaccaggacttaggcacaatccatctacttttccattggttattcagttcttgtcaaatatcaaggcattgctgtagttggaatttaactgaaactgcaccatttgactggaacaatattcctactaatagaagcaattggatttcttaaatcgggggattaaaatgtgttcagacatctagcacatggtttttttttagtatggtgaagaaaaatgacactgtaagggagaaattttaacatctttcattgaagagagagggactacacatttcagcacattttgtttaatgtcttcagttcatgttatcttgataaaatagcaatctaggaacaagtaaagacttaggataaaaatagaactgaagccatgctttgaattgatatataaagcattgagttataaaccaccataaattttttttttttaattgaactagtactcattggaaaagtttgagtcttttcaatgtggtctagtagagatatttccagtcaaatcctgtactccaatcataccatcttgaaatacatttctaggcattagtaaaaattgcttaaaaatagttgtattctttgctggtataggaacaaaccataacagactttgggtaagattttcccattcttaattaaacttgtaacaggaaaaactactgaagatctgtttcagcctctatcctatataaaacagtcaaaacagggatgtgggagaatgaagaatcaaagtttaggtaagtaatcggtagggcatgagacttcacctcgggtaccatagcttcaggatgtaaggcaattaatgcaacttaatttaaacaaacagggatgttactgtttaattcagtgcacagtaggctcacaatctgtatctggctgcatttagagcaatattcagtggctaaagaatg

SEQ ID NO: 93710 - DNA, 1050 bp, Homo sapiens
catctctactgaaaatacaaaaattagcagggtgtggtggctcactcctgtaatcccagctgcttgggaggctgaaactggagaattgcatgaacctgggaggcggagactggagtgagttagatcatgctactgcactctaccgtgggtgacagagcccggagactttgtctccaggtagataggtaggtaggtaggcaggcaagtagatagataggattacaaagtacttaaagagtatccacttcttgtattgctttttaaatttgtgagagtgtaattgataagaatcaatgtagataatgtgatttgggatttatagttaccatataaatagaagttgatgtaacatatcatgggttacttcttatgtcgaagttaaaaagattaactaagcaggatatacatgttttacaccagaaaatctgagttaacagattctgcctccgtgctggataatttcaaattccttgaaagtgcagctgcagatttcagtgatgaagatgaagatgatgatgttgatggaagagagaaaagcgtcattgatacttcaacagtgagttagataactcatacaatataaatatttttagggactataatacatactgtataatgcataaaagaatccatgttctttaatcttaacccgtagctttttctttttcatgaatttggagacatttatgagagtttgtaatactgatttcaagttgagaatatttttaatatagtagctttctcttgaaattcctcactgtttgactttttgttcattcattgaacaggacaacttttctatggggcagatgaatatagtaaatattgtgtgttataacaatgcagggttattggttgttacaagagaatagaattgacagacacatcatggtgcctgatggcagctagcatcagctctaatatatgcagtttttgtctcttgtcaggattgttttggtaggcaaactttcagaactcttccattagagttcttcaaaattgtttagggttcttctcaagttttgttcagatgttgataagcttattgac

SEQ ID NO: 93711 - DNA, 1075 bp, Homo sapiens
gagcttcaattctgtagagtgactcgagaaataactaccttgtgtgtaatgaaggagacgatatatgctaggaacattctgtctagatcacaaacagttgatccatgacaaatttaaaaaaactaccggaataactattataaaatactgatttggtagtctagctccaatccagcctaaagaaaagaatgtgctattagatatattaaagaccagcttcttcttatggtaaatgtaatgaatggtgtattgtatagttctctcatttttctcagtgactgtagaggctggtactgcaagagacagctccatctgcagctggaagattatttattaacaagtcttactagcatagtactgtactgttaagtcttatgcaggcaatgagtttaaataaatacttttatttacatattaaattatagaatactgattccagtatgactgaactctaaggattctcttcacacaggtatctacaggaggtgggttatacagatactattctagatgtgaaatctaaacgagtgcgagctttgttgggcttttcaagtgatgtcacggacagggaagatgacaaaaatcaggactcagttgtaaatggcacagaggctgaagttaaagagacagcaatgattgcgtaagtattttgtctggaaagtgttttagctattattagttcttattaaatatttttggttttatggacattacttgtacttttaggtagtgacatagaaataatttataacttaataaaaattctaacattttatttggttagaaggtaacaaggattggagttatttatgactattttaattcaagaatattatttgtgatatttatttaatacagatatttaatagattttagtatattgacttaatcagtaaataaaacttcagaaaagattttatttggaaattcagtacaaatctgtaagaatgacgtttcatgattggtgatccagaagtcgtaaaaatacctcaaattctgtagaagtaacactgttttttaaccacttttgtttatctattaatgttgtaatttatctttgatataaaatatctat

SEQ ID NO: 93712 - DNA, 1553 bp, Homo sapiens
caggctaaggtgattctcccacctaagcctccctagtagctgggaccacagctgcgtgccactatgcccagataattttttttgtagagacagggtttactccatgttgcccaggctggtctcaaactcctgggttctagagatccacctgccttggcctcccaaattgctgggattataggcgtgagccaccatgcccagttattatttatttttaatttttaatttctgtgggtacatggtgtatatatttatggggtacatgagatgttttgatagaggcatgcaatgtgtactagtcacatcatggaaaatggggtatccatcccctgaagcatttatcctttgtgttacaaataatccagttatacccttagttatttttaaatgttcaattattgttattattggcttgttctagttctgatgtgctactttataatacttttatttggctctcattgtgtgacttgatgggataagtctttgttctggagaaaaattcttagtctagttaaagacagggaaaatgtatttattttagttctgctactcttagggaaatccagtagcaataatttatattagagttttgttatagaaattacagttaaaaaacagaacttacattatcctaacacataccttacagttgcagttttacatattcttaatcttataaatgtttattggacgttattaatgaattaagatgccctctaatacgtaaaacaagtcagttttattatgacttaatgttttctagatgaaggtaatgaaacagaagtgcagccacaacaaaacagccagttaatgtggaaacaaggtcgacaactactcagacagtaagtgtctcatggtgaaacttataaatggctgaagacaagaaacagttttatgaagttatttttactgtgtattttcaagtcagatgaatattttatctcatacagatgctgtgaaaaagcttaattgaattactgttcctttttcatattaaatactttttctgtgtggtagaacttacgtagttaaaagaattttataactttaaagttattcttttcattgcatattttatgtatgaatatataacattttaatatatgtgcaattggccaggcgcagtagctcacacctgtaatcccagcactttgggaggtcaaggtggatggatcacttgaagtcaggagtttgagaccagcctcaccaacatggtgaaactccatctctactaaaaacacaaaattagccgggcgtggtggcacatgcctgtaatcccagcttcttgggaggctgaggcaggagaattgcttgaacccgggaggtggagtttgcagtgagccgagatcgcgccattgcactccagcctgggcaacaagagcgaaacttcatctcaaaaaaaaaaaaaaaaagtgcaattggtgtttacatgcaattttgttatgttttaaaacttttaaataattggagaactttttgaattctccaaatttgcaaatattgcctaacatatatttcattcattcattcattcattcattcagtcattc

SEQ ID NO: 93713 - DNA, 1195 bp, Homo sapiens
atggtgaaacctcatctctactaaaaatacaaacattagctgggcgtgatggcgcgtgcctgtaatcccagctactcaggaggctgaggcaggagaatcacttgaacttgagagacggaggttgcggtgagccgagatcaagccactgcactccagtctgggtgatagagtgagactcagtctcaaaaaaaaaaaaaaaaaaaacaaaaccaaaccaaccaaccagtaacaacaaaagaaacccctttctcagctcccttatctattagtattgccatcctgtccctcattctccttcattttactctgaatttctctgaacgaccacatttactaccttcagttttttttactagtctcatctctctctctgttcctttgttgtctttctctttttctgcttttggttactcatttctcagtctcttgtgatcttgcttctgatctctattcagataattgattaccaaattatatatttttttcagcagttactctgactgaagtcctctcactctacctaattccttttctttggatgatttacaaaattatctctaactagtcttgatacttttttgcagttaaaattgtacatgtccagtttttgctaatgtcttcacctggatgacctactataacttgaaactcgatcatcctttctaaaatccttttcccaaacccagttgacccttttcctcagatctagcccccagtttaccctttctagaaacctagcctcagctttcactcaacctttcactttcttatagtcactcttctagccatgcattaggtttgtaaaatacgtagtttaaaatccatttttaatcatttaattactagtactacttcttccctggttacctcatcacctcatatctgggtgactaaagtagaagtcttccctaatatttcacttctggtttctcccttggccaaagtagtttacatagtattgcctcccaggcttctaaaaattgatttgtttaacacattctttttattttttatttttgcctgttataggttttaaatctctgcacgattagactgtttatatttcctacatattagagcacagtcatgaattacttaacaacagggatatgttctgagaaatacctaacgagacaatttcattgttgtgtgaacatgtagagtgtacttacacaaccctagatggtatagcctg

SEQ ID NO: 93714 - DNA, 1007 bp, Homo sapiens
gtatccatggccctagtaattcaacccagtactttatcttttgtttcttctttctgttctttatctgccaacattaataatagtttcatttattgagcattttctgtgtgccaggtacaatgctaagtgctttatatctacaatctattttaatccttgtaaaactgtatgtggtagatattaatcattcccaaatgcataggtgagaaatttgggaagaaaggttaaataatttgctgtagaaaaaggctgagtgatgggtctgggcatggtaagtagaagcaaatattttggcttttttttttttttttttctctcgtgcttcagggtcactgtgcagggctgaaatgttttcttctcccttgtttgcctggtgaatttctaatcatctttcaagattccattaattctgggaaacctgtctgacttccaggcacaaggaagcttcgtgcttccctaacagcttgtattacaaagcagaagcattgttatccagcaccatccagactggtggttgatcagttaatccgaaaagatgttaaaatggtatcttaaaaaatttgtttcaggttaatagtatatagatgtatatagtcctttcccaatgtaagacaggcctacccacccttcacatttttgtttcttagaatgctaattcgagttttgtattgtcattcttgaataagccacaattgtgtgtgtgtgtgcgtgcgtgtgtattttcgggacgaaattgttccacctcacatcatcaggcgttagattcttgggagtgccgcacaacctagatccttcgcatgggctgttcacagtaggatccgtgctcctatgagaatcagcgttgcctctgatctgacaggaagcggagctcagcgggtaatgctggcttgcctgctgctcacctcctgctatgccacccagttcctaacaggccatggacccatatcggtcagtggcccaggggttgagaacccgtcctatctcatacttggtatatatttgtttcc

SEQ ID NO: 93715 - DNA, 1110 bp, Homo sapiens
gggatctagctaaatgtgaggtatatcacctattagactgtccactctggaggggtagggtgtttgatttttgctccttgagtcctgcaaggctgtttgttgtgattggtcaatatcctaagggcaaaaatggctttttgttcctttacctcactgggttcccattttcccttttattttggccagataattccttcctatttttgtgttgcttttaagaaaattgtgaaaatattttgtccagaatttttggctgcgttcagtagaagaattgttgtggggcaccataactggaaactgaattctcttattttactttcaaaatctgacaaataagaatggccctactaatttttgggggagaaataatgttgacagacagcacttctttatcaagagatgtgcctatttagtcctgaactttatttcaaatctacttttctttgaatggtaaagggagacctacagtttttctccaaaatcttgataactgaagcagagtttaaaacaaacaaaaccctttgctatgcagtcaatgaaaggtgtttgaaagttcagataatctggatagagtcccctttgcccacctgctatctccttgatgtcagctatacttttgatttgctaatgtgtgtagcatccaggtttcaattctgggccattagaaataaaattgtccttggatctttggcgtttcttgcctcggtggccaatctgacaaaacaatctgttgaccatcataattggacagttgaaagtatgggcctcagagtcagacatctctatcactttcattttacaatttttctaggcctcatttttgtaaatgtgggtgataatatccctactaagcaggatcgctgtaaggtttaaaaaagataaatatgcaaaatatgtgatatatgatgggtgtccagtaagtggtttgcttttttgttggttgagatttctatggacagaaggcattagatttattatttatataagtcctattgtagaagccaagaaccagtttcagtgatccgtttatcatagtagctacttacattctctttgtcctgtaagtacaggttgagcatccctaatccaaaaaccccaaattcaaaatgc

SEQ ID NO: 93716 - DNA, 1064 bp, Homo sapiens
ttgtttaccctccccacgcctgttcgtccgccccatcccactcttaactcccagactcatttcaactctctggccatcctgcatctcagggctgccctctcggtttactaattgggctggcagtagttttgagagacgcggagcaaatcgtccgctgccctggtgtgccccttcctaggtctagagacagtctccgcagaacgtgccggctttggcccctctcttcaaggaaggtgatcaagaagacaacagaagttgtgtcaggccttgagtcgaggcgagaagttgacgttgggcaaaagtgttattcatatatcagatccctttttttatatatgtaaatgtctgttctccactttcttccgaccccccggccccctcccacgtttcttttaggtatttccaattaatgcattttgaatgaaggacctagatgatcgcagtcagagagaatggttaagaggtggttcctgttctcagaatctgaaacttcccaagggttaattttatgttcagtgttttgggagattttcttgtgctttaaaaggaactaaagggactttgaagttagttacattgccttgcataatctgcaagataaagtatatccagggaggagataactgtgggctctgaaaagaatgaaagtgaggctgatactttacaagccattcagaattggtgaataggttttcagtggttgttcttaaaacttccagggcatacacaccaatttcaaaaggaacttaaagaactatgaatagttgtgcctttctgttttacgggctaagcctgtatacttatgaaatttgagtatagttttagttggcaaaacacttgagtttaaaatgctacccagtgtgtcactttttttggtaacatgtatttggcgcttaagaaaaaaaagaagaggagaaatctgttaaatagaatcatgtgctggaacaggctctggtgtagtggaagtggctgtggaaagagcgaacacacaaggctgtagtagacaaggttatagtaagggctgtgtttgttgctagctctgtgaccttgaggaaatcctttaa

SEQ ID NO: 93717 - DNA, 1132 bp, Homo sapiens
tatactttcttcttttttttttttttttttttttttgagacagagtctcactttgtcaccaggctggagtgcagcagcgcgatctcggctcactgcaacctccgcctccctggttcaagcgattcccctgcctcagcctctggagtagctaggactacaggtgcctgccaccatgcccggctaatttttgtatttttcgtagagacagggtttcactatgttggccaggatggtctcaatctcttgacctcatgatctacccgccttggcctcccaaagtcctgggattacaggtgtgagccaccgcacccagccaaagtgtatactttctaatatctatacccagttatctttgatgatttaactgtatttttataataacgtaaaatatcttatttttttatcttatgccttactattttgtcctcataaatatcatattaggtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtgagtattacattctgagttttacttttatggagttcaaagtagtagttaaacaaaatagagacggtatagactagcaacaacagttgctatagtaacagtttaaatttctgtggcttaagtttgatgttgtctcagttagaatatgtactctatattgaatttgtagatagaagatatagagcttttttgttggctgaagcaaacatattagcaagcactgttacaataatagctgtatgagctagggtattctaaatagctatgggtaacaagtcattatgcataaccatagatgtatattgctgtactgttcaatgtttgtattttcatattctatttcagattcctagtgtgccaataaattatgttcctaaagtgctttgcaaattgtactttagttttcttatcaaaatcagtgtagaaatcgtcaacatttttttctgttta

SEQ ID NO: 93718 - DNA, 1059 bp, Homo sapiens
tcttgaaagaatataatatctttgctattttcaaagttgtgaaatatgtggattgtgttttttatcaaaaatttatttcatttcatatttttatgttattacacttatttttggaaaagttttcatttttgcattctatttttatttttagatgacctcttggtacttcatctctctgacctcattcgcatggcattcatggctgcaactgatcatagcaaccagctgcgaatggctgggctccaggcgcttgaagacattatcaagaagtttgcgtctgtgcctgagccagaatttccaggtcatgtgatactggagcagtatcaggctaatgtgagattttctatttatttaagaacttaaaattgatcttttgaaagattgctgaagaagtgcagacttcctggaggactgcatttggaactgcaatctgtttatttctgtagaatgcatctctttatctccattgtctgttacctagttttagtcaccccacaaatgaagaaataagtgtcaagctgttgtcactatttttaagttgtgataacatattagtgataaaactagaatagaaattccagctcagctttccagtcttgtgtttagatatttagctctgccctttaagagataaaaggaaccttcaaaagagtgttgtggatttgctgccgttatttttatatggcaaaccttcataagcatttttagaaatagatagcagttgccccttgtataatgaaggataaattaactcttaataacaacagttaaaggtattactgaggccgggcatggtggttcacgcctgtaatcccagcactttgggaggccgaggtgggtggatcatttgaggtcaggcgttcaagaccagccaggccaacatggtgaaaccctgtctctactaaaaatacaaaaattagcctggcagtagtggtgcatgcctataatcccagctacttcggaggctgagggaggagaatcgcttgagcctacgaggcagaggttgcaatgagccgagatcgcaccactgcactccagcctgggtgatagagtaagacc

SEQ ID NO: 93719 - DNA, 1055 bp, Homo sapiens
ctggagaagcagtacctggtcccctccctctcggagtctcagtcattgatgcttctgtggccctttttggtgtagtgtttcctcatgtttcttataaacaccggttagtataaagtcaatcaggtaatttttgttaaatatatattatgttaaacgaaaagtagattttctcatcccagttaactctgcaataaagtgagttattataatacttaaaacagtactcttacagatttactaatgtaagtgacagatacatgataaaaaaattgcatgcaaattgcacataatttgagactttatgtaagatttgaccctgtgtactagcatctgatatctgttgtattgtggactgtattttataacaaaattttcattatatatgctagaatgacaactgttggcaaaaaaaaaaatgcattataatagtttgtttgatagttcatacataggttttgactatatcttaaattaaggacatcagtttgctaagcctgttgactttgttgttgaggaagtaaatggatgaaaattccaatcactaataacgtttgtgagatggttcaagtctagaacttggaaactaacataattggttctttttgtaatagaagcattttggtttggtatattctgtatccacagacactattcctagctttagtaggcagtttgtatattgtgattttcccaaaaggaaaacagaaatgaattaatacaagaccatcacagataacttaaaagctttacaaaattaaaatgccttaaaagtattgttgggtctggtgtggtggcttatgtctgcaatcccagcgctttgggaggctaaggcaagagaattgcttgaggcaaggagtttcagaccagcctgggaaacatagtgagacactcatctctacaaaaattacaaaataaaaaatgtctttaatatgtaggttgcttgattaattgctttttaatttgaggagaaaaaagtttaaatatgaaactttacccaaatatctttaagaacatttggttgccacataaatgttaaatgatgttaaaggtggaag

SEQ ID NO: 93720 - DNA, 1083 bp, Homo sapiens
tgtgctgtggttcattgtacattattgggcaataaataataataatcatatcacatttaatatatttaaaataaagtatctttgtttgtgtgtgtctttcagacagggtcttgctgtgttgcagaggtttgtctcaatctcttgggctcaagcaatcctcctgcctcagcctgctgagtagctgggactacaagcatgctatggcacccgcctctctttcctctatttgagttttttggttattttaaataatttgggctaaaagacacaatacaatatatgaaaggaagtaccattattgtatattaaaaccagcatttaaatatagattttttttaaagaagagaacagagacttaattattttattcctgttgaacatgttgcagctctttgtgggcaatgattataattttcacaaaaattattctttttaatctgatctgaagttctgttttttaggatcttttaatgcacttcttagagaactggtagcggaattcactttgactgacaactcagccaacacaactacttccctcctcagatccctctgccattatgatgatagtgttcttcttggttcttggcttcaggaaactgatcataaatcaattgaagaccaggtaataaacatagaggaaaatgaaatactaacttaatctgaaacaatggtcctattacacattgtcacttaaaaagaaaatagtgtatagaaaggtttaatccccatttagtgttcttagacacttaaagatggcatcctggtggtagatagtgaaaaaagttaaacaggaagagtgagaatttggcaaattgtctttatttaatattctgtgtatttagataccttgtggtggctgtgataaagatcagttttaactggctttttggttattggtattttgttttgttttagtttgttttgttttgtgacaggttggagaggaatgagttagtaggttgaagatttagaacttttgcccactgaatacattatttcttatgtactttttaaagagtgattaaagccccatttaaaataattgtgggattaagatcttgtgtatattgttcacgcaat

SEQ ID NO: 93721 - DNA, 1033 bp, Homo sapiens
tctttcagcttttagaaataaaagttcacattgctatatattcaaagatgtcaggataatacgctattgtaatatttagcattttgataatgtttagtaaaaattgagtggttttaataaatcatggccgggcatgatggctcatacctgtaatcccagcactttgagaggccgaggcaggtggatcatttgagatcaggagtttgacaccagcctggttaacatggtgaaaccttgtctctactaaaaatacagaaaaattagccgggcattgtggcccatgcctgtaatcccagctacttgggaggctgaggcaggagaatcacttgaacccaggaggcggaggttgcagtgagctgaggttgcaccactgcattccagcctgggtgacagagaaagactccgtctcaaaaaataaaataaaataaaaaatatgagtagcttttttttctcctttctttctgttgtatactactatcatggttttcttctcagtaatcttaagtgtttatataaatattatttgaaactttacataggcagattggggctagagttttaaattttgattttttttctgggacattaagcccatgtccattcatagcagttgcatagctaccgatgaaatccagacttccctctcactttgtcatatcgttgcttcctcattctcatcttcctcagactttccatcttccccacacgtcccatcttcctcataccactttcatattttacatttgcccagagacccttagggactacccagtactcagagagtaaaatataatctcctttgtctggtaaactggtatcttataatttgacttcattccgccgttcattcaaatttcctgttgctctaattagactagttatcttccttccttccctggcctttttcagcttcgaagcctttgctctgctaacctcttagagtttcatctcccctcttattcagctgcaccaaatttaagtctatactagccattctgtgtggatgttaatacagcaaagtaccgagaacagt

SEQ ID NO: 93722 - DNA, 1079 bp, Homo sapiens
gaagcccgtcgaaaagaagaaaagcaacaggaagccaatttgaaaaacaggcagaagagtttaaaagaagaagaacaagaaagacgtgacattgggttgaagaatgcactaggctgtgaaaacaaagggtttgccttgctccaaaagatgggctataaaagtggtcaggcacttggcaagagtggtaagtcacatgtggaaataaacaggtattccttaccacctaattgtgacttatggataaggaccaaagctgatgctttaatctttatctacacagaaattataacaacttaggctttttagtctattatgtattaacaagccttatggagagcttttcatcatcccacatccattttagataccacatgtgccatcaagagctgcttatcagcccagcttagctgaaggcactaacaacctagatggatgtggcttacaacagaagaagcaaagaatggtgataagtgatgggttgagaagtgcaatggctaaatacattgaaacaacactgaggatgatggcaagactttgccctgcttgctctgtacctgtggcagccatctgaatgaccgtccagttggagaggctcaattctcacctctctttttaggaagtgaaactgcttattaagctagagaggctatatatttatagtaacctctgtaaaccgtttttctttcctttatcgtaattgctttgctttcacttaaggctgtcaccgtcttgcaccaataatatcagtgttgttccttcttaaaactccaccttcaggtggcataggaggctgtgaatcagcctttttgatgagtaggtatttgaagacaaggtagataattgattatatatagaatatatatagatgttcagatttcaattttgaatatcattgaaacaggagggcatatgcatagagcattgtaaagttgcatacttatactgttctgtagtttgaggaaaattttctaaaatagtttgtattcattctctttaagggggtggtattgttgaaccaattcctctcaatatcaaaacaggtacgtaattattttggagcatatttgccaataataata

SEQ ID NO: 93723 - DNA, 1003 bp, Homo sapiens
tttctgatttgaaaaattgtttataatattactataagatgagattaacaatctttgtaaaaatcagattatgttttgggcttaaaaaaaaccctagtgttttctactattagtgtactcaaatgatttgtgagtgatagtactcaaatgagaattgcatttaatttgtacatagttaaatcgtcttgttttgaagcacaaagtcaggatgtttctcatcagaattttctgtttgaatagggaaaagtggcattggtcatgaggcatcattaaaacggaaagcagaggaaaaattggaaagctacagaaaaaagattcacatgaaaaaccaagctgaagaaaaagctgcagaacagtttcggtaaaactatttttgagctggttttggttctatttcctctttattgtggtatgttctctggtacttgggcatataaaatggttaaagataacgtagacctttagtttacaattttttctttcaattagaatgcgacttaaaaataagcaagatgaaatgaagctagaaggagatctcagaagaagccagcgagcctgtcaacaactggatgtccagaaagtaagccttttaccagctttcagtttagtaaagtgttttggcaccccctgtgatttcccgtttatttattatatatatatatattttatatatgtattatatatatttatatatgtattatatgtttatatatgtattacatatatttatatgtatcatatatatttatatattttttacatatgtcttatatattatatatattttatgtatttatatatataatatatatattatatatatatataaaactaagaactccaagcccggtttatctactcattaaagctttcatgtaatgtgcacttctgatctgtgacaattgatataaaaatggcttattatttactatagtaacctgagttgtctgggttactataaaacccagggttttatagtaactatagttttatagttttatac

SEQ ID NO: 93724 - DNA, 1071 bp, Homo sapiens
tattttgattcaaatttgtttattatatttagatttctattttgtgacatgttttggggttctttttttttctttttttttttttttttgtgagacggaatctcgctctgtcacccaggctggagtgcagtggcgtgatctcggctcactgcaagctccgcctaccgggttcacgccattctcttgcctcagcctccccggagtagctgggactacaggcgcccgccaccacgcctggctaattttttgtatttttagtagagacggggtttcaccgtggtctcgatctcctgacctcgtgatccgcccgcctcggcctcccaaagtgtttttggggttcttaagaagataaggtataagcttttaaaaagttatgaaaaactttaaaaagttataaaaaattttttataaatttatatttattgttacttttaacatactgtgaattttatacccaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaaggtaagtggaaaatgtactttattaattgatatatatataatatagtaattttaaaatatatcttctcagctgggcacagtggctcacgcctataatctcaacactttgggaggctgaggcaggcagatcatctgaggtcatgagttcgaaaccagtctggccaacatggtgaaaccgtgtctctactaaaaatacaaaaattagctgggcatggtggcgtgcgcctgtaatcccagctactcgggaggctgaggcaggagattcgcttgaacctgggaggtggaggttgcagtgagccaagattgtgccactgcactccagcctaggtgaagagtgagacttgtctcaaaaaaaaaaattatatatatatataaaataagatagatagatatatatttttttctctagttttagaatagtggttgattgata

SEQ ID NO: 93725 - DNA, 1034 bp, Homo sapiens
tgcaacctctgcctcccagattcaagcaattctcctgcctcagccttccaagtagctgggattacaggcactcgccaccacacctggctaatttttgtatttttagtagagacggggtttcaccatgttggccaggctggtcttgaactcctgacttcaggtgatccacctgccttggcctcctgaagtgctggtattacgggcatgagccatggcacctggacttatcatgacttttgaaaagccaggagttgactgtgactgcctggggtgatatgttacgttagacttgccctgggaggagtgagaggactactctttgtgagtcaagagtttctgccaagtggatctttcttattcagaaggagagaatcaaatttgttttattgtccatttcacaagtgacattaaagggaaaggagtggggaggcgggggggtgggggttgagcatgaaatgtcaaaataacagtggtttttatctttaaggtttggcatggattttaaagaaatagaattaattggctcaggtggatttggccaagttttcaaagcaaaacacagaattgacggaaagacttacgttattaaacgtgttaaatataataacgagtaagtagtaaatgtttacatttttttgaatggcaaggtacgctgaatctgcactattcttttttatgcttctctcttctttattagggtatcatttatttctttctgatcctcattaaacatttcattctaccaagaggagtttggcttactccgagatgatctcactttactgtggttatttcaataaaaatggatataccattgatcatccttttggtgctatcttcagaactgaagctatagagtcatttgctttaaagtgacatgcaaattcatgaaatgctccgtattttaaaaaccgtggcaccagatagaacctatcattacccacaaaataggtgatctttgagatgttctagtcttaccttcttattttatagatgaggaaactaagatccagagatgtgaagtgattttgtct

SEQ ID NO: 93726 - DNA, 1835 bp, Homo sapiens
tggaagcacagagcagagttaaagagaaggaccccctttcactgaccagttgagttttttttctttcctttattttttaaaacaatttcaaaattgagatggggtttcgccatgttgcccaggctggtctcgaactcctgagctcaggtgatccgcccaccttggctgggattataggcgtgagccaccacacctggccaagttgagtttttaaagtagaaaattttggagaaattaactttattgtgcagtgaatgagaaagaaagaacggttttgaaagaaagtctctgcatttatgtgagactgagatgagtcctataaaggggagtctccccaacccctctgtctcctaaactgcattgggaaactcagattaaatatgttctgtgagcatcactcattcaaatgtctcttccattgtaggatacgggaagaagaaatggctggtgatctttcagcaggtttcttcatggaggaacttaatacataccgtcagaagcagggagtagtacttaaatatcaagaactgcctaattcaggacctccacatgataggaggtaggttgctataaaaaatgatatggcagccataaaaaatgatgagttcatgtcctttgtagggacatggatgaagctggaaaccattattctcagcaaactatcgcaaggacaaaaaaaccaaacaccgcatgttctcactcataggtgagaactgagcaatgagaacacatggacacaggaaggggaacatcacacaccagggactgttgtggggtggggggaggggggagggatagcattaggagatatacctaatgctaaatgacgagttaatgggtgcagcacaccaacatggcacatgtatacatatgtaacctgcacgttgtgcacatgtaccctaaaacttaaagtataataataataaaattaaaaaaaaaagaaaaaagatatgaccttataaatgtaagctgggggaatggcaactctggcacaactttgaggtcaacactttagttttgtgagagtgctcttggcataaagtgggaaccatggtggagccacagttgactccagagagaaaagagggtagaaacctttccatgcttcaacaagacatgctgctttactgtttgaggtgactgcttaaatgctatattgaatgtaggttcaaaccctcaaaggtagtcataggaggtagtgatgactagagtacttgtttttagatagtgcatgagttgtataatattttatgaatattctctttgtaatcaggtttacatttcaagttataatagatggaagagaatttccagaaggtgaaggtagatcaaagaaggaagcaaaaaatgccgcagccaaattagctgttgagatacttaataaggaaaagaaggtgagtgattgccttttttcctaataaatgggaacttgcaaatacattttctgtttctctctgtgagaaaatactttcatacagagtaaagccattcacacgttcccttacattcaagagtttggttaagtcattcaccctatcttcatttctatgaaaccctgagtgagagccacacctaggacaccatgggcaaagctggataatagttatttagagtgtcagcagcagttaaatactctaaagttgaacaaatatggaaaggtgagaagtgttcagtgggaaatgagctgacaggttctgggaggagtcccctccacctaaatgaggaagtacagtaaaaaaggaaaaagagatgaaagtgattgtagggagaataatgtacagtggtcactcactctctgtggggaattggtaccaggactccctgtggatgccaaa

SEQ ID NO: 93727 - DNA, 3116 bp, Homo sapiens
gcggctgcagggaaggcggagtccaaggggaaaacgaaactgagaaccagctctcccgaagccgcgggtctccggccggcggcggcggcggcggcggcggcggcgcaggtgagcagggcagggggcagccgagggagcgcggggagcgggggccggggggccacgtacgaggggctgcaggcccagccggggcgggactcgccaatcctgcgtccccagctcaggacgcggacgctgatccgaagcccctggccccggctgggtcagcactgggagagcaggcccaggtccgcagcccgggtgtggggccctccccaaatccagggaaaggatcgtggagcggggtggggactgaaagccatttccttcccgtgaagaatttttatcagtgcaagtaacaaatatttcccaggcagcagttgtggggcggggtctagtggaagacgaataggcctagtggcttgacacatggaaaatacggaggcctgaaatactcatagactggctgaacaatctttggctaaaaatctcttccgtggagagttgcagtagtttcccaattgcctggccgcagttcctgttcccactccgtatcctcacccctgaacctccaccccctacctcttctccacacctcagcatctggaatgttcctttaagtaagaaccagactctcccctgctccgaccttccccgtagctttcctgtctcatcagaatcctataaacatttattaaggctcacaggcaaggcccctcgcaccccctactccggccacgctggcttccttgctgttcctggtgcacagccaagcatcctccagcctctaggcctttgcactgcttgtttcttctttctggaaagcttcttccccagataactgcatggggaaatccctcccttatcctgcactgcttcccatgccagcttatcagagcagccttcctcaaacaacctgcctatacaagaaaccccgctctgcccttgctgttcccccttccactacttcggttgtcaacatagtagttatcacctggtgacattttctttcttttcttttctttttttttttttttgagacagattctcactctgtcgccaggctggaatgcagtggcacgatctgggctcactgcaacctctgcctctcaggttcaagcgattttccttcctcagcctcccaggtagctgggactacaggtgcccgccagcacagccaactaatttttttatttttagtagagacagggtttcaccgtgttggccaggctgtatgtagtctgctggaaaggaagtggaggcatagccaaaataatttctgggcattagtaagatggacaaatattattttttagtgattatgatggaggtttcttccagatgagtgaataagatgtagaatctgctccccaaagagctcactaattagtttaaaaagcagtcagggctgtgttgaaggttgggcaaggtggagtggcaagcccatactagctgaccctccagcatcaaagaaggctgtgttgatcctgatagatgagtggatattggtgggtacagagagaatgcagatattgcactataaatgtagagaaaagcaggtgacaagtcctggatggggtatctggagatattttggtactcactcattcattattgagcctggtcccttacctgtagtaattcatgctctattttggaaaatagttaaataagcaattttaataaaggggatgagcactgtggaagagcctgtgaaggagtgtctgggattttgagctgaaatctgtaggaagtagaaattgaccaggccaagacagcagaaggaatagagtcaagggcattttaggagggagcaggttggacagaggcagttgggagttcaggagagagtccatggtggaagcgtgcttttgagaaccatcattgtgtccgtggaatttaaagccacaaacctggaggtgatcaccaggggagtgagtccaagtagaaaagagcaagtctaaggaccgggcccagtgatgctagaatatctagaaaagaggaagttagaaccatagaaaaggttaaaaaaaaaaaaatagaagaaaagaagttgaagatgaaccaggaaaggagacagaaaaggagtagcttgtcagaacagaagaaaaccaggcccaggtgccatggctcatgcctgtaatcgcagcactttgggaggccaaggtgggtggatcacctgaggtcaggagtttgagaccagcctggccaacatggggaaaccccgtctctactaaaaatataaaaaattagccgggcgtggtggtgggcgcctgtaatcccagctactcggaatgctgaggcaggagaatcgcttgaacccgggaggcagaggttgcagcgagccgagatgccaccatcacactccagcctgggcaacaagagcgaaactctgtctcaaaagaagaaaactaggagagtgggtgtcttaaaagtccaagctaagacagggagaggagggcgaagaggatgcgcaaccccatcaaatgctggttgtaagtcaagtagagaaggactaagaactgactactggatttagtgatagggaagccattggtaacctcgacaaaaacaatttcagtggcttgtggagactgcatgattgaattgatgtttttttgtttgtttgttttgtttttgtttttttttttgagacggagtttcgctcttgttgcccaggctggagtgcaatggcacgatctcagctcaccgcaacctccacctcctgggttcaagcgattctccttcctcagcatcccgagtagctgggattacaggcatgtgccaccaccccggctaattttgtatttttagtagagatggggtttctccatgttggtcaggctggtcttgaagtcccgacctcaggtgatctgcccgccttggcctcccaaagtgctgggattacaggtgtgagccaccgcgcctggccactgaattgatgttttaaaaagatcatgatgtggctgtattaaaaaagaaaacagataataacaagtgatggtgaggatgtggagaaattagaaccctcgtgcattgctggtggaaatgtaacatgggtgtaaccactgtggaaa

SEQ ID NO: 93728 - DNA, 1069 bp, Homo sapiens
tactaaaaatacattagccgggtgtggtggcgggcgccggtaatcccagctactcggtaggctaaggcagggagaattgcttgaagatcgcaccacggcactccagcctgggcaacagagcgagacaccgtctgaaaaaaactaaataaagagtgtaaagcttttttccatgtgtccattttaacatatcagagtgaaatattgcactgaaaatggtaaaatcatgaagaaatattctaacagatatctgggtctactgttttttgtgtgttgtaggtgaagttggtgattggaaaaatttgttcagtgaaattcagaaccaggaaatggatgaaaaattcaaagagtgcttagcaggcacctccctcggagcaaagttgaagtatgaatcatattgccagggttgattccagtcaattcagcaggcctagatttattttccttaataataattaagtgtaaataattaaatgataattcaatcaaataatcaaataataattaaacaatattgaaatctaaataatacaatacaaaataataatacaatttaataataatgataacatcggacatttttgagcacaaatataagtttgttcactttttcaagaaaggatatttcagcagtcccaaagggacactattattaatacatcacactggagttttaacttattttgtgctctaggttcacgtaagagggtaaggagatactatcagagacatacctaaagctgtgtttggccatagatgacacaggcctccaaatggtgcacaattttctgtactttgctcgtaatataactcctttcttactatggataaaagcacttggggtggctatctcagacaatgttgggggagagttaattccaactctgcaataaattccattctaatttggttcaagaaaaatgcattgctaatctgctccatgtatgccattgcagtaggccttaggaaggccccttctcaagggaccttatatttctacttaatatgacctttaattcaaagctaaaggtaagagattgtgttattttaccgtaaagactttttctttttc

SEQ ID NO: 93729 - DNA, 1028 bp, Homo sapiens
gggcagcagagaaagaccctgtctaaaaaaaaaaaaaaaattcttcaagtttttatgattctaaaaattagactttcttaatggaattaaacattagctataaatagaattcagaaaaaaagagaattcaaatgagcacataggaatacattaatttcttcagctggtctaagttggtactttttaatgcaatgatatcatcctagataaaattataacctgtgaattaatgttactgtcattatttacatgctaaaaactattatctggtaagttcaacaagagtcataaattgaaactacaaagtataatcaatacagaatatcttacagagatatctcaatatttacataagaagatgaaagtactctaagtttaaagtgggggatgagatgaactagggagttaggctgaataactctgatgactaaaaagtctgtctcagctcagagaacaatttccataggaagaaatttatctttaagaaaatttttttacagaatctggctgctggaataaaacagattgctgagttcttgggattctttctaactggggagcaaattcaaactatctcagtccagagcaccttccaagccatgcgtgcgaagtctcaggacacacacggtgctgtcggcccattccttttccgcaaaggtaaagtcgcattggtttctgggattgttatcagttagggactgactttgcacacaacaggtaatccaaataacttcatcttaagtcagatagggttttatttttctccgcctcagtaagaggtctggacacaggctctccagagctgtaactggcagccccataccatcttttttggtttatttgtttgttttgagacggagtctcgctctgttgcccaggctggagtgcagtggctcaatctcagctcactgcaacctccgcctcctgggttcaagcgattctcctgcctcagcctcccgagtagctgggactaacaggcgcgtgccaccacacccagttaatttttttgtatttttagtaaaggcagg

SEQ ID NO: 93730 - DNA, 1583 bp, Homo sapiens
taagtggagtaaaacattaaaattaatttcatttgtttcttttgttttttaaaattacgtatatggctagcattacatttttattgaacaacgatggtctagaaaatgtctttttcatcatttctttctggcattgtctctgtcggatttcatgtgtcattcactatttctgaatttttttaatccacctaaatattcatgaatgtcttatagtttttataaatcatttttgtaacttgcttaattttgtgttatttatgaaaaatgttccaaaaggtaagaaaataaatagaaatttagacaatgggactgatttatatcagctttttggtggcagggatttataataacataaagatatctcgagcatatacacatatgtatagtttatattttatagcataaattaatgatcattttaacctcagttatttgacatttcttaaagtcttcccccctgtgtttttagtttcttggggaaggtattttgattttgcaatcaattggaacaaacatcttgatggcgacaatgttaagttcatattatatgaagacctgaaagaggtgagattattattgatattttagagcaaaatttattgtaaactacaacgtagagcacttacttataatgtctgtttgtataaacaaatatggtgttcaatttttaaaaatattccagatatatggtacagtgctggaaaagaaaattcaaaccatgcatacatgcttaggttgtttatttaacagaaataaaataacgcttagcaacttattactaaaagtgactgctttattttccctttatgatggatagttcaaattggtaataaaaaaaaataggtaggtctgagttgatttaattgaacatacacttggttgtgaactaatttatccagtcattttttaaaaattgtttattgatgtaacaaatatctagtgagtgattgctcaccaattaggccctggtgttacatcagtgaacagacaaggcaaagatcgctgccctgtagtaacttacatgccagttggagaaggtggaaagaaagaatgatacataataaacacaataatttttaaaatgtatatagtatgtgagaaaaaaagaaacagcatagctggtgaaggaaaattaaaaatgctggggggccaggcacggggaaggattggacaaattccagtgtaaaatatgatgtttaggctggtgtggtggttcatgcctacaatcccaacactttgagaggctgaggcagggggatcacttcaggccaggagttcgagaccaccctgggcacatttttaaaaattaggcatgtacctgtagtaccagctactcaggaagctgagacaggaggatcacttgagcctaagaggtagaggctgcagtgaaccatgattaggccaccacactccagcctgggtgacagagtgagatcctgtatcaaaaaaaaaaaaaaaaaaaaaaaaagaataggaagattaggagagaccttactgaggggatgtgatttgagcaaagatctgagggaagtgggggagtgagccaagtaggtaactggggaagagcatttctggcagaggga

SEQ ID NO: 93731 - DNA, 1635 bp, Homo sapiens
ttacattcttactttttctgtaggagaaatcataagctactccacctactaatctaaaaccatgttgaaaaaatccaggtgttagctgacttgttcttagagggtccatgttgccccctgttggttacagtttcctcttttatgtggccccaaatcttgtttttagtcaattctagacttctcccaaatgaaagtgaatatcacaaatctgcactttgcaaaatccacatctttcccctttctgaaaatgaaatgacttctgcctgttctagttgtctggcctcacatgttttcagattcctcggaattcaggaacatgctggatcatgtgtcctccagtttcctcagttcttgaaatagaaggcttcaggccagaaggctgaactcagagcagacgtgtgatcctctgcaatcttttggttctctggggtttcagtttgttctttacgatgtttatttcatgctactcatccaaaggaacactttcctcatcaaagaaggcagatataggaattcagacgttctgtgtcatgtactcacccataaacatcatacccagagagtgggctttgccattctttaatcttctcctaccaactctaaaacattatttttgtcgtccttaacattatttgcaatttttatttgaggatttaagctttcaggtcatactcttgtgattatcctagtgagcttggtctttttttcctttttacatcttctgtgcatcttattgcctaaattcatttgcaagaatcctttgcaacaatatcaatctttttcttcttctttctctcctttccccagatttccccatcagccacctcctgttcctcagtttcctactgtcattctttctctatatattaacacaattatgtaatatacgagtggacatgatgatattgctcacccttttaattttccaaatttcaaaacatagacccaaataaattaactcaatttttgctccctagatattggtgatatttcgaaaccctaaagatacagcagtatcttttttgcatttccacaacgatgtccccgatattccaagctatggctcttgggatgaattcttcagacagttcatgaaaggacaaggtatggctgttggtaaaagaattattcttacttgatcagatgaccacataaatgtgaaaacccaaatgtgttttagggtaaaggaagaagatttaggtagatctgggaaccaaaaagtttcatttaaatgaacggtcatagcaccattagttctgtgcatccaacaattaaatgcattgctgttttaaaaacgaatttggggccaggtgtggtggctcacgcctgtaatcccagcactttgggaggccgaggcgggcagatcacaaggtcaggagatcaagactgtcctggctaacacggtgaaaccccatctctactaaaaatacaaaaaattagcctggcgtggtggcacgcacctgtagtcccagctactcgggaagctgaagcaggaaaattgcttatacccagaaggcagggattgcagtgagctgagatggcgccactgcactccagcttggcaaagcgagactctgtctcaaaaaaacaaacaaacaaacaaacaaaaaactaatttggacaagtcgtatgttg

SEQ ID NO: 93732 - DNA, 1192 bp, Homo sapiens
tcaggaaaagtttatatattcagtactacagataagttttttttttaaaggagaacctttttcgctgttataaacaacttcatttatagcataataaacatactttcagtcaatttctttacaatctaaagacccctgaactaaattttatgttgtgtcttaagtatttcaaaacccatccatgtcaaactgataattttactattgcttgatactatgttatttcccttatgggtaaaacttcgatcagtggccaaatctgaaaagcaagaagacactcttgtcatctgaacagttctattaggatgttgttagctttttgaaaatattatatactaactcttaaattatatttaaatgccagctacccaatggtgccagaagattattgcaattgtttttacccaagtataatttttaaaataaaatcatgttgcattgcatttttctaaaatcattagatttataattgaataatgtagacttacaattttttttagggccaagaaaaaagaaaagaaacttaaatgattccagcctatttgtatctgctgaagaggtaaggctaatgtactgttttaacaagctagctattctacattatttttagttttctaataaatttatcgtttttgtttaaaagtttggccatctattggatgaaaatatgggatccaagtttgataacattggcatgaatgccatggctaacaaagataatgcaagtaagtaacttaaatttttttattgatgttttaaaaatagctttggcttggaacttcagaagataggaaattttcgttattttatttattcttttttttttttttttttttttttttttttttttttttttttttttttgagacagcgtctcactcccttgcccaggttggaatgcagtggcatgatcttggctcactgcaacctccatctcccatgttcaagtaattctcctaccttagcctcccaagtagctgggattacaggcatgcaccaccacgcccagctaatttttgtatttttagtagaaacagggtttcaccatgttggccaggctggtctcgaactcctgacctcaagtgacccgcctgcctcggcctcccaaagtgctgagattactggtgtgagccaccatgcctggctgataggaatatttttgaaagaccttttcatggtactttacaacctg

SEQ ID NO: 93733 - DNA, 2017 bp, Homo sapiens
ttgttttggtgttcacttgtcataaacagcagaatcatgacttagaataattgattcagatacaagatatatgtcaagcttgtcattctttgttgtatctcacatttctgtattgtctggcagacacatttgaagatgataactgtttcagctctggaaaggatgatatggattttgctgggtaacatacttctatcttctccttcctatttttctagcatttcccaaattgttgtccctcagaacagtagaccacagaactatatgataaaggggaaatgtagtcaagtaagtttgggaagtggatacagtactttcatctttgacatttataaagcacgttattatttactctgagcagtctgcaaagctttctccttctgagtcatttaatagcctactgccctagtagtcagcaaaacactactttagaaaatactgcctcctcttgtattacaagttgtgtttttttccagaaacgtgaaaaagagaacaaaaggagctaaggataacacattagatgaagattcagaaggtagtgatgatgaacttggtaacctggatgacgatgaagtttctttaggaagtatggatgatgaagaatttgctgaagttgatgaagatggaggaacattcatggatgtgttagatgatgaaagtgagagcgttccaggtaagcattttttaaaataagacataaactgtgtcttcctcacttccttagccttaagtttgtttttctgctaaaggtttttaatatagccctgtattcaaattaatactcatgtcagccagaaacttaaaaggaccttttcccttctcgtttggagctgaagggtttttattgtgtgttatgtgtgttttcttttaagcagctttttgagctttggacttttactttaaccagcagctagcttctctgtacaatacatgttgagctgaaatgctgccattttttgatagtaattagcagtttataaaagttaatcagtattcatcatagcccagcatagatgaaggtgaatattttatcttgtaaattagcaaggaacacccagaattgtctctagactgttgtctgacctttctgtcctttcacatacctccagcatgcacatgcctgcccaacattcttcttacttattctgaaccacagcagaagtttcttgttttaaggggttttatattatttggtcttattaatgaagctatttagaaaattttgtacttgcacaaaatattagaactgtgccaattcttagagtctttttctcagtctgtcctcaagcctatgctagtggaattacaaaacccacatggaatagcagtatagtgccttaccatcagaataaagattttagcatatcttggagtaatattttccagtcttattgtttttaaattgcttattagcaaattttttcgtgtaacagaacttgaagtccactccaaagtcagtactaagaaaagcaagagaaaaggtacagatgattttgactttgctggctcatttcaaggtaagaaaatacatttaatatcttttaaaagcagtgtccatgtgaaaggtgtcattatcattttgggaaatgaactctcctaaatttgattaataaaattcaggggtggggggggttctttttaagaaagatgttaagtggaaattattttccacattttgaattgtttctcgcattcagatatctctggatcatcttttcattcactttttaaaaatttgttatcattatttcagttgtttttggggaacaggtagggtgtttggttacataggtaagttctttagtagtgatttctgagattttggtgcacccatcactcaagcagtacactgcacccaatgtgtactcttatcccccactgcctcccactcttccccccaagtccccagagtccattatatcattcttaagcctttgcatcctcattgcttagctcccatttataactgagaacatagaatgtttggttttccattcctgaattacttcgcttagaa

SEQ ID NO: 93734 - DNA, 1518 bp, Homo sapiens
gattcagtgcactgttatagaaataagtcctaaaccaactagtatcataacctaatgccttagggtagtaaagtacctcttatctcatctggttgactggttaattaggtttgatttggcttgttttttaaaatcatttagaatgaataattttgagggtttgattacatctgtaaatggctaagttttgctgtattctaatataagaatagggctgataaaatattatctttgaaatgtattacacttaaaagattccagctactttttattgagttaaactattttttgtatattagatacaaatttcagtcatttatttccaattgagtatacttaagattttacagttgtggtttgccactggtcataggtgctttgatgatatatagtaagattagacctttaataaaattgtcaaatatataacatgaatattataggtattataaaaaagttgctgttaaagagaaacaaaaacgggatgcagatgaagaaagtatagaagacgtggatgatgaagaatttgaagagctgattggtaatttgttttgttgactctttgtaaaataatctactactatgtgttaatagaccatggaacattagtgggagaagtggccttagttttaaaaaatcacttagctaagaatatcatgcaaatcacagtggaagattaagaaatatttggggccaggcgctgtggctcacacctgtaatcccagcactttggcaggccgaggcaggaagattgtttgaggtcaggagttcgagaccagcctggccaatatggtgaaaccctgtctctactaaaaaccccaaaaaatgagctgggcatggtggcacgcacctgtagtcccagctactcgagaagcagaggcacgagaatcgcttgaatccaggagtcagaggttgccgtgagccaagattacggcactgcactctagcctgggtgacagagtgaaatcctgtctcaaaaaaaaaacaaaagaaacaaatatttttatgatatatggtaattcacccacatttgcaccagaaaaatacatgatttgtgctttggatagtctatataagaaaacatttatatttgcttaagtctattcaattgttacagccaaatctcatgtgaaaaagaaatcctttttactattcataatctattatagtatatcagtactaattgatagcaatagtctactgtttgatcttttttatctttaatccacagagctacagaaattttgattgaaacttaatagacttaaacaaaaaacatggtaaattggaaagacttacactgatttcacgttacatatttttttgttgttgttttttggggggtttgtttgtttgttttgagacaggctctctctgtctcccaggctggagtgcagtggcacaatcccaactcactgcagccctgcagcctagaccttctgggctcaggcgattttcctgcctcagccccacgggtagctgggactacaggtacatgccatgatgtccggctcgttt

SEQ ID NO: 93735 - DNA, 1637 bp, Homo sapiens
ttttcatccctccgtggccctttttgcaaagaccatccttcaggtgagtctaaaataaatccaaagatgagaaataagaaaaaaagtatcattttagataatcaataattggtcatacagtgttttctctaacagagagaatcttgtacattttactgctcgtataaagaagcagtgacttgtttcatacagagtagcagataacttttcccactctgagatgagtggaagcaataagacattgaaagccacgcagttatttatttattaccttctagctcctctcctggagaaatactgcctcactttcccatttgctgtgtttgccacttcagggtttggttcctgattaatggttagatggcctgcattattaatattagtctatccatcaaatcaacattacatcctagaatatgtatgtatatgtatctgtgtgtttaattttttaagtataatgtgcatgagagagatatttgaagagtcatttattgcatatttgtatcttcaatacagtgtaatagaaattatctttttcttcctttttcttacttggattcatagacataatttgaattaagtttttaaatccccgctccacttttcagggaaactatattcagtattcaggggacccactgcaggatttcactctaatgagatttttggatcgatttgtataccgaaatccaaagccccataaaggcaaaggtatgcttctatttagtgaattatttggctttcatttttaatacataataaacaatatgagcttataactaggttttgcattatactgtcataattttacatttcagaaaacacagatagtgttgtgatgcagccgaaaagaaaacattttattaaggatattcgtcatcttcctggtaagtataaaccttagacagttgaaactgaaaagacaatataagacaaagatgcataaattgtattattctttgttctaatttatcagaataaaacctgagcatcaaagacattatccatcttttttcccaagaataggtattcttaaatctactgtatctgactgggcctttttttttttttttttaactttattacagcaaatttgaaacatatccaaaataaacaaaatagtatgatgaaccccctccccattaccatcacccagctttgacagttgtcaccattttatcatccgtagcttcatccacaacccctatgtatataattattattgcttacaattcagaccatcttaaagctctctaatatcagcttagcagcacaaaaacccacagctggttttgtcacagagcatcattttaaacttaataacctacttctatatttgctagccatcttctggatctgagtctgttgttgtattcaaagcagacatttctttgcataccagatctcatctcccttttgttcagagaccaggattaaattagaccttatagatcatttaatttccagtgacttacttcacagaggtccagagatgtaaaaggacttacccacagttagtaagttagaattaaaagccaaatctccttttactcaggatgagtcagcaatttttattctgaagaggtaaaactgatttcttgtagttccttatttcttagttttcctcagtataaagg

SEQ ID NO: 93736 - DNA, 2540 bp, Homo sapiens
cacaagcttaagtatttttcatttctagtgttagtaggaaaaaattaatggaaatgcttaaaacaaaggaagtaatgattccaggtgttaatagagctaatctggaggattgtgttaattctgggtgtcctaatatctgcaggtctagaccggttggggacatgtgtaggattcagcacctaggatagagaatttttaaagtatcatgagatcaaagtagagcagcctacagaagacagacattagggagagacaagcacataatagctaaataggttcaagtatttggaaaactgtcatgtaaaggtattaactgccaggcactggggttacaacagtgaataacaggcataatccctatttcattggacctttagagaagagggaaaggcaggaaaatcaagtttgtgaaactatgaagaacacaaacatgggactgagagactaatagaagaaccaattttggatactgtggacatgcagagagttggagagaagcactctgggcagtgaaaatagcgtgtatgagaggaatgttacacagctagtacattggactagagattctctgaagtccttagaatttaattttctgctgttcatcgatggtcttcactaaaatcatgaagaggcggcctctggtccccctgctagtaggtagttatacaaggacaaaaacccaaatcttctaatgttctgctttcatgggtcagttttcactatctggttttagattagcttttctggtggggttctgtaaatactgttagggctgtgccctgttgatatagaaaacagaaaaacacttggaaaagacaagaaaaccacacactcaaaaatgcctattcctgtgtctgttgctgttggtttttcctggtgccatcatcatccttttctggtcattgacttccatcttacctcttagggcagggtctcttgttctaaaataagcagcaaagttatccctaactaagatgaggttagtagctatttctaatatgtgaccattggttgtggagatggttttatacataaatatttgaccttggttttgttttgcaggaagatgttggatccagggttgatgacgtgttccaagcaagctatgtttcttaaccttgtctacaaatctctgaaagctgacattgtgttgcgccgggtgaaggcttttgtgaagaggttacttcaagttacttgtcaacagatgccaccatttatatgtggagctttatatcttgtgtctgagatccttaaagcaaaaccaggtttaagaagccaactagatgatcatccggtatattttacaactgctttttaaattgagtgggtgctgaaatatattggtttttgttttgtttttctttgcttcaaatgacagtaacctagttctctggagcatatgagtgtgagttctggaataggacaaacctagattttagtaccagctgtacagtttactaggtgggcatgttgctcaactcttctacttgcaataaactgtactatactagaagctaccattatatgagatttggaagactataaaacttagtagacctcttaagtcttcttccttaacaatgaaatggaaataatagtacctacctcatagggttatttacaagtcagaaatttacttgagggctaattgttttcaagtattagagtccttaaggctcaggggttcttagctcaaaacttaactgtgttatgtttagaaataaggatgtaatctcctctcttgtttaaataccattgatagccatcattttactttattagaactttcacgtttcaccagagttgcaataagtaaaactctgcatcacataatggagcacagactttattgcaacttccagttgatttatgtagatttatgaaactatacttttgttaggagtctgatgatgaagaaaattttattgatgcaaatgatgatgaagacatggaaaaattcactgatgcagacaaagaaacagagatagtgaaaaaacttgagacagaggaaacagttcctgaaactgatgtagaaaccaaaaaaccagaggttgcttcctgggtgcactttgataatttgaaaggtgagtttttttcatctttattctctagggagtttgtttctctttgattttcatagaaaatagcattctaccattttatttacttatttatttatttagacagagtctcactctgttgcccaggctggaatgcagaggcgtgatctcggctcactgcaacctccgcctcccaggttcaagtgattctcctgcctcaacctcccaagtagctgggattacaggcatgtgccaccacacctggctaatttttgtatttttagtagaggtggagtttcaccatgttcgccaggctggtctcaaactcctgacctcaggtgatctgcctgcctcagcctcccaaagtgctgggattacaggcgtgagccactgtacctggcccacagtttcttaaagtaatgttttagggatagaaaactttctgttcaagatagaaacgttaagtggttttctatacac

SEQ ID NO: 93737 - DNA, 1050 bp, Homo sapiens
ggaccctgagttttatgtcaaatttgaaaggatttttccagttccgaaattatttttaaaattatgttgtgtttcctattattttatggttttatttttcacatttgtaatgtatttttaacttatgtttttaatgcagcaagattaccttatgctggctactttggatgagaatgaggaagtgatagatggaggcaaaaaaggagcaatcgatgaccttcagcaaggtgaattggaagcatttattcaaaatcttaatttggcgaagtatacaaaagcttccttagttgaagaagatgaaccagctgaaaaagaaaattccagcaaaaaagaagtaaaaatacctaaaataaataataaaaatacagcagaaagtcaaaggacatcagttaataaggtgaaaaataagaataggccagaaccacattctgatgagaatggcagtaccacaccgaaagtaaagaaagataaacagaacatctttgaattttttgagagacagactttgttacttaggcctggaggcaaatggtatgatctggagtacagcaatgaatattctttgaaaccccagcctcaggatgttgtatctaagtacaaaacccttgctcagaagctgtatcagcatgaaatcaacttattcaaaagtaagacgaatagtcaaaagggagcctcttctacctggatgaaggcaattgtgtcatcggggacactaggtgacaggatggcagccatgattcttcttattcaggatgatgccgttcacacacttcagtttgtagaaactcttgtgaaccttgttaaaaagaagggcagcaaacagcagtgccttatggccttggatactttcaaagagttgcttatcacagaccttttgccagacaatcggaagctgaggattttcagccagcgtccttttgacaaactggaacagttgtccagtggcaacaaggactcaagagatagaagactgatattatggtattttgaacaccagctgaaacacttagtggctgaatttgtgcaggtcttagaaactttaagtcatga

SEQ ID NO: 93738 - DNA, 1060 bp, Homo sapiens
tcatcatctcaaagatgagattacttcctagacctagagatgttatcaaatcaaggctgtgtacattttatttccttggtctttttttagactccataatctgaatcattgtttttatcagatgccaaatcttttattttcatttgttaatcataatttatcattaggaaaccaaattgtgcattgttcatttcttatttagattatgcttaataactagtaggttaggattcttatagactgctggagagtggcttgggtaaggaacacatctctctgaaatattacctctattgtgacatgactaaatcattgatgtaaatgattaggaaacttaaaacctacttaacacattgtatttttttttcttcttttggtatttaggtgttcactcaacttggatctgtgctgaaaaattgtgacatttcagtacatctggtagaggtaagccaaaaattaagtgagattcaagcattgacactgactaaagagaaggtcccgttagagcgaaatgctggatccccagtgtatatgaaaggtgtcactaagtctgggattccaatttcctggtaccgagatctgcacgatgttccaaaaggtaattacctttatgtggattaatgaaagaattttgatcacaaccctcacagtattgatgggactgtaactttttacagcaatataatagattgagttactgctgccaagtcccttatccatagagagtagcctacttttttctagaaaagagcatcttaatagaaaataaagttgcctgacattaagtagtagtttatttcatgaagctttgtaaaatcccaaacaaaatgtaaatctcctttgtacttttgagtatttccctatagctagggttgtaccgatgacggagcagcccaaggcagctggggctgatggaagcagtgttagtaggtgggtttagttcagttatagagtcttttaaaaaatccttacttgcctaaagacaagcaaggtgtgggggaaaatccctgtactagtcaggaatactgactagtattgactagtttgagtcttgactcaa

SEQ ID NO: 93739 - DNA, 1041 bp, Homo sapiens
gagcatgggttaaaatcatttcttaagtgtgtgaccttaacgtcatgtagtaagagaaagtaagtaaccgcttactcagccaagtctcttactttcactgcttatctcagtttcatgtcaaatggtaatggtattgtccacaggaagagtttacatctgtgaaagcaatgtagtacagactatagtaaattaacaataacagctaacgtttgttgagtactttgtgttactctgttttctcatttaattctcaaagcaactatattaggtaggttctattattatccttctttgggctacagcatggcttttatcccatgcttccacacagatctcagtttgattcggccagaatggtagaattactactgctttctgttgatctcaaggaatcattgcaagagcctgtctattgtggcttgtttaaaggtacaaaaaaatccctgtacttctcaggaacgtccaggcttcagactgcctctttttttttaatcctttttttccagctcagaagatgatttttactttctggaccttaactgagaacttcttacttagaaattatcagttttaaaagcacaagagcttttaaacttaaatgtatgaattaagttttgttaagtataaatttaaatgtcagactgaacacttatgaacacctgttttttcatagtatagcaatctaagtttacctgaatgacatattcatagaactaccaagaactaacctcctggccctgggagttcatttagttcttgacctaattagtattcacttaggaagggagggagcgaatattctctttcacttgaatgagatgcgtggtaatacatgtcatcttgaagagtagcctaagatagaatgtcagcatgatcagcgtgtccactgatgcctgatgaggctgacttcatggtttttatagttaagccacagtaatttgattgcactattagctaaatggttagttatatttaatcctcacaataaacctacaatatctataaggaagaaaacaactcagaaagtttaagtaacttgtc

SEQ ID NO: 93740 - DNA, 1041 bp, Homo sapiens
agacttccaaatagtgtttttgtttgttaagaaaactgcgtttatgggtatgaattttctaactgttcttctgagaacacctaaaccttactgtagatcaaaccccctgaggatatttgttaaaaatgcaaatccttaggtttgtttcacaccaatctacatttttaataagtactctatgattctcaggcaggtaatcagaagtcacattttgagtgctgttttattggaatatttgagagtcattagtattgctgcatgtaactaggaatcctgtcttctggttatttttgctaagaatttttttcttttcaggttcttttagataaatcaaatgagccatcagtgaggcagcagttacttcaaggatatgatatgttaatgaatccaaagaagatgggagagagatttaacttttttgccttgctacctcatcagagacttcaaggtggaagatatcagaggaatgcacgtcagtcaaaaccctttgcatccgttgtagctgggtttagtgaacttgcttggcagtgatatttcagcttggacattttacccttcagtcggcccaagaaatcaaaataaaggaaacacatttcatatactgcaggtaacaaaagtcaaagtattttatcttttcacagcaagaacagtccatgttgtatataatacaaccaacattatagaacttttagggttgtgactggctttggtgcaaatgtgtgctcaagctaataagttattgtgaaactgagtttcctttaacttacaaagctagttgccatatttctattttattttaaaaagtaaacatgcggctgggcgtggtggctcatgcctgtaatcccagcactttgggaggctgaggtgggcatatcacctgaggtcagcagttaaagaccagcctgaccaaaatggagaaaccccatctctactaaaaatacaaaactagccgggtatggtggtacatgcctgtaatcccagctactcaggaggctgagacaggagaatcacttgaacctgggaggtggaggttgcggtgag

SEQ ID NO: 93741 - DNA, 1549 bp, Homo sapiens
gtttgaaaaatttctttaaattgctcatttaaaatatcacaagtagaacttagtacatagtagatacttatgagtagcgcctgtcaattatttgactagggcactaaacaacaacaaaaaaaaacacaaaacaaaaaccaggttgacagtattttgtttcttttgtttcatcattacaatttcattttctcctaggactatcagacttggcttgaccttagagaatttgaaactcgcattggagaacgttacattacacatgaaagtgatgatgctcgctgggaaatacatgcatacacacataaccttgtatacccaaagcacttcattatggctcctaatccagatgatatggaagaagatccttaatcactgagctaacctaaataaggaaggatttcattttatggactgatattttgctgtgtaacttgttctttgtagattgtcatctgcagtgctgcaaagatatgaagaaatatgataacgaataagtgacaccagtactgtagttcataatgagtaggtacaggcgggaaactgaataataagaagtcataatggaatcaaggtgaagctttttataaacttttttagcctaagcaataactggttttgtattttttcttaatccttcactttaatacaataggctcacttaatttgtcttcccatttctctttatatatatatatataaatataaatatatgtttgtttgtttttttaatgaaaaacaagtcaagctagcatccagttactatatagcttggctaaattatacaagacttacaagattgattactcgacaggcttgtatttaagaggtaactgtgaggttaccattatgtgatgttactataaggacttttaacattggtttaacaaaccatagaggcattgaagggtttttcttagatgcctagaaaaagcgcactgggctgttttacctttcttttttaggtcaatcaagactccaaaatagtgattcctaacctttttggagttgctctgctactctgaatatgttctatacagcataaggattgtcaccttctgtgtgttgcaacagcttctaagataattagggacaaatgatgttacaaaaggaagagtactgctggtctaagtgctgagttgtatgtctttgcatagctccactctgctgctaaatatgcatgttctgactgacaccatcttgatgccagtactggattccagcattcagcaggtgcagatctcggctttacacaatttatctttacctagggttcagtcagtaatttctgctttttagcagggccagtgcagggtcagttaatgctacagttactgtatagcaaacagtatccttttttctccttcccctagcctattgggctttgcagatatctggagtgttttaaagtcaattattttaagcagtttgaggggatgtgtaggagtggagcatgaaacagtttataaggctggggctgtattatcagcacagcaaattaaagaatgaaagaagtacttctttttacatttcagctccagcagccagctat

SEQ ID NO: 93742 - DNA, 1039 bp, Homo sapiens
agatataaatgaccaaatccaaaatgctgcatttatgtacccaccaaatccatggagagaaatttctggtgaaggtaaaaaaaaaaaaaaaaaaaaaaaaaaaaaaattttggctatgtgttttaagcctaaacatctttctcatcccaaatcagtctgtctcttgcaacttatctttttagtacatctcccattcatcttccaaattcaactagttaccagttttttgagcactcttctttttatacttttatctgtgtcttctgtatagttcccaggcatagcacttacataggccccagtggcctcattgtcaaaccactaaaatatctttttaactgtcttacctgttaaactcttttctggtccttcctagtcactactgccaaatctatcttcaggaaacattactttcatttatggtgctcccaaacacttctctttaaccaccttacaggcatagttatctgtgatatggtccatgcttaccttctagcctcatctcccactactccctacacaaacctagttgtttactcttctgaactgttttctgcaatttgcttgggactgtttttcccttgtctacaatccttcctattaaaattcgaggaccccttaatttgtggctcatctataaagttccctgactactcctctacactgcagaatttacttaggctaaaaaacatttgggcttttttattatctttttttatttttattgagacggggtctccctctgtcacccaggctgaagtgtgcacaaacacagctcactgcagcctcgacttcctgggctcaagtgatcctcccacctcagcctcctgactaggtgggatgatgggtatgcaccatgggccacccacacctggctaatttttaaattttttgtagagatggggtcccactatgttgcccaggctggtgtcaaactcttgcactcaattgatcttcccaacttgacctcccaaagtgctgggattacaggcatgagccactgcacccagccccatttttttcttaagtattcattctt

SEQ ID NO: 93743 - DNA, 1058 bp, Homo sapiens
aagaatcaagacttagataaataactaccttagaaataaaactcttaagcaaataccatcacaaatacagcccccaagagtcaaaggtttctgtgtaattgactaaaaatttatgggcagttggtgcctattcagggaaagcatgaaattagagcagtgtcagatttttcaagtgagaaggaaggaaaagtagtagtaatggacaagagtgattatataatcaaattaggagaacattctatcccctcagtgcggctactctccagtacacaacttggagaattaaaacctaagatccttttcattgattgtaatttttattttgtttgctttgtttacttctctaggctttctttctgtgccatttcagacaatcatagcacatctagatattagtaaaactgtttctctgcttaagttgctcatgtatcttgcaacctctcttcagaatttgcaccatcctgggattgtaaacctggaatgtatgtttgaaaccccagaacgagtctttgtagtaatggaaaagctgcatggagatatgttggaaatgattctatccagtgagaaaagtcggcttccagaacgaattactaaattcatggtcacacaggtattttaactcctttttttttttaaactagcgattaaaaactaatttttttttttttaagacaagagtcttactctgtcacctgggctggagtgcagtggtgcaatctggctcactgcaacctctgcctcctggattcaagtgattctcatgcctcagcctcccaagtatctaggattgcagatgtgtgccaccacgcctggctaatttttgtatttttagtagagctggggtttcaccgtgttggccaggctggtctcgaactccttgcctcaagtgatccacctgcctaggtctcccaaagtgctgggattacaggcatgagccactgtatccagctaaaaactaaaataattaaatagcagtacttttacatgttgggtgattgtgggaattgttaaccttaaggagcagaataacacacttttagctaagtcttgatgaacta

SEQ ID NO: 93744 - DNA, 1781 bp, Homo sapiens
ggattacaggcatgcaccatctcacctggctaatcttgtatttttagtagagatggggtttctccttgttggtcaggctggtctggaacacacaacctcaggtgatccacctgcctcagcctcccaaagtgctgggattacaggcgtgagccaccacgccaggcctaaatacaagatttttaaaatgcaaagcatttttttcctgaaagtcttgcacaatacattatacttgcacataaaatttgggcttaacctcttattagaacatagaaagcctgtgttttcataaaatagtttgcactttatggaaattagctgcttctaacataaaaatgtattgaagtatttggatgaagaaagtcagagatgttgacattgtattatagaaataaataatactaactccttactttatcctaccaggatatcagtactgtttaccagatctttgcagatgaggtgcttggttcaggccagtttggcatcgtttatggaggtaagcaactacagccgtttgcatattgtacacattattttaaaaactggaaaatgtaaaacatctgccagctgttttgtcatctcatagttttgtccagtgccttttttttaaaggctgacttgttatctttcagctaaatccttctcactgtaatttgagtattcttcccttaatgtcattgcaaactttaaaaattaacagaatcagaaaattttacagtgtgttttatctcttcttgtagctcacacatacagatgtttgtcggaggcagggggggagatggtttgaagtttatgttgggctgagtgggcttattcattgaagtatattccctactagttttccaacacaaatggcaccatttgtctactgttggcatgattgttctattaagtctgaaaacctgaacctgaaatccaactttgcgatttaggatattgatgaagtcatttaaccttactgtgcgttagcatcttcaactgtttaatggaactaataaaacctgacctgtgtagctcatagggcttaaatattaattaaacttaatatatgtaaaggtactaagaaagaaatgttaaacccttgttatcccttgctaagacttggtacagtagtttcctagttggctgttctgcctccattcttaccttcttttcatacaactcttagagtcaatctttcagaaaattcacatctgatattagtattacctcacatagaacccttaagtggttcacagtcatctacagattcatagccagttttcttagcagaggatttcaaggctgctgtaatttatccctgcttctctagcctcagatctaattgcagcttcctctttgctttctatctttcagtcctgtttacatgcctccataccctttgcctctctgctccttctccatccctttgtctcttctagtgcacattttttcatacttcagggctcaactaaagggctttctctgtggaaatttcttgtccccgtacctatttctccatcaaataaaaacatggttcccctttggtactcctgctacccaacatacttctctcacaatatctattaccctttgggtttacattattgtcttcccactgaactttattggagcgttggctgtgagatgtctggatcttctttgtattcctagcacctagtattgtgacataaagcagtcgcctagaaaatgtgttgactctgcatgcatatataatatctatggtttgcaacttcagatttgtcagttttaagagtagttacatctctggaggacttcct

SEQ ID NO: 93745 - DNA, 1023 bp, Homo sapiens
gagaattattttacaaattcaagaataaaagatcaataaattcaatctcattaaaaaatgatatgtggcaaaatccaaaagcaaagacaaatgagaaactggaaaaaatattttcagctcattctaaacaagggttaattccataagatgtgaagaatgccaacaaattgataagaaaaagaacataacgcaataggaaaatggacaaagaatatgaacagagagtttcacaggaaatacaaatgactcttacacataagaacttgatttcatttataataaaaggaatatcactttaacctttcactgaaataccagtgtttatttttcagtatagcaaagatcaaaaagttattaacatactgcattaatgagggtgtgagtaactagggactctcatacgttgctgaagagactataaattgggtcaaatcttgtgtagaataatataacactatcaggcaaaattacatgtgcacatgtctgttgacccagcaaatcaacttctagaaatatagcctataggtaaattacatatttttatgtgtgtgtgtgtatgtgtcatatatatatatgtattcatgtgtgcatgtatgaaattctctacaaggattcccagaaacctgataacatgctttgcctggagtaagggtgaggagtggggatgagtgatggtggaagtgatacttttcaccatacatcctttttatatcttgagaattttgaacctcatgaatcttaaagttattcaaaaatacaaatttatgaatgtaaatgaagggaaaagttaggtacaagcactttggaggaatcatttttgaacctcacagttttccaatcttcattttatagagaaagaggcattattggagacttgacagcaaatgtctaacattatttcagaatgaatctggatcaaagtattataaggtaaggattttacactttaaaaaatataagcattaagatagtgtatgtttttttcagataatattcattaactgttatatttgaatatatatg

SEQ ID NO: 93746 - DNA, 1307 bp, Homo sapiens
gtggccctccagaaaacattcatgacaagtaaataggatttaaaatattagcttaaaatagaatcttttatgtatcatcataacaggattaatttttcttcagccattgtttattttactaagatattttgaaaaattttagctcagttgtctttaaaaaggcttcatgttcctacagtatttatatgattttttaaaaatctacacaaacttacaaattttaaatattttttagtccatcaacaagcaataatattccgctaatgagggttgtacaatccatcaagcacacaaagaggaagagcagcacaatggtgaaggaagggtggatggtccattacaccagcagggataacctggtcagtaatcaaatacatttgaatatgctagtaagactttgttatgagtttcattctgtgcattttttaaatcaaaatgatgatgagatacatattaagacattatatacaccacagcaatttgtaaaagatgcactggaattatagttaaatttgtaaggaatttttaacaggcagaatatttaatgtattgtctttacaaactggtagagcagtcaatattcaaaaaggatctgggattgttccacaataaaaaataattaactcgaaacacagtggagccacaaatagagatagaaggaactaagacttcatctaaaaagtcatcttattaccaaagataggaaggaagcatgtttggttttatgtagactttaacttagtgtaaatgtgcaacgtttttttttagatccagcaaagacgaggaatgatgacattctagtagaaagacaatagatttgaagaatcagcgtagtgtaataactaagaacacagactttggagctagactgcctaagtctctgtaacttactataaaactatatgaacttgggaaagttacttagtttctttatgcttttgtttccttgtgtaaaattggcataataatggtaaccacctaataaatccaaatcagttaatatatgagaagatcttggaacagtgtctggcatacagaaacactcaataaatgttagtagctagtattttatttttaaagtctgctgagtagattattgaaacaagctttctaataaaccttttaagaataaaatgaagtacccaatacatttagctggcctaaagttttgtatgataacaacagtatagactgcagtgtgtatgtgttttatttatagttcatatccttgcgaatgtaacttgaagtggtgtgcctacctttgcgaatttaatggtatatcaaaggtgcttttacatcaaattaat

SEQ ID NO: 93747 - DNA, 1024 bp, Homo sapiens
caggagttcgagaccagcctggccaacatggcgaaaccccatctctactaaagatacaaaaattagctgggcatggtggtgggcgcctgtaatcccagctactgaggaggctgaggctagagaatcgcttgaacccaggaggtagaggttgcagtgagccgagatcacactccagcctgggtgacaagagtgaaactctatctcaaaaaaaaaaaaaaagagaaatactttacttaactcataaagatattttcttacattttaagactcttaagacttttttcacatttaatggacttcctctattaatataaaactctgaaattcatttaaaattttcccagaaccttccagtctgggaacagatacagatataccaatggatattgacaataatgacataaatagtgatagtagtcggggtttggatgacacagaagagccatcacccccagaagataagatgttcttcttggatccatctgatctcgatgtggaaagagatgaagaagccgttaaaacaatcaggtaatatatatacatattacaagctacttccagatgcaaggtcagttcaggatctcattaagaaaaagccacgtctctttaagtgggaccttaaaagtaatttaaaatctaaataaattgtggctaattcttttacatgcaatgtagtatttctgaaataaattatatcacccttgccatccactcaagatggggaggtatgagaatccttgttttttttttttcgttttttgttttttgttcttaaagaaaaatgctttaagtgtggtctagatgtaaaacctagttgtggaacagccactgcaaggtgtcagtattgaactttcagttaaagcaacctgtttttcacacaggcagctttaactggtagtagaaatggcaataaagaatatactcatgaagatgttgcacaaggataatggtgatgaagtttagggcagttttcatattgccacagttaatccgactattagcattttgtaaaaatactattaga

SEQ ID NO: 93748 - DNA, 1828 bp, Homo sapiens
ctcataaatgtttgttggatctcagtctctttcctgcatatacattaggtcctgattcttaggaattgaaagtatgtatctgacatatgttggataggaatttaatcagcttgagaaactctcatgggagatgtggaaagatgaatatgacataagagaaggaaatatggagctgccagtacatttcggcggtgttgtacacatggtattagcctcattatacaaatgaagaaaatgatgggggggtgcagaggggtgctaaagtgacttgtaggtggttattattttaatatcatcattactaataatattctgtttgtgagtgatttaaagaaagtctaaccatatctgatactgcttgacttttacataaattaatatgctgaatattttcattttagattgcaaattcaactgccataaacgctgtgcatcaaaagtaccaagagactgccttggagaggttactttcaatggaggtaaaattatttttcttaatttttgtgaaagatcagaaaaggccatgattctttggtgtattatctttggataaggttctgttttcctgatttattttgtttcttaaagattttcttctgatttaataatcaaacaaaatacacagaccactgacagtatacatttattagtaatcacgccttcccgtctttcctctggccacctgttactttgtagtctaatatagccagtggtactccatatcctctttcatttttagacataaaagaacttgttttaaaaccctgctcttgtctctattctttcatagttctaatatgtactaactgcttgctataccaggcactgttctaaactctttaaatatattgacatttcaacctaagaacaaccctttgaggtaggtactaagagatgagtaaactgaggcacaaatacatgaaataacttgccccagaaatatagccagtaggtggcagagctggaagttaaacccatatggtctggttccttagtccctagtgattagaacacactatactgcctcactgtccctttctctgtcaaataatcgttgtccattttccctttggggtctttttttttcttttcaagataatactaagcaaggcagttacctttttttggaaggaagcagtaaggactctagactttcagcataattttcctttaacaatttacatgactggtaaaaattttatgtaagtagttctgtaaaaggaaaagcataaaaggaatgaaaattctcttggggagagtttaattaacattttctcttgtggcttgttttctgtggttcttggttgtcttagtctgtttgtgctgctataacaaaataccataggctaggtagcatataaacaacagaagtttatttttcatagttctggagactgggaagtccagggcactggcagattctgtgtctggtgaggggggtccgtttcctggttgatggcaccttgtagttgcattctcacatggtggaatgggagaaggaactcctgtggacatattttataagggcacccatcccaaagataccaccttccaaagacccaccactacctaatacccttgccttgggagttaagatttttaaggggaacaaacattcataccatagcactgattaacaccttgacagagcatgattggttttctctttcggttaatctgaattagtatagtttgtctatgactaaagtcttttataaatttatacttcatgtatttgtgttttcgtgtttttctaccttataacaaatggatacgaaacaccatttatatttatcttaatgtgcatttgattactagtgagatgttc

SEQ ID NO: 93749 - DNA, 1108 bp, Homo sapiens
ttcagtaatgcaaaatgagcagcaataatactttcttcatttatttgttttaaagtttgtgtatttgatttgtaaagtgctgaaatgtgcctggcaaataatcatcagtgaatatatacctgagaattaacatatcttagatgtttttaagcataaatattagcaaaaagaatctgcatttttctcattcaaagattggtaaattaaacattgcaaaggaaactgctgagaacaacatttttagagttttttggctttagtgtttgaaataaatgattcttgtggttaagctctgctcccactactctgtttttaatattgacttacacttatgaaaattacttatgttatagtcacatgtccaccaggaaccaagtaagagaattccttcttggagtggtcgcccaatctggatggaaaagatggtaatgtgcagagtgaaagttccacacacatttgctgttcactcttacacccgtcccacgatatgtcagtactgcaagcggttactgaaaggcctctttcgccaaggaatgcagtgtaaaggtaggattaggtgttttccctaattaaaatttatgtctgtttttgttattatatataggcttaaaatatttatatttcagaagcattagccaaagaaattattctcataattgttatataaaggaaagagaaatataaacaaaatataaatgtgtgtgtaaactactattactactatctgcagtgtgtgttaggtgccaggcactatagtagaacagtaaacctttacatgctcagtcttcaaagcaattgtatgtgaattatgcttttgttaatatactagtagtaataggagttactattactattaactactaatagtaataggagtactagtaataggagttagtagtaataggagtcatatttcattttatagacatagattaggtaacttgcttaagatcatgtagctagtaaacagaaaaactagaatgtggatctctgaggatggcttcttcacctgtatgcttatcacttcccaatacagaatagctagtaggcagcaaagctgatacttgaggttttatgtctttttgattccagagccagacactaaaca

SEQ ID NO: 93750 - DNA, 1051 bp, Homo sapiens
tatctttttccacagaaacgtttccataaattgaagttaagttccatagtagtttttactttagtgttctatttcccactgtgtaagttaagcagtttttaattggttaaagtaacctaatgtctgtttgtaatcttgtcattatgagaaaatgctgttggagttccaaataactaacctatgacctacttctggagctcaaatgatgagaagtaaatggacttgctaaactagagtttgaaatcacaatattaaataatttacttttatggtccagtgcaactttcagagaaaaaatgattctgtgtactttgacataagtgaatgtgtgagcattcttaatctcatcgcagtacaaatacaacgtgtattgtaatacttttcttttttaaagctttagccacagtagaagacttccagattcgtccacatactctctatgtacattcttacaaagctcctactttctgtgattactgtggtgagatgctctggggattggtacgtcaaggactgaaatgtgaaggtgtgtgttctaaaatttttgtggtcatttgaaataagattccacatttgcattttttattatcagtgaaaaagcaagatgacgagctgttgactagggtggtaacgaggatttagaattggagagatcaggactctcattttatctctgccacctacttcatattcttgggcaaattactaaacctcttaagattaatttctcgtaaaatacattctgccccactggtttcataaagagtaaacggttaaatcaggtaatagggttaaatatttagtacaaaataatggctccataaatattcatgttgttttttgtttttaaaagttttcttggccaggcacggtggctcacacctgtaatcctagcactttgggatgccgaggctggtggatcacctgaggtcaggagtttgagaccagcctggccaacatggcgaaaccctgtctctactaaagatacaaaaacttagccgggcgtggtggcggatgcctgtaatcccagctactcgggaggctggggcag

SEQ ID NO: 93751 - DNA, 1560 bp, Homo sapiens
gagatgaaactaggttagtgtttgcacctaaaacacatcccataagatccaagactgatggtaaaattgggctacaaatttggctgtgctttttccatttggcaaagcaaacaggaaaacatgttaacttacgtgagcaaattgttcatgttataaaatcaactagataaagttattttgtgggtgggtcttcacaaagaagggctacagtatgaaataggtaaacgatatcagcagcagcgtctctgtgacaaatgcatttagtttagtgaaactgattcatattagaccatttgatgcaggcaggtgacatggtgtcatttattaaaggatattctatgaggagcccaaataagtcagtgagcatttataattctgagatctactgaagaattttgaaatatttagagcagcatgtcctaaggcgctggaacgactgcttatctttcaggctaagagtggagtagcagtaagtttaagattatattctccatcagtaactgaatatagaaatcctgtatttgtaagagacatgtattttaaaatcatcaatgattatttatttgtaagtttacttttctatttttcttgaactttaaaattaaccaggatgcttgagtacgtggatcaccttttaggtatcaatagaattgttagcaaatagtgttaggttaaaaacactatgttttaaattctttgataaaattgaaacgtttacttataaaaatagaaaactgtggtcatactgatataggactattatccctcagtttccagagtgtggattctttggcatgtatgacaaaattcttctctttcgccatgacatgaactcagaaaacattttgcagctgattacctcagcagatgaaatacatgaaggagacctagtggaagtggttctttcaggtaagtaagtggctttttagagtgattgccttttcccctcaaagagcctaattttctgtactaaatgctgcaattcgattatatttagtctttgtattattgttacttaatttctttcatctctaataatggtcaccatatgatttttcctttcaggcatgttatatcaccattaagaaagaaaaatacctggcaacggtggctcacacctgtaagcccagcactttgggaagctgaggcgggaggattgcttatctcaggagtttgagaccagcctgagcagcatacctcgtctctactaaaaatttaaaaaaaaaaaattagccaggcatggtcacatgcaactgtagtcttagctacttgggaggataaggtgggaggattgcctgatcctgggaggttgaggctgcagtgggccatgatcacactactgcacttccgcctggacaacagagcgagactcgtctctttaaaaaagcaaaagaaaggcctggcgcggtggctcacgcctgtaatcccagcactttgggaggccgaggcgggcggatcacgaggtcaggagatcaagaccatcctggctaacaagatgaaaccccgtctgtactaaaaatacaaaaaaaatttggccaggcgtggtggtgggcgcctagt

SEQ ID NO: 93752 - DNA, 1029 bp, Homo sapiens
cattgttaaagtgcaaaaattatgtttgaccaagtgaaataacttggaagcttcctaccttgcctgacattttactgacagcattttaacgacatgaacttgaaacggttcaccttaaattactttcaaaataagtgttgcttaaaataattttgtttgcaactattggaaccttttacttaaaaatgttaagtaatgctgtaaaaaataacgtctaaaatggttatagaaagattattttttaaaattatcgaagtcatctttaatacaaaagcaaagaatgaagtgagcagagtgcatgagggtggaaatttaataactgatattctgttgcattcccatatggactgggaaaatacttcattttgcacagtcaagaggggtcatcggcacagtttgtagtaagcaaatccagaaaagctcgggggatgggggaacagttggaaagaggccaaattaaagggccattttgcttctaccatgctgtatcattagttatttctttaatttcctctttcttttaatcaaggatgaggtaggccaggtaaggaattatggacttgtctggttttcaaaaggttgccaacttcttccacatttcctagcctctttattctcttgactcttttattccctaaagcaggatttctcagcttcagcactattgacattttgggtgggataattcttgtgggggctgccctctgtgttctacagtgctctacccactgaatgccactagctcaagttgtgaaaaccaaagatgtctcaggacattgtcatatagcttctgtgggcaaaatcatctcagctgaggatcattgccctagaggaataaactaaataatagccagtgacaattcctgacaattacttaaacatgtcatcacctctgctgcttttctgaacttcttccctctcaggagaatagaatgtttagaagggatatatatacaccattttactgggcaagaattgtattttgaagaatatagagacaacagcattagtacaggtttctgcccccgc

SEQ ID NO: 93753 - DNA, 1016 bp, Homo sapiens
aactagccaaaaattgctacccattaggatttattagtgaattataagcatatgaccaaaaattgtcatttaaaaaagttatgttcttatttttaaattaatgtcgaatgaatataaagtattaaaaacctttaaaaaatttccttccaggctaactatatgtcagaaagcatcagcttttctcgatggacccattcatctaatgaaatatgcctgtactattttaaaaagctttgtatttcgtcatagaaaagttcatccccccagaatgaaaatgaggacatttgagaaggtgatttaaggtgtggacatttgagaaggtgtcctatcaaattagtaaaccaaaggaaaagtactgaatagattaatccaaaacacttactgttttttaaacgaagaggatttcaccttgacagaaaaacaacttttattcaatatgtatttcctgaaattaaagagacaagtacagactgaaaggaaaatagattcgtaaataagctacgtcaactctatcctgctgaggatagctcagtgatgttaaatcctttacaaatccctggttgtcttcctacagacaagactgctttttgatgggactgatattaagagaaataggacctttggggcattcaactccttgataaaacttaaaagtatcggcatgagtggcttaacagaggaaataaagaagttttcaactaaatccaaaagtgcggtcattttctttactgctgttattttaaaaacctcttcataaccattgaaaaagaatcgacaactattttaaaagattaaagaaaggcagatgtctgcaaataattcccctccatcagcccagaagtctgtattacccacagctattcctgctgtgcttccagctgcttctccgtgttcaagtcctaagacgggactctctgcccgactctctaatggaagcttcagtgcaccatcactcaccaactccagaggctcagtgcatacagtttcatttctactgcaaattggcctcacacggg

SEQ ID NO: 93754 - DNA, 1030 bp, Homo sapiens
ggcattagctttgcattagctcttttagtcacccattatattagcagtttgaattaatctttttcgttgataaatacctctcatataaactgcttacaagtaagcatttccccatttctgtattgcacattttggggaaactaaatgcaaagctttacacttacctttaagtttcagtttaattttagtttatttctcccagatttcttcaacctgaggattttataagcatattctttatgcctttattatctaataaatagtgaaaaatgatataaggctgaggacagtgtttcaaggcagttccgtaaagactttcctcatctaaggtgacacagagcagcaaacttaactacactaacatccaacccacactccagtaacattcttgcaaaggtagcatggacaatcatcttggatactatttttgtcagaataaactatcttttttttctggctttgctgattttgtggtcttgggcaagtactttaatctctaaacctttgttttctcaaccatataatgagttgctgtgaggattaatgaggtaatatgtataaagtgcttagaacagtatctgacagatagtaagagcttaataaatgtaagctattgttatttttttccagctaagaagcctaataatcattattttccaagatgtaaatgtggttgacttctagtgatcattatattcttctctagttattcacaaaccatttgcttcattattttttatgtttgtaatttctgaaatttgctttcctgcttctccagccgccagaacttgaaaccgctctacaaatctccaggccatgattatatctgtctttttgagctctttctccaagattgcaggagtcagctttgtgattacatttgtgaattgctttagtagtatggaatggactgcatctggacccagagactcaaactcatgtaaagttgttatagtcttagtcatttgtctcaggtttcagttctcaatgcctttctgcagttttagtttaaaactgtggagaagataag

SEQ ID NO: 93755 - DNA, 1008 bp, Homo sapiens
gaattgatgttctcatcctgtgaaccttctcccactttaacctaatttatctttacttgtttaaagataaggaaacccaagatgtactttatttgcaaactcaaagcaaatggcgagccacctgtgacccagtaaccagaaaagaaaccatgccatttgtataagtagagacacttcttgttgaggtaggcaaggctcttgtgagcgatttttttcccctagtgagacctaacaaaagacaagctatatcatttctgcctgaaattatctgcttgaaaagatcaaaatatcaggatacttagctcttcacaaatatgaagtcattatcacatttcactgagccagaaatcactgttaacagcacacacaaaagactacactggttgaacagcaaagagaaacccgggtctccagaatcacagtttagtccttctatattactgcaagtgacctgttttttctgaaggctccccgcaaatgaagtcctggaatggaaaaaatccataagtccataaattaacttgataaatattttagaacagacaaaagaaaatattgagtgatgtagttctaatcctcctaatatggaacctggcaagactgaatcattttactgtgaaatatataaacacaatagaatgagccaacatgatggtttctctccagtaagagtttttcttttggaaatgaggttaacctagccccaaatctagcaattctcataaaatccgattttagaattagcctcccagattaatctgaatgattgacttattttttcttaggcaagtcagtaagccacccactagacagccatatccagcaaaataagagaagtttccagatgccaaatgataagccaccatcaacccagcggggaagccttctggttggtttggctgtatgagattcaggaaggccagaatacccaaaattattcacacgacgttaacttattggtactggctaagcaatacatgtatttcctaaaggaggagatggtctttt

SEQ ID NO: 93756 - DNA, 1048 bp, Homo sapiens
gggtcagggtggtggtctcatcagaggctcaactggggaaaagatctacttccaagctccccaacattgttggcagatttcatttccataggcccttgcacagtgtaactgctcacctctccacagccagcaaagggagtcagggagtcttctcccttgtcagctcagatgaaatctcctataatgtaacctaatcagggacctattgcctttgccacattcccttgtttagaagccagtcacaggttctactcacaaaggcattaacaccaggaggcagatcatgggggctcccttcgaattctgcctactgcatggaggatatagccttatcagtaatgtttcagaagtgttcccaagtgaaggcccagcctgtaatagagattcacaatgttttctctttgaagtgaagcagttttgttcatttcctcccatctcagaatgacttcaaatcctgacatcctcgacagcccaatactttgccacaacctgattacaactctagctctcttatttactggctatatgttattgagaaaaggtaactttctaggggaagggcttatcctgaatctccgttttcttatctgtaagaatgtattccactaacatttttaggacagtagcatataatagttattgtcacttattaaataattccagcacctttcctttaggactgttcattttattgcattaacttatgtacatatggaactcaacaatgaaatattagtgttgctagtatgcacatcaaagcaaaaggaaaatgtattttaaaacaaatccagttgtatttaaggagctgaaatcactgatcctatgcttacagcaattcttagaggaaaatgactaaaaccatagacatgtccagaagatgtgcccatggctatgtctaaaaagtactggtgtcatagatatggggtttttaggtctttctctttcctgttttctctaagatgaaaatttttatccacttactggagggaaacaataagttcagcattagttgaaactggccctgccattatttacaggctcttgtgaa

SEQ ID NO: 93757 - DNA, 1039 bp, Homo sapiens
gattgacatgagcgtccacattgtagtaatattttagtgtttctgatcccaaagattggctggtcatttctatattagtaagaagactgccgtgttcaaagagaaagcttcttcaagggaaagtccgtgtgcgtttttctatggaaaagtgacatgggactacaaggaaattggcagtgatcgtgttcccatacaggaaactcagaataaatgggaacgtgaacacctcccttcacgcactgtcagggaggcgcagggtaaccgccctcccctctgtgagagcttcatcccatggccatacttgctgtcccctccccaccccagcccattccatcttttgagaaacctgagctgttacttggaggagccaaaatctttccttgtagtttctgcttggtagctctagggcctcccagaacaagttaattccttttcattacaattaaatgaatccttcagatcccttaagattagttttctctttctatgagttctctttaagctgctctattccttcagcctcttctcacatgtcctaatcgagctccttcacttcctcccatttgcctccctctgaacatgcggggacatgttccaggtagcctttatcccttctaaatgtggagcctaggatcatgttctgggcgcttggcacagtggaattattatcttctggttggcagcagagagacatagcccacagatggttgggggtagggaggcggcggagggtacttggccgagtcatcatcctcccctaggactgttggttccaacatgcaggaggagtcgctggatactctggcatggggctcagatggtgcagtagtgcagtggtgccgtgactggccgcatagtgcgactgtgctgaggcaaagcgaaaagtgatcagaagctggaatgtccctgaaggatgtgacaaccgagccagaaaggggaagtcggatgcaggctcacttcctgcaaggaggagaaaagaacagagccgcaggtccctgggggcagtagcacccctcaacccacctgcccatttttatac

SEQ ID NO: 93758 - DNA, 1462 bp, Homo sapiens
cctagaggtggtatgtgattgccgggggaattgttgaggagtgggggatgggcagcagccatccaaccctatgaaaatgccaacatttaagacaggggttcagacttcttctgtaagggctcagttaatactttgggctttgagagcaacatacagtctctgtcacaggctactcaactctgacctgatagagcaaaagcacctttactgggatttctcaacttcagcactactgagatttgaggccagataattctttgctttggggagttgtcctgtacactgtaggatgtttagcagcattcctggcttctacccactagatgccaggagcacaccacccccagtcacgaaaacccacaatattcccagacattgccaaatatcgcatagggaacaaatatcaccctcagttgagaaccccactgagctgtagacagtacataaatgaataggcataggtgtgttctaataaaactttatctataaaaacaggcagggggccggatttggccggcctgtagcttgtagacccttgacttaagggatggtcagaaagaaaactagaagagcttattcagtaagatttgagggccttctgtgtccccagctcaagaggaggctctgtaagtgattcagcataaaaaggaggagagttttcccaacaggaacactcatgtatagcccttttgcttactttattctttttgagctcaccagccacctggaaatatcaggcattaaaaccacaaaacaggaaaacaacaaatcacataatacaagccctccacaacccctaagaaaacccctaagcaaagcagtagcaaggttggattacgtgaggtgcattcgagtagacttcctccaggaaggaagtgcatctggagcaggtctcagaggatgttgtgaatagaggctgatggtaagaaggtgggagagctttccatgtagggaacacaaggttcttagtttcaggttaggagggaaatgaagtgtcagttaggaagctagggagctattgtccccagtgaaagcctgtgattgttcactgtcgcatgcaatgggcttcctctgggaaaagaatgaacagcacttaacacgattttctaagaacaggatgtttgtttttctcctcgaggatggcggggggcggggggtggggggggggctttgttactttacaattcaaatcttttgacgtttaccacaagtcaaattccttttgagattcttgttgacaatagcaaaaatactgaaaagtcctagtgagttagagatggagggaccagtgtctaggacccttcttctcatttttggcttctgacaaggtcaggttagcatctccacctctcatccgtgttgcgctcttggtgtgtcatttcctcttggtgctgtcagacttcaagatacatagtcttcaggttggcagtccttgagttatcaaatcggcagtggctacaga

SEQ ID NO: 93759 - DNA, 1015 bp, Homo sapiens
ctccagcctttcctttaatgtggtgttttgttttatgtccaacatgctcacaaaagctgtgcttttttcatgtataaagttcctggtattcaacagtgttggggataaaattgctttcacctgtatcacccaaagatttttttttttttttttttttagccaggccatagatttttcacaaattctttgaccattaactgtaacatttatccagtgggtggaatataattcgtaacctaaaaacctccaagaagactgctctgatcgtattattattattattattgttattcagattcttgctttcagtcagattttatctaggcccagtctcatttcttactaaccagaatcctgtgaacctgtatttcttttcattgattgaatgagaaatctatttttaaatgcagtatgtttgccagagaacaaggatagccatttgaaaatactggattcagccagccacaaaatcttgtgtgcctcaccaagccatagaagaccaagaattttcctaatatattgcattgttcattactttggatgttaaaagcacttcctaagtggagcccgtcctatgtgtcaagcactcttctcagccttttgtcttgattatcttacttgtttctagcaatcatctaatgaaagaaccgttgtatccccattttgctggtgtagagactgaggatagaccagttatataacttacccaaagttgtgcagtaagcaaaacctaaacatgcgtgtgcagtttaacaacacaatatgtgcaggcatgagtggctaatcctatgtgaaagtcagcagctctttgggttaaggggatgggaaaaaaaactgaacttctgaagcctccgagtcaggctgcctgggcacatgtcctagttctggcacttaacacctgtgtgactttgggcaagttacctcacctttacctcagtttatcctttgtaaaatggagataatattatttccctgaggattaaaggagttaaaaaagattatgtactcagaacag

SEQ ID NO: 93760 - DNA, 1020 bp, Homo sapiens
gttaccagatagtataattaccttaaaaaaaaaagagggttgcaattcattaaattgatttttatggtcacaaaatcagggcagtctgaagtaaaataatctcagcgcactccacagcagatgacattggcccataatcagcactggcttctggcttggccgatggcactggtgggtccagaccgttccctgccattgactcttgagctcattccaatcatcttccccttggagcactgaagcaaatctgataactcagtgcctgcatttccttcacatggggaggatgtaagaggacacttgtccttaatgcccactccttggtgttgcctccttcaggaaggcttccctgactactcacttgttcctaaagaataaccagagaacaaacaggctcttggaactaacatacttttcaacaatgcctttaaatataatttaaaatggcctgatgattctttaattttatgtgcaccaaaggactccacactgattcttttaagcacttaatggaacttctcctggaacattttctacactatgtctagcctttgagtcaaagttttattatatctgattgaaaaagatttccaccctcatcccagtggggttgctgagaaaagcaggcagcctcgtgttctgtttggggggatctcccatcccctggtgttgtgctgtgtacccagcatgctttcctggctgtctctaactttattgtttaaccccacagcccttggccattatctaggccattggaccccacaagtcaggtcatatcagctttgagagcaccactcagctcccagacccacaatactgaaagctgctggtgtccactggatctggtggatgtttgtgaatcccaggatgctctgagcttgtctttcctgcacctcccctgtcactctccctgctcacattcagaaggccaaagggccacctctgttctcttactgcacatcccagcaatcagtatttaaatttgagactcttattctgcaattcccacagcccgcaagc

SEQ ID NO: 93761 - DNA, 1090 bp, Homo sapiens
gaaaggaaaagaaaacaaaaaacgaatgaaaataactgaatttggaggctggagtaatcagattactgctttaatcagaaaccctcattgtgtttctaccggagagagaatgtatttgctgacaaccattaaagtcagaagttttactccaggttattgcaataaagtataatgtttattaaatgcttcatttgtatgtcaaagctttgactctataagcaaattgcttttttccaaaacaaaaagatgtctcaggtttgttttgtgaattttctaaaagctttcatgtcccagaacttagcctttacctgtgaagtgttactacagccttaatattttcctagtagatctatattagatcaaatagttgcatagcagtatatgttaatttgtgtgtttttagctgtgacacaactgtgtgattaaaaggtatactttagtagacatttataactcaaggataccttcttatttaatcttttcttatttttgtactttatcatgaatgcttttagtgtgtgcataatagctacagtgcatagttgtagacaaagtacattctggggaaacaacatttatatgtagcctttactgtttgatataccaaattaaaaaaaaattgtatctcattacttatactgggacaccattaccaaaataataaaaatcactttcataatcttgttatgaagttttatgttgtagcaaatatagtctaatgtatcactttatttcaactattactatggattattcaattaaaatattgcactgtaaacattttatttgtccattctacatttcaggccgaggccacatgcttttttttcccgtaggttttcatcaaccaaatttctaatctctatatttttgaatttctaagaaccaacacggaggttacatttcaatcaaacaatcaagccaaatgagaattaatttgcaatgttgaaagattgaatagattgcgactttaagttgctgatcgatttctgcttcatctaaagaatgcagtacacatttttcttcctcagcctcataccagtcctttctctgagtattttcttctttcatttttttaaaggtacatgtg

SEQ ID NO: 93762 - DNA, 1060 bp, Homo sapiens
tagcctagttgtagatggggattgttaatttctttctctctctttttttttttttggtggtatatgtaaggctagcattttttcagtacttttgtggtcttctttgtgaacaccgattaaagtacctagttttgtttgtttcttttttgagacggagtctctctctgtcacccaggctggagtgcagtggtgcgatcttggctcactgcaacctccacctcctgggttcaagtgattctcccgcctcagcctcctgagtagctgggactacaggtgcgtgccaccattcccggctaatgttttctattttaagtagagatggggtttcaccgttttagccaggatggtctcaatcgcctgaccttgtgatccgcctgccttggcctcccaaagtgttgggattacaggcgtgagccaccgcgcccggcccttagtttgctttttaagcgaagagaatgcaggtgttgagttgcatgtgtgaaaactctgaatttactttggttgatacatcttcgctcccactcccattcagattctgtttttatatggattgtatttgttttcatctgtattaaattgctaacttatctgttcttaaagaatccacctgaaaagtgtctttttatttcttctgccaccctgttttatgaatgctgtggactgttttttatgaatgaaaaaataatttgttgtataatagcagattttctgaaattaaagacagcttacttttaaaaagttataaaatctagaccattggctttcttacatttcttgtcagaaaagagtgctttactcaaagaagacaattctctacaggatttaagtccatttcacacttttaagctttagcctaaacattcatgtcctggattccctcctttcctctaacttgaccagaatggatctgcgcatctcaggttttttccattcgtgtgatagtcgtggagtgaggatgaaaattagcttgagttgctgtgcatctggtagccatcttctcacttggccagagattactcatcaaatgactattgtacttggattctgttgggagcctctg

SEQ ID NO: 93763 - DNA, 1258 bp, Homo sapiens
ggtgagaaacctacagtctcaaattcttgtagtcttaaactctttagcttcgaggcactctgattcattctcctaacaaatcacttcatgttttaggtgttttccaaactgtttgaagttactagacgtcgaatggttcaccgtgctctttcatcagcacagcgacagagactgtcatccaacaataacaagaagaaaaattagacagtatttttaacctttttctctatctgaagtgttcacacttacacatgtaggacaataagcaggaccgtctgggccggtctgcataaatgctgtatacataccagatttgatgctgcatatagggtatggaattgcacatccatctcataggaattgtaaatggtttgaataagaggaaagtaatttttgttgcattataaaatgtctagtagcatcataagtttttttgagagaagcatctttttatttcccatattcctggttattttcatcattgctttgaattgaatttttatatctatttttatatgtaactctttttttacctcatgtttttgtttgttttgcacatttctcataccacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaactgtagaagtagtttagtgtaactggcttcacagatggctgccacagagtgtgaagattgtttgttagttttaagcattcttttaatggctcctaagacatgcagatggactgaggagcattggttaatcatgcacctttgtgccatgtttaactcttttatttctttttacttaatctaatgttagtgaatttgtcttatgtaaaaggatatttcagggaaatattttcagaaatctatttagagtctctttaacacagtgtcccattgaaattttaatttttagagaatttatgaatcactgtttcaagaaccagattggaaagacaatgaagcctttattgagccactacattaaaagtatatattgctttactgccttcaataccagtattacatcaatgcatgtatcagaaacttcacagaaattacatggcaactcttgtagctaagaaagtaattctgaggtgta

SEQ ID NO: 93764 - DNA, 1047 bp, Homo sapiens
agtttccgttagtcatatttggaaaatgattttgcttgagtaggttcaacatataaacaataactagattatgataacctgtgaggtattgtaagtgagtttaaaactgactcaatcatgtaagtggtttgactttctgagactaaaaactatgaacaggaacttctttcaagtgttaattatttctagcatgtaatactgtaattctgtctgtccaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggttggtatctatcttttggttttttagtgactaatcttattttcctgtgactttccatcctttgcagtatttgtactccgactttgccttcatgtgaggaatgtcaaaaggatgtcttctgttttgttcagatgtagaatctttatgaattgaagattttttctttaaagttataattttaatgtactttggttagcctaaatctgtactatcctctggatagattcttagttgtaggcctgattgtatcagacggtgggcagggtcagagtctgtaatgatttttttctttgaggaaagaaaatataaacaatgaatgattttcaaggtaaggaaaagaagtttggaagtggtgctttcggaaagcaaaagaagtttcttcctaatattggcaagc

SEQ ID NO: 93765 - DNA, 2039 bp, Homo sapiens
gtggtttaagaaaatgtggggttggctgggtgcggtggctcatgcctgtaatcccagcactttgggaggccgaggcgggtggattacctgaggttggaagttcaagatcagcctgaccaaccctgtctctactaaaaatacaaaattagccgggcatggtggtgcacgcctgtaatcccagctactcgggaggctgaggcaggagaatcacttgaacctgggaggcggaggttgcggtgagccgagattgcaccattgcactccagcctgggcaacaagagcgaaactctgtctttaaaaaaaaaaaaaaaaaaaaaaaagtggggtcttaacaaagtggtcagaaatgggccttcataattttttgtattgtcaaaaaagactccttaggagtaccatctgagttaagtgtgcatagtgtgcatgcgagtctgtgtgcattttctttaaaaaaattttctttcttctgtttacaatttcacctgtctctctccgccctcaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaaggtgggaattcccattcttgctaaaatctgaacttatttattagaggtggaaagttttttaagaaaatacatgacgccttaaatgtcctgtcttatactggagaatgtttggatgcattgttcatgttgtggttgtaatgctctgtgttgtttctctagcattccattgatttgtttgcagctgtctagcatattgattaacctattttataatgtctgttgctcagcagtgatgtcctgaaaattctgaaggctgagagcatttcttttcaattgattgcagtctgctaaaaggctttatcattttattatattgatgaaatcagatataagtgtctgtttcaggagtgatagtacagtttatgtatgttgtaggattattttgagtgtgttggcaaaacatttggggattgacaaaacttttacagtatggctggtaaaacataatctagtagtaaaatttaatacaattttatgaattgtttgcctcttgaaaaggacattttcgttaatactaaatgtgaaatttgtcttggtagtccacaaatttattgatgttttatttgttatttgaactggcagtgttactagggggttggggaaaatgggctagtagagtaagggggattatattttttcctatgagatatggcatgttggatgagcttttttttaaaaaatgaatccacttcagtaatagatactatgtattcttatttcataaaacagaattttatgaaatcgtaccagtggggacctaattttttttggactaatatgttgctcaattttttgttttctagatattgatgaagactttaaacgagagcttcgaaatctggttccattgctgcttgcccctgaaaatttggtagaaaaagagataagtggatctaaagtcacttgtagagatcttgtagaatattttaaggtaggtgagctcttaaacagttttgtctaagatagaaatgtagttgacttaaaactcatctgtatgtataagaaatttcttgtctttattttaaaacaaaaaagagtaagatttgtgatttatctttctgccttgaattagatgtatctgtatttaaggatatttaaaagattatagcagatttctgtctcctagacagtgatttaatttatttacagaattatcttactttttctccatctcagatatggagagaacaagccattcatcatactctaatactactctgtcattagtgaatgataataggaatggaaagcataattttacatcctaagttctcacaaaaacactccctcagagttctgaggacttgataagaacagctgaaagtatttatattggttcaagtaaagtactcttaggttttttttttttccctctgttcttctctagtctttatagctt

SEQ ID NO: 93766 - DNA, 1074 bp, Homo sapiens
tgcctcttggtatctagcatatagaggccagaaatatggttcaacgttctacaatacacaggacagccacacacaactaagaattaactgacccaaaatgtcagcagtgctgacccaaaatgtcagcatttgagaaatctaaccctatatgagtaaaaacatcctctgtgagtgaaaatgtccttattgaccccagatctataatcagtctagatagccatctagaattagttggtcttgtagttacacaaccatgatttaaaattatgatccgtgtgtcctgatacacccatttttcatttttaaagtcctgtattactgcttgtggtgactctttctttatatttagtgaagttcttcagtggcagcgattgcttggtatagggcctgagaatgttgtttaagtgggtccttgatataaccatgaccagtactgaccatttagttactataacttttgataaggattgtttaggagagtaagagaggcttcaattgttaagagttgtgattttttcgtaaattttctttattgtaaaataaacaatttttattttttctgtgtatagacattaatgtttttgattcgagattggagctatccttatgaacattcatatggtttggaaggtggaaagcaatttcttgaaaagagattacaggtaagaccctaatgcttaaagaggagaacataagcaccaagctaggcaaacgggtgggctgtccggactgctggtcacattaccagtatttacgtgtcgttggaataaagtattccaggttagcccaagtgactctgtttgtaattgatgaaaagtaaagtggttgcattcctaccaaagaagacagtgtccttgaatcaaaattaaggatcatgatcctttattcctaaaggtagccccccatggaagtacttgtgtattagtctgttctcacacagcataaagaactacttgagactgggtaatttatgaagaaaagaggtttaattgactcacagttccacaggcttaacaggaagcatgactgggaggcctcaggaaacttacaatcatggcggatggtgaagggaaa

SEQ ID NO: 93767 - DNA, 2683 bp, Homo sapiens
agtataaataaccaagaagattaagattatgattattttcttccttgcctttgggtggggggggtagttttctttccttatgtaagatatctggctgatagataaatgataatttgatcttcttgtcatttattccttcaacaaatacatactgagcacctgttacatacaagacagtatgctaagtactaatgatctaagttaaataaatctctttctctgtttgctgtttgcaacctggccctgacaatgaaaggatccagacctattttctaaaagcagaggcccacataggttggtcatggtgtcagggtttatgttaaaatctaaagtttaatcacctcagtcatcaattactttttaaatccttgtttggaattagtagctaagaatatcattttaggtttgctggcctaaattgactatattcttgacctccaagtggtttagccagagtatcacttatttgctcctagaacagattgttctctcttcggagtcaccctggttcctaagatgtaagttatttcttagcagaggtgatatttgttgatggccacttttctcctgtggcagtgtagattactgtctaaagatctgtcttagaattaatggatgaaaatccccgtttcctgaggatacttagaccctcctttatcaactctagtctcctccaaaaaattctggaaagggcaagagtgccacctactgttacttttattagcttccacaggccagtaaaattgtcatgttgagtgtaagtgaaaactgatgagtaagtaaactgaggagtgtgagtaaaaagagaaccacactagagtcagtagtagtggaggtacccctgagtaactgtatactctgattgtaccagggaagaatttatctttgtaaactgttgccccttatattcactaatttagaaaaatgatggtggaaataacctacactctttaaaaaatgatcgtatcttaacattaaagagcttagagaaggagtacaagaaacctactagataccacacttgttcttctaccacttttaggccatgagtatacatatattcatgctttttgcatattttaccaccactgcttcttccttaatattctatcttgactattgttaggaaaaaagagaaaatccttttcacatgtcagttgtcaagatagtagttaaatgattcctttgcgctgagatacaaaataaccttttttccacaagtaaagttatacagaagctgggtattcagaacaaaacactaataaaaaacaaaataaattttgtttcaacaggtatataatctgtctcagaatattcaagaagatgatcttcaacatttgcaagtacgtatttctttttttaatttttattttttgagatggagtttcgctcttgttccccagactagagtacggtggcacaatcttggttcactgcaacctccccctcccaagttcaagggattctcctgcctcagcctcccaagtagctggcattacaggcatgtgccaccatgcctggctaattttgtatttttagtggagatgaagtttcaccatgttggtcaggctggtcttgaacttctaaccttgggtgatccgcccgcctcggcctcccaaagtgctgggattacccggcgtgagccgctgcgcccgtctgcgagcacatatttcttaaagaaaatgtgccaactattgaaatttaattctcactttattatgaatttacacttggaagcctataatactggtaacacgattgaatgttatatgggtttaaactggtgtatgacttcttaactggaagaaattttgtacatacctagtgtgttagaaaattaaatgtttggctttgaaatgattttaaaggttctggtacctggagctttggtgtggaacaggtttacacatgtcttctttcaatctctttagaggcattattttaactaactctatttaatagttatttacagagtatggaagacttgcgatggaagaaatctaccagaaaccatttcaggtaaaaaagttattctaacattttaaagattagcctatgagaagttgtgaagccacctcagtttgtaattttggagacaccaggatattacaatagactcattgctagcaacagattcagtgcaatcgaaactaacctttggtagtatcatcagcatacttatcagtaggcgaacaggataaatagaataaatgaatctaggctaattcttaatgctttcacttagattaaggggagtaatgtttctcttaacagatgttattctaaacttaagacaataggaaatatatgacagtcatgccattttttttttatacgtggtaactacagaatgttacaggtttcttttttgtggtttactacaagttgaaattagttctgttactctttattttggtttcatatagaaaagttccagatagtttattttttgaagcaagtgtaatttgtaagttgccattaatactgtttggtgagctgcagttacagtaggagagcatgactctaccatgtttgctcctaagtgtgtgaagcctttccggtatgacagcattgctactgattgttaatcttaatgggtttacattgattctgcctcactcttgtctggctagtatggtcacttttattaagtagttgagcagatgatgccttcgtttttgga

SEQ ID NO: 93768 - DNA, 1301 bp, Homo sapiens
gcagtgctgttttgacagtcattctacctggaacttagttttgcttatctgtgtaacaacatgttaaaataattggtgccgagttttttatgatttttaacattttaggaaatatttctctgtctctctctctctctctcttttttttttttgtttttgaggcaggatctcactctgtcacccaggctggagtatagtggcacaatctcagctcactgtagcctcaacctcccaggttcaggtgatcctcctacctcagcctgctgagtagccgggactacaggagtgtgccgccacgcctggctaatttttgtactttttgtaaagatggcgttttgccacgttggccaggctggtctcaaattcctggcctcaagtgatatgcccacttcagcctcccaaagtgctgggattacaggcatgagctgtcatgcccagccaggatatctttcagaaaagggggaaagtgagtataaccccacttatttagaagcctagagagtagtagtgtgagctgatttgagaagattcgagtttggaggagaccacgtctctataagaaaaagaaccccacatgggatttaaggactgctttgtaactacttgtttgttacacagtgttttttttgtctttccgggtttagcttccccatctgtaaaataaagaatgggtgattttttggtttcttttatttcttaattgtgttgtattttacatttatccttgactttaacaggattctcaaagttggattggtggaaacaatgaaccattgacaggctttacatggcgaggtggctgtgaaagagaaacaacaggcatacaagtttggaatgaagtatttgtgattgacagacctaatggaactaaagtaaaattctgtttatacttttctaccctgtattctttcttgggctattttccagtattaaaaatcaaaacaacacagaactattaatgtttgataactttaacatacggattattatgtcaaatgtatgagatataagtacttttcttgatttaattactgcttttcaaatttatcatttgattttttttatagtcatttttggcaactgttttactaaatattttaaactctcaaattcctaggttgctgtgctgcttatggatacccagggtgcctttgatagccagtcaactatcaaagactgtgcaacggtgtttgctctgagcactatgactagctctgtccaggtgagacacaagattaagtggtgcgatcagttcacgtaatcatttggccccttttttttttcttttttgagacagagtt

SEQ ID NO: 93769 - DNA, 1074 bp, Homo sapiens
caagtgatccacctgcctcagcctctcaaagtgctgggattacaggcgtgagccactgtgcctggctgacactgttttgtttttgtttttgtttttgccactgtgtgtctgcttttcataaattgcttcatccctcattggtcctgtcttaaccatctctccactcctaattcacgctttgtaatttgttttagactagatatccaagcttattagaagtatttctgaaacaaaggcgtttttcctgtggggtacattgagtaaaggctatgtgggctttaagtatactaaactttagggatcttgacgtctgtcaaaggtattcatttattatgtcccacatttaattttctagaaaaattaccttatatgttaacttttgtattatttcataataacaatttagccctgtggttctagttaaaaacttttattatggaaaattttaaacataccctaaaataaagagaattgtataatgaactccaatgtatttgtcaacattttgctggtcttgttttatctgttctcttttttccttacctcccggaatattttaaagcaaatgccaggcatatcctttcactgcagatacttgagtatctaatagataaggactcttttttttcctaaccacagtatcattagcacaccaaacaatcttccttaccctaatttaacaccatctaatgagataaccagtttgggttcatattttcctgttggtttaaaaaagacgttttaaatagatggtttgtttaaatcaggctccaaacaagtcttggggttattttttaaattgattttttttgtttttgtttttgagacgcagtttcgctcttttggccaggctggagtgcagtggcgcgatctctgctcactgcaacctctgcccacgggttcaagtgattctcttgcctgagcctcctgagtagctgggattataggcatatgccacaacacctggctaatttttgtatttttagtagagatggagtttcgccatgttggccaggctggtctcgaactcctgacctcaggtgagccacctgcctcgtcctcccaaagtgctag

SEQ ID NO: 93770 - DNA, 1574 bp, Homo sapiens
cactttgttgctagggagtatacctttcctttggtaaaatatgaatttgtttcttactgtttagaataggtaaggtttcttaattgctgataattatattatgtagaacgtctttttggcaagggctgtatttattcactatttgattatacttaaacttcaggctgggcatggtggctcatgcttgtaatcccagcactttgagaggctgaggtgctgaggtgggaggattgcttgagctcaagagttcaagaccggcctgggcaacatagcaagtgagaccccatctcaaaaaaaaaaaaaaaaaaaaaaaaaacttctggtgatttcagattgccttttgcagttgagttttattctataaatacttctttttttcctatttactttatatgtctggtggaataggattacttttgcatttctgagttttgaggcttttgtctccatagtagtaaatagtatcagattagtgtttttgagtttttaggtttgcttttagtaaattatcacagcaaatagggtctgttatcagcaaggctgcctttagctcccactaaaattctctttgtgggcaggaatgtttattcttgttcactgctgtatccctagaaaaatggctggcacatggtagaggttccacaaatatttaatgaatgaatgactgtattttatgaaagctgtcagtgttcactatgttagagaaattatacacttttacacgttttaaagaatctgattagttctctgatttattttttcatctttgttgttgttgttaaatagaggcagggtctctcactctgtcatccaggctggagtgtggtggcatcatcatagctcactgcagccttgaacttttgggctcaagtgatcctcctgccttggcctcccaaagtgctgggattacaggtgtagccaccacactcagcttctttcatccttttgctgactaatcagtttagtatttttttttaaacatttccattacaaggtaacctaggaagagatgatacatagtagatttttatgagacaccaattctttttaaagtttctttggaagagggggctggcaaacatataagcctatgatttcagtcatctatacttataaaaatttatttttactgtctttttatgattgtattgtttctaggaataataacaaagatcatatttcttctggatttattacccatgctcaaaagggagtacattgaagcttataagtaaacttttttgtttgtttaagaaatacttagagtaccaactacaagccaggcacacttctctgtgatgggaatacttgtaagaatgaaacaaacaaaacttttgtgaaacttaccttcttgtagaggagatagaaataagtaaaatgtagagtaaaaccagagttctcttagaggaattatttgtgtagcctgtaacttttacaaataataaattcattaagtaccagatttttttttttttgacattgtgggggaatgagattctccatgtcagaacttacaacagtgcaaggcactttgataggagcagtttggtgaacaaagatgattgtttgtagcc

SEQ ID NO: 93771 - DNA, 2208 bp, Homo sapiens
aatatattatttaggattcttctgttgggaagaggtgtatcttctccctatttatttatttattcattccatcctttatatcagtgtgggctcatttatacttgagttacaatccaaagtgtttactttaaaaaaataattttaacttttattttagaatcaggggctatatgtgcaggtttgttactagggtgtgtttcctaatgctgatgtttggggtacaattgatcttgtcacccaggtattgagcgtagtaaccaatagtttttcaacccttgccctcttcctccctctcccctctagtactccccgttgtctgttgttgccatctttgtgtacgtgagtacccttgtttagcttctacttttaagtaaaatcgtggtatttggttttctgttcctgcattaatttgcttaggctaatggcctccagcagcatccatgttgctgcaaagaacataatttcatccttttttatggctgcatgattttaaaccttttcaaagtgaaatagattattccagtgtctgtaggaactgttagaaaaatgctgattagattgtcacgtctcgctgttgtagtttgaaatctaggaatcagtttacaatggtcaaaacttaatttagtagaattatataatatacatgaaactaaacacagtgcttacgatattgatgctaagtaatggtgatagctattattactaaattctcctagataaggattcttaattctctatggagttgcttctacttttataccatttcctgttttttctttgtaaaactttattatgaagaattttattaataaatacatgtaaaagtaggcaataatataataaatgcccatatactaaacaatttttagcacttatcaattccaatctcatttcatctataatctaactcagtctacaccttatatattattttgaagtaaatccctgtgatcaattaatttataaatattacagtatgtgtctcttaaaaataaggacttttttgaacattacaataatatagaaataataatcccttaatattaatgtcttttaagtgttcaattttcaagttgcctcaactgcctttttttttttttttttttttttttttttttggagacagagtcttgttctgtcgccaaggttggagtgcagtgatgtgatctcagctcactgcaacctctgcctcctgggttcaagcaattctcctgcctcagcctctcaagtagctgggtttacaggtgcgcaccacgacacctggctaatttttgtatttttaatagagataggggtttcaccatgttggttaggctggtatggaactcctgacctctaatgatcctcccacctcagcctcccaaagtgttgggattacaggtgtgagccaccatgcctggccacctcaactgcttttcgtttttgtttttgttttttttaatagtccacattgtgattggttgtcttcaaagtgttttaatgcattttaggtttccctccctccctctctttttcttggcaatttatttgttgaagatactgattgttggttatagggtttcccactctggatttgcagattacatcccgttggtgtagttttacatgttctgcattctgtgaatcttctgtaagttgttagttgaatctagagacttcatcagactcaagtttgacgctcttttggcaagagtacttcatagatgatgacgtattcttccattaggaagcacatactattttgtgatgtaacggtttttgaatctttactgaattcttggtattttgattactaagcatttagcaggcattatcttacttagtattcagaaataaccctgtgcagtgataattatatttcaacttggtagttgaagaaacgagactcaaagtaagtggcaagacttaaattcgagactaggcaatttgatgccagagcctttattctaaaaactattatgtaaaattatgtttggtcattttcccatatatctacaataagtaaagtacaggttactttataggatatacctacactaaattattcttttataaatatttactttggtttacttcagagttgaactagactgatgggaggatatgtgtgagtacaaatgtaacttttcttgctatgcactggtatctaagctcaataaataaaggatccttgctgtatttgctactcaagagttttgactccttcta

SEQ ID NO: 93772 - DNA, 1125 bp, Homo sapiens
aaagatggggttctcactatgttgtccaggctggtcttgaactcctggcctcaagtgattctcccacctcagcgtcccaacgtgttgggattacaggtatgagccaccatgctcagctaaagttttcctatttagacttgatctagaattttacatctgaaatagagaaatgtttaagtagtggcatattttttaaaaaaactgtacatttaaagatgataaaggatttctatattttgaggtcctcttaagtccttaagttagcttgtgtatattgtatctatctgtgtctaagctgtttagtgcaaatgtattttgttccaagtaggtcacagacagtagaaagttagaaggggagggaagcttagatcacttatctaggaatgacagataagtttcacctcaggtgccatttctgtttccatctctgatcagttagtagtggctgttcagagtggagtagcagccccccattgccgtgtatttgcaatctctgcacaaacggaactctcttttcctgggggagttgcagaagccatgcaaaggttatgatggcttgagtgaggttatacatctagttagtggcttctaagctgaaatgtctttattggctttcatttatagtattgccctatagaattcctgatataaatcaccttattctgtcaatcaaaaattgcatttaaatggtatctgatttttggataatgtgcctccacttaaactgatcatgtggtgggtcatgcttttcctatgagatgaaagtaaagaaggagaaataatggggtagttggatttattttattaacctgtatgcctgcacaggtgggatgctagctgaaagaagtagagtagtgacatactgacagtttaagttttcagtgttgacttgagtcaatgtatgtaagtatgcagttgatgaaagtagtgagtagttttataagaggagattaaaatctgtaatcaaagacagaattggtgggtatggttatggtgtgggggatgttggctttcccctcctaaataaatgttacactcaagtattctatgccctgccccccccacttctaattcttatttgcttatttaggggtgtgctttagataaatgtatcttttccttaaa

SEQ ID NO: 93773 - DNA, 1207 bp, Homo sapiens
ggtgtatgagtccattttcatgctggtaataaagacatacttgagactgggcaatttacaaaagaaagaggtttaatggaatcaaagtttcacgtggctggggaggtctcacaatcatggcggaaggtgaaaggcacatctcacatggtggcagatgagaagagagcttgtgcagggaaacctcttataaaatcatcaaatttcgtgagacttattcactatcatgagaacagcacaggagagagcctcccccatgattcagttacctcccactgggtccttcccacaacatgtggaaattgtgggagctacaattcaagatgagatttgggtggggacacagccaaccatatcaagtgggaaatcttatcagcattctttgtcctgtcacagagggagtgagaaatccaaaggaacattataatgatctataatggggggagggggcaattacttacttgaaattttgctttagttgtggtccttaatgaaagttcgtaatatagggattaaagtaaccagtttctttctttttaaattctaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggtgaatagtcttttaaattgaacccaattaaaaagaaaaaagtaccaaccatgcctgttaaaaaaatagacaaaaaccagaactatatctttttttttttttttttttttttttttttaatttaagtggtctcactctgttacccaggatggagtgcagtggtgtgatcacggctcactgcagcctcaacctcccaatctcaagcaatcctcccacctcagcctcccgagaagctaggactacaggcgtgtgccaccatgcccaactcttaaaaaaacttttttttttttttttgtagctatgggggtctcactttgttgtccaggctgacagaactgcatttttaattctatagaaatataattctttataggacttcctggtcaatacagtaatgtaagtttgagctcttgattct

SEQ ID NO: 93774 - DNA, 1163 bp, Homo sapiens
gatttttttggctaggtgaggtggctcacgcctgtaatcccagcactttgggaggcggaggcgggtggatcgcctgaggtcagcagtctgagaccagcctgatcaaggtgaaaccccatctctagtaaaaatacaaaagaattagccaggcgtggtggcaggtgcctgttgtcccagctactctggaggctgtgacagaagaattgcttgaacctgggaggtggaggttgtagtgagccgagatcgtgccactgcactccagcctgggcaacagagcaaaactctgtctcaaaaaaaaaaaaaaattaaatatatatatgtataatttttttagagtgtaaatgtgttttttaggctgcataatatgtcagtatatggctaaaataactgttcggccactttccagttttgaggtacgcaacattaatttttgccaccagaataaaattagtgtccttatttccttataataaatccctagaaatatatttaaccatcgtataacctctttaaggctcttaaaaaatatgtgctagaataaacttgaatacttagatactgttttcacttgggtatgaaatataaatgttgaggttcaagtactaggcactaacacgttacttagcttttgtgggataactaatttttttataagtagactgaatagactgaatcaaggttactttccatgaaaatttgtttcaagtttttgtttggaatgtgaataataaaatatacttttcattccttttgaaaggtgaattattctttgttctctttttataagtttagttttgggttgatgtaatctaacattaatgctacattttattataatgaagatttgtagcacttttttattatcttagtttataattaagcttgaaatttgctgaggatctaggtcagccctgaagtgtaaattttgctgttggaatacatgctgagtgtctgaatttggcagatttaagataatgtgtgattagacaacaaaaagacaggtgtcttatttaaatagacttttttggtttttttttttagagcaattttagcttcacagcaatatgaagcgaaattgtagttcacgtactccctgccactccatatacacactgtcccccgccatcagcgtttcacccacagtggtgcttttgttaaaatca

SEQ ID NO: 93775 - DNA, 1047 bp, Homo sapiens
caagtttgtgtctttgtcagtacttgtaatacttgtatcccaggctgcaatagtcttgtgggggagacccagcactgttataaaagctcacccaggtgattggatgagctagactaatagtttaatagagctaaactagctgatagttttcaatcctagccgtatatcatgttaacgttttaaaataattttttttttttttcagacggagtctcgctctgtcgcccaggctggggtgcagtggcacggtctcggctcactgcaagctccgcctcttgggtccacgccattctccggcctcagcctcctgagtatctgggactacaggcgcctgccaccgtgtccggcttactttttttgtatttttaatagagacggggtttccctgtggtctcgatctcctgacctcgtgatccgcccgccttggcctcccaaagtgctgggattacaggtgtgagccaccgcgcccagccattttaaaataatttctatagctttttccttttttaagtagagattgttttatgtacctcgacttttttgaactttggtatatcaaacccttgatagcaaccctggagtggttagttgtatcacagtattagcagtctcccaggaaaaatagagcattacagtttagcttgaaaactttttttcttccttgaaaattttattttaatattgttagaaactacatgaaatagaattaaatgaatgacacttacatcctaaacacttgtgaaatagagtgacccttgttagtccatatatcctgaggaccagcaattttggcatcatcttggattgataataatgcagtttcaagctcaatcccagttttattgaatcaggatatgcattttaacaagatactcaggtgatgtgtattcatgttaagcttgactagcactgctgtggaggaaataacactaaataagacctggccttgatttccccccaaacagtggtttaattgtatgtttttcttatttttaaaatgagtaaattgggctgcataatctataaagcctgtgggagtgatgtaat

SEQ ID NO: 93776 - DNA, 1283 bp, Homo sapiens
gaaagtaccaacctgaaaatatgatggcaataggataatacttggtagatattatagaaagaagtagaacaattagtaaaggaagtagaacaattctgtttgttatggtcatggagaagcatgaagtattcagaagtgcaaagccaaaataacttttacagatgattttccaagttatggaacgtgtctctgtgtgcttgggtatatacacatattgctaaacttggatacagttttttaaaaatgtgtgtatttaagtagccaccttcactacctactctgagacaaatggctgtgtggtgtatggtcggatgatagttactagaaacaacttttaagtcataaaagactaacatcctctgttttcccaaggagataatatgtacttttgattgaccttggatttggtcttcggaccagtacaagtagaatgtaggggattcccttgctaagctactagcttaataaaaagtattcatacaactcctgttcatacaactttatgattggtccccaaacaaccacttagaggctagctggatatcctgctggccagtaactctaataacttgttggagaagtatgtaactggtgaagaatacttatctaggttctctagtaacattttatcttttattgcaaagatgctctgattgtggcggcaatgcttctttaatcatagggaggataatgtagtgggaaaagaatgaggaatcaaatgagtgatttcacttaagctctcagagcctggagccctcatataaggtagtgataatccgtaacaaggctgtcgtgggaaacagatgatagggtgcaagtgttttgtagtactttaaagtttgtaaaactgtcttaaggcacagtaacatatatgtaagaatgtaccagtgtgactacttgtgttattatgctattatatataatgtgtatatttgcaataaaaagttataattttttcctgtggacagagatttagtttgggcaagggtggtaggcaagttttaaattttagctgtaaaatgctgataatatgttcatgatagggttattgtaagtatcaaatgtgttaaaagtgcttaacccactgccaaatattctgtcggaggtggttattaccataatgggtggttatttaagatgagactttgaactaaaaagtaattttcaaaataggcaacttggaaggtgtttgttcagttattaacataagatgtgatcattcatgcttcttagctatcttcattttaataaatgtgcattttagacaatcctgtggcaaagta

SEQ ID NO: 93777 - DNA, 2120 bp, Homo sapiens
gagcgatgggcggggcgggggcggagggagggcgaggagatacaggcggagggcgaggagatacaggcggagggcgaggagatacaggcggagagcggcgctaggacccgccggccaccccgccggctcccgggaggttgataaagcggcggcggcgtttgacgtcagtggggagttaattttaaatcggtacaagatggcggagggggacgaggcagcgcgagggcagcaaccgcaccaggggctgtggcgccggcgacggaccagcgacccaagcgccgcggttaaccacgtctcgtccacgacctccctaggtacgggccagcgaggcagaggccgcggggccctgatggggagagacgctcgctgctcgggctcgcgggcaccggccgcaggcggcggggtcggagtccgcggctggttcaggtctcctcccgccgccgcgcctgcccgccgggcctagcctcagccgcgccccgcgctcccgcagcgcgcggcctgaaagggcggctcgtgggccgcggctccagtagctgctgggagaaccagtggcgcgcgcgtctgcgaccggcccggccccctgcccgccagcccgccgcgtggctgccgccgtgtccgccccgaccttagggggcggccttgagccgtggccgcctgcccggggcgcggggaggtcggctgcggctccgctccgtccggcgagctccggacgcggcggggcgacccgttagctggtgggcgttcgctgtcccttacgcggacagggaggaaggggtggccagggcatgatgggccccgcggaggaggaggtcgcgcggggagcagacaccttgctgccgggtccgaaagctccttagacacccttcctggagggaaccgcagtccgcaggccagggctctgtccccgggctcgcgtttcggggctcctcggctcccgaacccattcgcgcgggttgtgcgtggctagggtgcaagtctagattttcgtgtcaaactggggttatgagccgtttacgagtcacttggacgatagtaaggcctgatcactctgaaagtgtctgtagtgtgaagtcacctgatccttggctccctggttttgctgaatgtgagctcctactgtacgtgtaccaggagcgcccctgccccctcgaagacgcagttgcgttggcagcgcagtgtatccctctcactcataacacccctatttataggagtttagcgtttgatctctcactgtggtgcgaattgatcgcatgaaatcctgattgaaaattttgatggtacttaagaaaggcataaagttttttcaaaggcttataaatagtaaaagcctacgatttggtaagtacggccaagataagagtttattattaaatacagatacgagctcgtgtcttaagatttctttttttacggtgtgtaaaggttttgctggataaaatgtaaagcattttggtatgatgttaaccacaaggactcactttaataggaaagtttatttgaaatatacttcatcattcctggtagttcttggcgcatgtcagaggtgatgacagactggagttttgctaagggaagaagaaaaggaaataaagcttattttattattgtctgccaaccaaaacgcttgactgtttgtacagtggtagcactctgtagaataaaaaactaccaaagaagcagcttcgccttagatgtgtgctggttggatttcttaagtaattaattgttttggaatgcggatggattaatttcgctcttttggttggaccctaggggaagaagtgtgtgttcttttctttctttctctttctttctttcctttttttgaggtaagagttttagatgcagtttcaaaatattctatgtatttaccttattagaagaaacataaatttatacttcagttatggttgtgaacgttgttgtgctgtggtatcttgagaagagatgatactcttcagattgttgttgaaatagggcccaccatttattatttaataaatgcttttgtctgctactcataggtttttgtcctttgttttttaggacggatcagcaagaccttcacttgatagccattcctagcaaatgattgcctaaaacagtccctgtacctg

SEQ ID NO: 93778 - DNA, 1942 bp, Homo sapiens
tgaggccacctaggcttttgaggaacatgaaccaatatcttttctttttgtttaagtcaatttgagttgttatctgcaagaaaaacagatagaggaaggttatcaaagactcactttgattattttcttgaacatgcaggcggtggtcactggcttactgagatcagtcctccagctccttaaaagttaactactcacgggctggacacgatggctcatgcctgtaatcccagcacgttgggaggctgaagcgggaggatcacgaggtcaggagatcgagaccatcctggctaacacagtgaaaccctgtctctactaaaaatacaaaaaatcagctgggcatggtggcgggcgcctatagtcccagctactcgggagaatggtgtgaacccgggaggcggagcttgcagtgagccgagattgcgccactgcactccagcctgggtgacagagcgggactccatctcaaaaataaatagcttctctcgccaggcatcctcgtggaagtgacatcgtctttaaaccctgcgtggcaatccctgacgcaccgccgtgatgcccagggaagacagggcgacctggaagtccaactacttccttaagatcatccaactattggatgattatccaaaatgtttcatcgtgggagcagacaatgtgggctccaagcagatgcagcagatccgcatgtcccttcgcgggaaggtcgtggtgctgatgggcaagaacaccatgatgcgcaaggccatccgagggcacctggaaaacaacccagctctggagaaactgctgcctcatatctgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtattcgacaatggcagcatctacaaccctgaagtgcttgataaaacagaggaaactctgcattctcgcttcctggagggtgtccgcaatgttgccagtgtctgtctgcagactggctacccaactgttgcatcagtaccccattctatcatcaacgggtacaaacgagtcctggccttgtctgtggagacggattacaccttcccacttgctgaaaatgtcaaggccttcttggctgatccatctgcctttgtggctgctgcccctgtggctgctgacaccacagctgctcctgctgctgctgcagccccagctaaggttgaagccaaggaagagtcggaggagtcggacgaggatatgggatttggtctctttgactaatcaccaaaaagcaaccaacttagccagctttatttgcaaaacaaggaaataaaggcttacttctttaaaaaataaataaataaataaataaataaataataaataaataaataaataaataaatagataaataaataaaaagttttctactcacactgaagtgacgaagtccagagaaggtggagagctgtgagcagccagagcgagggctgcaggatggtcagcggcagcctctgctttcctccactccacagacactactcctgtctcttaacttgcccatgggctggagctgtgctaattttgctcttaaatattattagaggtcttaacatcttcctcggggatcccactgaaaagtaataacatcagaacacattattacagtttcagatacatcttaaaatatatactgtatctaaaattttacatt

SEQ ID NO: 93779 - DNA, 1030 bp, Homo sapiens
tctgatgttattacttttcagtgggatccccgaggaagatgttaagacctctaataatatttaagagcaaaattagcacagctccagcccatgggcaagttaagagacaggagtagtgtctgtggagtggaggaaagcagaggctgccgctgaccatcctgcagccctcgctctggctgctcacagctctccaccttctctggacttcgtcacttcagtgtgagtagaaaactttttatttatttatctatttatttatttatttatttatttattatttatttatttatttatttatttattttttaaagaagtaagcctttatttccttgttttgcaaataaagctggctaagttggttgctttttggtgattagtcaaagagaccaaatcccatatcctcgtccgactcctccgactcttccttggcttcaaccttagctggggctgcagcagcagcaggagcagctgtggtgtcagcagccacaggggcagcagccacaaaggcagatggatcagccaagaaggccttgacattttcagcaagtgggaaggtgtaatccgtctccacagacaaggccaggactcgtttgtacccgttgatgatagaatggggtactgatgcaacagttgggtagccagtctgcagacagacactggcaacattgcggacaccctccaggaagcgagaatgcagagtttcctctgttttatcaagcacttcagggttgtagatgctgccattgtcgaatacctgctggatgaccagcccaaaggagaagggggagatgttgagcatgttcagcagcgtggcttcgctggctcccactttgtctccagtcttgatcagctgcacatcactcaggatttcaatggtgcccctggagattttagtggtgatacctaaagcctggaaaaaggaggtcttctcgggcccgagaccagtgttctgggctggcacagtgacttcacatggggcaatggcaccagcacgggcagcagctggcaccttattggccagcaacatgtc

SEQ ID NO: 93780 - DNA, 1049 bp, Homo sapiens
ccagggatggtgtgggaatgcaagtaaagaggggcattcacaactctgttggctgctggatgcagagaaaaccacaagctggataaagagcagcctctggggaaaaacaagctgtagacctgaggtccagcagcaagagttccttcttcaaacaggtggttagcaagtggcacccatcagctacctgttaagtctttgagaaaaattaacgacctactttataatttatacaaacaaaaatactgtcgcctatgtgctgcgccccagccattccccagccctggtgcggctgtgtcctgtagtggagacagccctggataggttccagccttggctcctctgctaggtagctaagttatgaatgcttagctttgttcatctttaaaatgagtgtgttgtattaggcagtctcactctgaaacttaaatcattttatggtatgggggtagagtttatatgatttctgtagagatacaagagtagtgctgtgggaaagtatgacgcacctgttgggaaggaggttgacatatggagaaaaatcagaccatatgggattatgaaatttaaaaaattatctcctcctgctcagtaaacgtgccaaatataagcctatcatcctaagaactgtcttccttttaacaaatgagaagaaattatgtgcatttccaaaattaaagggatattcacgtcatgttaaatgtgtgacatatgtaggcaacgacgaagttctgagaagtaagtttgtgtttacggtatggcctttgttatttaggagattacaattaaaacaggactagcccagatgaaacaattaacaaagctgatgagctataaccaaaacccatgattagtgatgggttcattgaatacattctagtacatctgttctatggaataccatgcaatcaatcatcaagtagaatgaaccacatttatatgtattgacttgggaaggtgtagaagacatattaagtaaacataaacaagtggtaaattataatgaaaaatatgaccatgtttttgttaaaagcataaatgagacctcaaca

SEQ ID NO: 93781 - DNA, 1491 bp, Homo sapiens
acggagtctcactctgtcacccaggctagagtgcacaatcttggcttgctgcaacctccacctcccaggttcatgcagttctcctgcctcagcctcctgagtagctgggactacaggcgtgcaccaccacacccagctaatttttgtatttttagtagaggcggggtttcacttcattagccaggctggtctcgaactcctgacttcaggtgagccaccgcatctggccaattttacttctttatattcctgctttatattcaccatatttcttatatttagtataaaaaggtgaagtaatttactctgatacttcaaggtgatcttgaaagtttgatgaagtgaaatattaactgttttttactttttacagatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaatttgttgtaagcttaaatattgaattgttttcattttaagatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttataacaatgagttaatgtgttcattttcatttgttgcatgtgacttaaatacagctagtatttggcattgagattttaatagaggttataattaacagttcctcttatagataataatctgggatccatgggtgggcttcagagaatctgtgtaccccctaaaattgtatgtagaattttggatatttacatttttattttttaactcttggatccatcagtaatatgtatttttctatatggtacaagatttaaggatctaattttatttttattccaaacagatagctatttgtctcaataccatttattaaacattctttctcccactggatctgttttttttttctttttaagataatagattttatacataggcaagtaagatttaaggacca

SEQ ID NO: 93782 - DNA, 1126 bp, Homo sapiens
tttagtgaatgtgtaccttgattatttttcttagttattcctgtaacagagtaaacattaaacatggttgtatgggtagttctgatcctgcagtaaaaaacattgggtgttttttgcactttgataatggagggttacaaaaaatttgccattacaagtttgtagtatagttgtagagtcatggcagtcagctgaaggctaaaaactggttaaatattttgccaaagtggattagaaaaatctgtgaaagaataaatgaaggacaaggaactctgctgtagtagtgtggaaacagatttttttcttagtgtaagtctgccttcctttataaaatattttaccgaaaaatagtataaacaaaagctgttatataccctgccaaaattttttatttttaaaaagcctattgtgaaattctttgatagttgtggtgggattatgtaggggggtatccattctgagctatgtccattaagatatttaatctgaggttaatttgttccacttttctagggaagtaagcagaattggggtataggaggaaagagagcgaataaagaggcagagaagagaagtaagatgagtaataggggaaaaagcaaagatgggggatgtgtgctagtgatattgagcctttttacaaatattgcaaatcacaaatgtatcccttcagatcagcgcttcagcaaaacaggtttacttgcattttgggatcaccttatagatgacctttccttttcctatgtgacgactataagaaagggaatagaaagagttaattatggttcaggacccatagattccatcagattaagtttattcattggtttattatagcagtatgaaatctatgtgaatcatcacaattctttacctcttttaatttgggaagcccagacttaatgatatgaactggtagaagctttcatagttgaaccatggcagaaattgatacatagatttatttgctgtaagctcaagaagagtttgtgtattaatttgtagcatctttggatatggtttgtagacgaaagattttaaagcttgaaagatgaaaaatgccttcaagatgttaatataccatttatgtagcatttttccatgtcagttttttaaatatttgaag

SEQ ID NO: 93783 - DNA, 1050 bp, Homo sapiens
ggtcagataaggatttgtatttagtgtttgatggcgtatgcttaagcagaggaacattaacagaatggattagtaggctagattggctcaaaaggagtgagacttgcgtgatgagagacgttagaagccatgtggtagaaggaactgtgaatgttaggattgaagaagaaatgactttggggaaatggggtcggggggacagtcataataacttcttgagcatttagaagaggttttggccaacgactaagtctgtaaggccctaaatggggtagaatatgggtagaggatcaatttctatacaatataaaaattcattttctcacaatttagggctatctggaaatcttattattggttttgggtaagcagaagctaaatggtcccaacttacagagatgatgtaaagagaatttttacattgagtaaaagttaaactagatggcctcagtccctttcaatgccacaataacttggaataggtgattaaaactctacttctctagactgaagtgaaaattaaagtatttctcatctcccataaacctcatttgtttaggtgactaaggatataggtaaaggctctctgaattttcaaggattagaatgaccagagtcttgagatacatatttttaaaaatcttattgggcactgtaatttcatcagcaaactttctaaaagtattgtataatgatttttaaaatttactaacataggaggtgctattttagaaacttataaataatttttttgttgatgtctctaattagatttgggaaaattggcatgccttttctgaaaacgtagctagaataaaaattatcctttagagtattgtagtattctcatccaataatgtagcccccttggttagctttatcttggcatctttaaagtttggggttgctcatagtcctacctggtgttatggtcaatagacaatgacctattcatgatataatatgagtcagtgatgtgaacattttcagctctcaagtcaggtgtttgtaaatatgtgcatatacttataaaatactctgtgtttactg

SEQ ID NO: 93784 - DNA, 1177 bp, Homo sapiens
aaaaataaaaggattagaaaggtgcacacttgctgcattgtttactttttaaattttttgtttttttctcaattgtggtcactgaacagaaattctaacataatgaaaaggtgcattatatgtgaaagacgttcttctgtgtggtttgatttttgtaaagtggctgtttataagttgtcactttttgtaacaatttaaggttatcactgtcaatttgtgtaactagaaattttgacatttcaaatgtaggtgaaagtaacatgtctgttcaagatagaatatctttaaacttgataaatctgaaaataagagcatttcatttgggatgcatcttcacctataagtgctagatttcgtgaggataaatttgactgataaaattgttcaactaactgtgtggcaattctggaatatacaaattaaaatgtggatcttgtaaaaacaagggggctgcagtattggctacatcttaactacaatatcagtgtttgaactacagggtggaaaagctcaagatgagtatgtctgtaaaagtcagtaactagaaaaaaattttatggcatacaaaataccttggggagtgggtactctatagtgcatgtactctagcaaaaagaaaaagacaatgtgatgattgatcttttgcatgtttgcatatttaggacttttagatgattggctcctttaactctcaattcccaggaaatcatcttgccttatgcatgaaattgcaaataggtttgttttgtaatgcagctttggctagaccccatgtttttcactacttatggaaatctgcctggccttgggttggtacagttgatgtcagtattagaaagcacatccttagcactgaaacaaccggacaagtggttgatgagaaatgtctcacttctgtcaatttacagttattgaccactcggttttgtttttttaaaaaaatctcatttgaaatagttgtggttacatttttctcaggggctctttaaacaggtgtagataagcttattttaatagtgtttacatctattcttttaaagggtctgatgtttacacaaagccagctgaggttagttcttcatataattctagtcagataagtttagaaatgtataaggtatatatgtgaatagtgaaatataattaaagcacgtaaaacgtttttagtttatgcttt

SEQ ID NO: 93785 - DNA, 1030 bp, Homo sapiens
ctaacttgtgaattgcgatttggtttgggattaaaaaaaatgtttactttttaagcaggtttgaatttactgaaagatgcaattcaacttagacttaaattttttttgttttttttgagatggagtctcactctgtcgcccaggctggagtgcagtggcgcgatcttggctcactgcagcctccacctcccggattcaagccgttcttctgcctcagcctccagagtagctgggattacagacacgtgccaccatgcctggctaatttttctatttttagtagagatggggtttcaccatgttggccaggctggtctcgaactcctgacctcaaatgaccctcccactttgacctcccaaagtgcagggattacaggcgtgagccaccgcgttcggccttagacttaaaatttttttaactagaaattattttctcttgctaggaggcaggtggaagtcatcataaagtttctgtttcacccgtcgtccatgttcgaggactctgtgaatctgtggtggaagcagacctcgtggaagcgctggaaaaatttgggacaatatggtaaggatgatagggacttcatgtagattgaaaactgtggtagaataatccttgcttgcttgttacaagccttgatgtttagcatagtaaatattgtttgtatatataaacaaagtagtatctattgtttgcctatgactgtatttctttggaacgttttaagcctactatttttaaccttcctgggtgatgcatgagtgtatttttgtggagctatgatcacttctcactccccagcaaagttgtataaagaaattatgtgtgcttttcatctgattttcaaatgagtccgtgagtcctgttcaaacactctttaaaccattgagttgattacatgcttcatcttcagagtttcaagtagtgatgcttaaatattgatttttttgttgttcttgattttggaatatttaggaattaattggcaactaaaagtaagcagattaagggtaggcattatttgtttaggtg

SEQ ID NO: 93786 - DNA, 1049 bp, Homo sapiens
tgccttaacctcccaagtagctggaattacaggtgggcaccaccacacccggctaatttttgtatttttagtagagacggggtttcaccatattggtcagggctggtctcaaactcctgacctcaagtgatccacctacctcagcctcctaaagtgctgggattacaggtgtgagccaccacgcccagcctaaaaatatttttcatcggcatgtcccacctacagtcattatgatttctttcaaagcctgtgctgaaaatatttgcttataagccacaggtataaacaacctacccatacaatcattgaaacgccttccttttcatgtttcccccagttgccaccaaagacctggctattaactgccatgagaggcattaaggaaaaaatagaaaaagtaaatttagtgcctttagaaaacctgggttcagaagcagggatgaggaaaaaaaaggatcaggttagaggctgcagtttattgtcgctcacgcccaggagcaccctggtgggagcattgaaaattcctggtttaaagttctgcttccttccttaaagctgtgcgaccccgggcaatttacttaaactctccagacctattttctcacgtgaaacaaatggattgtgatgatttaatgagccatgggctgtgatatgtgtctaaccatatctgaccacatatttgatacgtctctgatcagagggagcaactaatcatttttatcccctttctttcctttgcccccaaataccatctctgactctactagaactttttatttcacttaattaacactgcaaaaaatggcatggagattcaactaggacagcaagcagccactaaaaagtatataaattatctgagattactaaagtgcttattaattaaattgttttcttcatataaccaaaggataagtcattctgtgaatgggggttttgattgagagtggtgagtaattttatttcagactttagtgcactctggctaattttgggctgtccaaattgggtgtcacagtgtggtccttgggttgttagaggagtggaaa

SEQ ID NO: 93787 - DNA, 1050 bp, Homo sapiens
gctcactgcaagctccacctcctggttcaagcaattcttctgcctcagcctccagagtagctgggactacaggcacacaccaccatgcccagctaatttttgtatttttagtaaagacagggtttcaccatgttggccagactggtcttgaactcctggcctcaagtgatctgtccatctcggcctcccaaagtgctgggattacagacatgagccaccatgcctggccaattctgtgattctcaaataaaacattgagagattcatctctatattttatttgactttgacaaatcctgtaattatgtcataatatgatgaacgttttgagaaaagtctattctaagtataatgagaacaaagaaaaaaaagattggtcctggctatagaggttagaatatttcacaagaagaaattatgttagagaatattcttgaacgatcaattggactttgccagactgtggtgggcataggggacccagaaggaacattcattctagttatgagaaagggcccagagacatggcgaatctgggggacaaattccacattttccatatacttgatcattaagcacatgaccaagtgtgtcagtgcatgaggatggacaagatagattggagccttcactgtttttttcttctcatttaccaaaaatttcatcattttagaattgtcccagttttctaattttaagtcagggcttctttgtcatgcttaaagtcttaccctctgtgccctctgctctgtgttctatatggtagcctgaaatttggccctgttatatatatttatttatgccagactcctgaaggtgttcaagcataccatttatcaaatatttccatgtaatgtggcagctaataacagcttcgttttacagagggaagagctgaagcaaacactgatttgtagattgcttggtaacaggaaagagacctgatgtatgccctctgtctttccttcacaaaaattttgtagctttctttgtttcttcaagccttctacctgtagttatactttaagggagataattataagcaatttt

SEQ ID NO: 93788 - DNA, 4146 bp, Homo sapiens
atctctttagataaatttaaaagatagatatgtcagtctgatttggtttgtctgacagattgatggctctcaaacataacttgatccaggaataaagccttacaaatggggggcggctttcttttcgtctggccttatcacctgaattagtctcagttcaggggtctggttattttcatcctgccttagcctcctgagtagctgggactgccattgtgtaccacagtgcccagctgagggatctgtgccttaagtgaggttagttttgcttccttcataccagtctcatcaaatgaaaaccatgtatttcccttggatattacacagtgtttgagaatgttatacctgtacagaaactaaccaattgagtgatagaaacaagtaattgaaatgggggttccttatgtctggtaacactttgtttgacagtgtgttagacagaataaggcaagtgttgcatcttgtttagttttagcttctttatgcctgaccaacctaatacagtgttgagtagttaaggaaattcctttggactgattgatataattgtgtttttcactttttttattaagatccccgtcgaggtcaagatcaagatccaggtctatttcacgaccaagaagcaggtagggtaaaaatttgattatgcttttctagttatatggcaccaatatccaaagagttcaaagtgtttttaattgttgaaattttaagtgttaactctaaacttaggttttagtgggaacacagtaccttatttgtgtatgtcctatttattactggctgactttccctgaacaagggaatgtaaaactatagtgagaaagaagcttatgacttgggggattatattaaagaggcccttgttagaactgataggtgcatggagaagcatcctgaaatcgatgtgcttaaagcagaatgtaaaagattaatcatgatgtagtaattgagtcattttttgaaaaacagttgttgaaagattggcttttgttagcaacaactggtaggatgtttttcagtttaagtgcagtctgacattttaagcttaggacatttgggggttttacggtattggtgactacaagaaagggattggttagtactctttctttaatagaatttctcatgttttgacagccgatcaaagtccagatctccatctccaaaaagaaggtaagctaaatgttttgttgccaaatcttgcctgtcaagtgtggcctctgcagaatttgtttgcttactgctttgcagtctttgagctctttggagaattggtgctatatagattaaaatactatgctaagtttctgaaatactttttttttttgattcagtaacattagtttatacttttgctggaaatacttagtcataaaatgttagggtgattattaagatgtgattggtcctgtgagtacttggtagaaattttggtaagatagatgccttttccccacatgtacaatagatacaaagtgtggagaaaagtcttggaaatagttacctgcctagtgcttctttatgaccagaaaacttcaaatagttgtcatatttatctagtgcttcttaatgaccagaagacttcaaatagttgtcatatttaactgcaggttgaccttgcaattttgacaaggaggatagcctaatttttttttttttctgggatggagttttcgctctgtccccaggcttggagtgcagtggctcaatcttggctcactgcagcctccgattcccgggttcaagcaattatcctgtctcagcctcttgagcagttgggattacaggcacccaccgccaagcctggctaattttttgtatttctagtagagacggagtttcaccatgttggcgaggttggtcttaaactcctgatcttaggtgatcacctgcctcggcctctcccaaagtgctggggttacaggcgtgagccaccgtgcctggccagggtagcctaatcttaagccagggacaaaagatgaatatatgtaagtttcatgtcatttttaggtctttgctataggaaattagtaccttaggccacctttgaagttattgaaagttagtacatgtacatgagagtttcaattgacactaattggatccaaacctaatgtttttctttttagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttaagttagctaatccgtttgaagttggtgttagtaggtattgtatgatcagtggtgaagcaagtaggaccactgatgtgtctaaatgagcatgacaggaactaaacgaaactgattaaatgtatgagaaatagaaacatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaaaaaaacctgctggttgcgcagatacctaggcttgtccattttatgcatttcagcaaagtcattggatactattgcaacttgggaatactggtctgcatcaagtttattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaataatcctgatacttaatttttggaagtgggagctctcagccaaaagtaggaggcattaatcctgtagctttaggatgggcagctagtagcgtcctagaaatgagtatagaaaggataaaaaggtgtggaggaggggtaggggcaaaaatggttttaaacaaattccagccttgtggggaaaagggctgtttgggccaatacctcttaggtcatgtgcaacttggcacccgttactgatagatgcatttcaaaataagctttggtgcatccccccacttgttttctgtgattgggattgccaaattgattgtcactgattggaagtgctgctccagactcattccttctaaactagcctagcactgatgagtaatcagtcagtttttatttttaatttttaaaatttttttgcttggtgcggtggctcg

SEQ ID NO: 93789 - DNA, 4177 bp, Homo sapiens
gcggttaaattgtacagcctttcataggccggtctaatgcatccgtactaagattgttaaggctgagggtccctagcctggggaaaaacgaaaggaggcagagggtagggagacgggaaagaagacaaggagggtgtagaaaacggggagaggagggggcgggacagcatggggaaggcctcaggtttactggagagatcgtggcgttcccatagaaacgtatccctccgcccatgacccgcgtgttagtctcttcagttccttccgcgtcgtttcttggctgtttccgcccagctcctttgtgccgcgcagaacaacgagatgacgcatgcgcaaagcgcagcggccgcatatataaacgcgaacccgggctcttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggaggtaagaagctggagtccggtgagggacgttggtgtgggtgtagtgagcactgcgaggccgtagggttgtcgcggaggttgggagacggttattccgcgtgcgtaatggcggcttaggagcacgccagacgaagccggaggcagcggaggcggggtgctgaagggagacgggatggcgggtgtacatctctgccgagttccgtactcttgggcatttttgtggcccaatccagcctaaagcagggttgagatgacggttttcgcgttgcctttctcggagctgcccgccggcccccctccccccccgccctcggcggcggctgccattttgcgcacattgaggaccgtggtggcgcatttcctcagcgctttcccgccacttcagcggacagatctggccgcagctgtaagatcgtggttgtgtttgagatagaacgaaattggcagctgtgagctgcatgttctcgtcaaacaatcggttaaattgcggaatgggaatggggacgtaatctgcgactggcggctgggttttttttagttatttccagcgcggtttatggctctggggcggggagctggagtcttgggcgagcctgtgcctgggacgtttgccgcggaggacgagagccggcgcagccctgctctcctggcccggcccctaccgaggccctcccgccgccgacgccgctgccgctgcgggcccgcgcgctcccggtgcgcccggggctgccgggactcatgggtggggccgggccaggttccgccccacgcctcggtgtatcctaccacgcgtttctgcttgtgttcgggagggtcaccccgcattatttagaacgttaagaattttgtcaaaagtctagtttctcagggatttgcggactttcaccagttttacgactaagttttgtcttggatagagggcattaaatgtgctttacccaatcttgaggatggcccgttttaaggcaaataagtaattgaaacttgggccagattttgcgtaacgtgcattcttctatttgcgtttttaaacagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaagtaagtaagatgttatgaatcttctgttcattaaaatatactgtggctagataatgaacttagtgctaaatttggattctgaagtctggaagagaccttaaatagctggtcatagtgttaaatgctaaaggcacacgaaggttaaagaagatagcggagatggagttagggcttggtaaagaccgccaaagtttgttgggggggaaggagtggttggaaagagtgagtggttggaaagagttctttttaaatctataagtcctgaatatatttttaactttagaattttgttaatttgcttttattagggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtatttattttaataaaggaatggttggtattctagttaatcaagtaattcttttattagcaaggcagaaactagtgtttttctataaacttgaatgttaattgtacaggtgtattttacaatttttgtttaattaaaaaaatgttactatattaataatcaacctggtcaaaacctttcaggtttcttcgtttgagtcagtcgccttgattcagaatgtcacgagccttatgatatcatgctgaggcgccttgcaaatccgacaattaagatcctcctagaccttgaggtgatcagcataagaggccagatcccctcgagtcatctacacctagcttcaccttattctttaaagggcagaaaatttgagacggtgatcgccgtaacagtaaatttggcttacaattggggcccccctccggtttagaaagaggaacaccagattgaccacattcccaactagaaaaatcttcttgcgtcaatcaagcctcacctggctcatttggctgtcagtttgatcgtcgttagattgaagaaaacatctagatgcagcgatcggctatagatacttctagatcgtctagatctactagaccatgggccaaagagggtcgacctgcaaacttgcaaggtttattttaaatacacattacagtgttttatattatgtaatgctaagttgtaattcagcttttaacaaatctttttttaggtagtaaaaaaaaaaatactcaacaactaataggcccagagtttatttccaaatgagacactaaatttaaatagttttgagatttgatttcagcagaggcacacaaactcttaaaaacgagttattgtctgacattttgttttttctctaacttgaaaaataggtcacggtctagatcacattctcgatccagaggaaggcgatactctcgctcacgcagcaggagcaggggacgaaggtgagatcttgtttaactgaagtctttctgtattattattaaattcactggtagtccaacacagaaaaagctcattattttttttggagacagggtcttgctctgtcacccgggctggagtacaggggcataaccacgactcactgctgccttgatgatctcttgggtttaagcagttctcctacctcagcctcccgagtagctgggactgtaggcactgccaccatacccagctaatttttatttttgtagaaatggtcttgcactgtttcccaggctggtctcaagctcctgggctcaaacgatcctcccgcagtgctgggattatgggcatgagccactgcaccgttccccagttgaagtcttaacaggccaaaaaaaaaaaaaactgtggagatggacttaaagttctttattttaggtcaaggtcagcatctcctcgacgatcaagatctatctctcttcgtagatcaagatcagcttcactcagaagatctaggtctggttctataaaaggatcgaggtatttccagtatgtaacactttttttccttacttgtgtttggattgttcacatcttatcagtagagtgtcttaaggacataattcaaatggattgcttcagggaatatttgagatgtaaaagtttggaatttatgtgtaacttgtaacataaatattaacctagttttacagatgaagaaaagggctactagagattttaaggcttgttaggccgtgtggtagacaagggtcccaagcaatacagttctactcaacactctgggtaggcatgttgctataaacttttctggcttcagattggatgatactagctctgaaagatggtaattgattttcccgacaaaaaggcctattagcaccaggaaaagagatcagaagcaagtagaaacatttctcatttttggaatgatggggttgatttgagacactggaaagttgactagggcagtagtgtgtacacagaaatgaatgtggatttttttttttaga

SEQ ID NO: 93790 - DNA, 1101 bp, Homo sapiens
gctgggcaaaaagtttacctatttaggatccttagtgaatgtttgttgaataaatggaagcattcattggtgacaggattaatttcaaacagagtagagtgtcatctattattttagtgacctacttgggttgatgatgcctctaaacttacttttcctccaaagtattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcaaagcatacagcccagaggatctggaagagagaaagaacagcctaaagaaatggcttgagaagaaccacatccccatcactgaacagggagacgctccaaggactctctgtgtggctggggtcctgactatagacccaccatatggtccagaaaattgcagcagctctaatgagattattctgtcgcgtgttcaggatcttattgaaggacatcttacagcttcccaatgagaggccaggaagtgtgaacatactgatagaaaaagactatattttatccctcataaaatgttttaaatgtaaatgtacatgactgtgtgtgtgtatgtgtgtgtgtgtataattctttgttgttttggtaaaatcagaggagtgggttataagtgctaatttccttgggaaattaatgaactagggcaagtatagcatcccatgcataaaattagcacagggacatcagaattgtatgggtcttcttttttctttttttcttttttttttgagatggagtctcgctctgttgccaggtttgagtgcagtggcgcaatctcagctcagtgcaacctccgcctcccaggttcaaccgattcccctgcctcagcctctcgagtagctgggactacaggtgcacgccaccactcccagctaattttttgtattttagtagagatggggtttcacctgtatgggtcttttcttgtgatggggttacacccccatttttgttaggcaagaaaagcatttggaaaaaaatgtaacatgttagattcaatataaaatattatggtaag

SEQ ID NO: 93791 - DNA, 1958 bp, Homo sapiens
ctgagtaaggaactgagaggacaggagcaaaaatgcaagtaggaaaagctaggtagtagacagtgccgcagcacttggagttggaattccagtcaaaacaaacagcattttttgctgtcctaagaatttcgtggaaaatcaggcctacccaaaatccaatgagagtgtttaaaattgtaatctagagttaaataaatgatccttggatttattgaatttttgcatttctgcataaccgtttcagtttgcctgccagtttgcgtaagtgaaagctgcttcttggaaatgaccagacaagatcctcttcatacctgaggaatgaatccacttgagcctcattgctaccccctgaaataatgcatttttataatcactcatttttgtaagacttaacactttgttatgctgatgcccttgcttaaaggtttttccacttctttcaggaaatggccagcctcaaacgacaattcacggaactgttatcggatatagggtttgcaagggaagggctcagagcaagggaaattgagaaaagggcccaaggaggagatggtgtcttagatgccacaggagaagaggtaaagaatgtggagttggttctcatttctctttaattagcacctaaatacaatcttaacctgggaacacttgtagacattcttcttcacttaagcctttgagcagtgggttaatggcattcttgattttctgcttcgcacaaataaatatcagctgatctggcacggtggctcgtgcctataatcccaacactttgggaggctgaggcaggtggattgcttgagctcaggagttcgagaccagccagagcaacatggtgaaatccctcatctctctacaaaaaaattagccaggcatggtggtgtaccacctgtcttcccagctatgtgggagggtgaggtgggagaatgatgtgatcccaggaagcagaggttgcagtgggctaagattgagacactgcactctagcctgggcaacagagccaaaccctgtctcaaaaaaaaaaaaagtataaaaaaatttttttaagtgtcagctaacactcataagaatagagggggctgggcacggtggctcatgcctgtaatcccagcactttgggaggccaaggtgggcagatcactcaaggtcaggagctcgagaccagcctgcccaacatggagaaaccctgtctttactaaaaatacacaattatccaggcatggtagcacatgcctgtaatcccagctactcgggaggctgaggcaggagaatcgcttgaacccgggaggtggaagttgcggtgagccgagatcgcgccattgcactccagcctgggcagcaagagcgaaactctgtctcaaaaaaaaaaacagggttttctgctcattgttgctgttgtttttggtttttaaatttcatgctgcttcttgataaattcataagagatagaatagacttccagtagaattttctcaaatcaggccagcattttttctaacaaaagacagctttttctataactataggaagagcacttctgtaagatgaacctgatgctcctgtgttccgagtgcagttagcactttctggagattctgaacatctcatgaaccataatttttttctccatttatactcaggaacactggctttgtaacgctttgcaaaggtctagaaagtcattgtaggctccttggagtgggtccaatgtgactgtggtccagtagatttgtttttttacttagaaataatttttctagcaaagagatagaaattaggtgctcttttttttgctttaagatagagatcaaatataataaaacggtaaatcctacagcacagacagaaatagccatattagagccagacgcagtggctcacgcctgtaatctcagtactttgagaggctgaggtgggcagattgcttgaggtccagagttggagaccagcctggccaa

SEQ ID NO: 93792 - DNA, 1039 bp, Homo sapiens
gtattccgtcttgtggtgatgtaagagaggggctaaaaatgcttcatttagggagacaccgttgttagtggctaatgctattaagctacacggattactgtatgaaaaaatactttgtgaaaactgtacgtggatgtgtgaatgattgtgtagccaggaccatggaccttaacatcaaatggggatgaaaagtaatgaattgctttttctctctttttgtcatgtgattttatatgtgcttgtatgaaaaggggttgaataaagaaactgtgtagtttgggaaactctgcacttgatgccacttaaatcagcactagctgctcctaccaggggctcaactatcccagaatatacagggcactgtgtccctctacaggaggaagctggttcatctattctgtccatagcaagcagtcttggccatgtttttataaaatgactcaatttatattttctttttctttatagatatgatgccagcaaagggatggaaagtctagaggacacctttgtatctcaagctaatgctctacaaaggaaaggccgagcaggccgtgttgcatctggggtctgcttccatttattcactagccatcactacaatcaccagcttttaaaacaacagctaccagaaatacaaagagtgccattggaacagctgtgtctaaggtgacatctggttttttgtgttttgcttccaaaaggtctaaatgtttctcactctattaagttccatgttttccttttacttctagaagatatttggctaagaatgaccaccaataatctcatttatttgtgaagaaagatatccttagtgttgcctttaccattccttttaaatttctgcacataaagatctcttacattgcagagcatggccctaaaacagagcttaagagtacatatgtagggccgggcatggaggctcatgcttataatcccagcactttgggagactgaggcaggtggatcacctgaggtcaggagttcgagaccagcttggccaacatagcaaaactccatctctactaaaaat

SEQ ID NO: 93793 - DNA, 1031 bp, Homo sapiens
gcggatcacctgaggtcaggagttcgagaccagcctggccaacatggagaaacaccatctctactaaaaatacaaaaattagctgggcatggtggcgggtacctgtaatcccagctacacaggaggctgaggcaggagaatctcttgaacccaggaggcggaggttgcagtgagccaagatcgcgccaccgcactccagcctgggctacaagagcaagactccacctcaaaaaaaaataaaagaattcattttcattgtagcacttaacactgtctgaaattggagttttgcatacttcagtaggatataagctccttaagagtagagatttcggccaggcacagtggctcaccaccaagcaacaacagcaaaactccgtctcagaaaaaaaaaaaaaaaaaaaaagaatagacatttcttgttcaccactgtatttctcagaccctagaacagtgcctacagcatttaggtaccgagtaaatatttgttgcatgaataaatgaatgtaatgattaaatggaataatagatcaaaaaattactttatgttggttgggcatggtagctcatgcctgaaatgccagcactttgggaggccgaggtgggtggatcacctaaagtcaggagttcgagaccagcctagccaacatggcaaaaccccatctctactaaaaattagccagacatggtgatgggcacctgtaatcccagctacttgggaggctgaggcaggagagttgcttgaacccaggatgtggagattgcagtgaaccaagattgcgccacttcactccaacctgggtaacagagcaagactctgtctctaaaaaaaaaaatatatatatatatatatattaatctatgtgatcataaagaacttaagagaaatgagaatggctgctctcttctgcttacactttaatcattatgtggttttcttttcttttttttgagacagagtctctgtcacccaggcaatggaggtgcagtggcgcaatctcggctctgcaacttccgcctcctgggttcaa

SEQ ID NO: 93794 - DNA, 2015 bp, Homo sapiens
taccttctagtttatctttttaacctcagcctaatcatagctaaattaatacctataaaatattttgataatcataagctaatactccttttctttggggttcatgtgtagagtttacgttcctagaagcatttacagaccttaatttaatgtctgttcaatagtcccaattttacaaatgttactaaactattatttgattgtccttttgattggagtgcaaattcctagaatttcccacctcttggtaataagtcaggaggttgttttagaaaatacctgaaactgaacaacttttattctaattagctttatcacttttctcattccatatgattgcttctttagttaactagcccttgaaaacttcattttaggacttatttgttttaatgtacagatgtgggaaaaccacacaaattccgcagtttattctggatgattctctgaatggaccacctgagaaggtagccaacatcatctgtacccaaccccgacgaatctctgcaatctctgttgctgaacgcgttgctaaagaaagagcagagagggtgggtctgaccgtgggataccagattcggttagaaagtgtcaaggtttgtatgctctgcttatttcctggtaacagaaatttatggtttttaggtataaaaagttttgggggttaggagattcatgggcaatttgggatatatactttcaggttatttttaaattaatgattacctttggtaatcatttatttaaatatttagaaatatttagaaatattttggtataagaactcttatggccaggcgcggtggctcacacctgtaatcccagcactttgagaggccaaggcaggtggatcacctgaggtcgggagttcgagaccagcctgaccaacatggagaaaccccatctctactaaaaatacaaaaattagccaagtgtggtggcacacgcctgtaatcccagctactcgggagtctgaggcaggagaatcccttgaacctgggagacggaagttgcaatgagccgagattgcgccattgcactccagcctgggcaaaaagagcaaaattctgtctcaaaaaaaaaaaaaaaaaaaaaactcttatttggttgtactaaatttcctctgtaaagctttttattttttattggcagaagtcatctagtaaagactgttttgctcttgaacttgggacataatccatttaaccaaataaggagcagacagattgagaactgttttcattattcactgttttttaatgctttttatgaaaatcttaacattgtgatatgaagtagaaaggcttttattactgtccctggcaagaaactatgtttagtatggtttcctattaaatggaactgctggtgtttccaatattttttatcactatccattcaaaatggctttccagtaatgtttcctttttttgaaaattttattaatgatttatattgccctttcatgtgtaagtcctcagccaccagactgttatactgcaccacgggagtgctgctgagaaggctagaaggagatacagctctacaaggagtttcccatatcattgttgatgaagttcatgagaggacagaagaaaggtaaaacaaagactttcccagggaacacacactcacctgaattgaaggcatggcagaaaaaattgttttctagttccaattcagtttcatgcagctagtaatggtaatttgccacaaggaaggcctatgttagagaagagcaactgctttcttgatctccagggtctgtaacactaaaaaggacagcacatgctcatcacttattagatggagtcatcctgttaggttagaaggtatacttcacaccatcctgggcattatgctaagttgaataccgtacttagtagaaataacagatgtcatgcatgctgtggctgaatgtatcttcttccttgtttatttggccattcagtcctgacattgattcatgtatttattgagcctgcattaaatgccaagtgatatattagttgctg

SEQ ID NO: 93795 - DNA, 1019 bp, Homo sapiens
agtaaagttatttataagggaacatgatgactttattcaatatttttcttctttgaaacatctcattactaacttttaagattatttcataatcccttatacatgagccaatgaaatattttgagctctacttaagaagcatgaagtctatattataaatctaaacaacaaaagcacttgtaacttgtttagtaaattccatgccttattttccatttttgacaccgtaaagtgcattttctgtcgactgtgagcaaatttcccttttgcctttaatgaaaatagtgcattaagtagccaattgctgcagaattataaagcaaattagctaacagtgggtcacattggactaccactcaaagaaacaagatgcataacagatgatggaaggtacatgtggtgtggcttagggagagcgcacctgtgccagatgcatgccactttcagtagctgccaaatgtgcctttaattaagaacatctctaatttttttcttcagatcaagtcagcatttggggtcgggatttgggcagggaactttggggtgcaaatatctggtgaaaccaccagagaatttgtttgtcaaagtgacatgtataattttagttgagacgtgtttgtgtatatatgtgtatttgcctttgtttagtagcacggttatttgctaaaataattgtcaaaaaattgctctgtcggtcggtctttgatgtaagaacaaagtgtggtctatacatctaatatggcctttgtacctaaccatgttcataggtaatctttgtactctgtgtgcagcagtatttggtttgcatttaaagtgaaaataacggctgttatttttctggcattactaagataaactgaaaaataataaagaaaaatgccttacatagcccacaagtgtattatttttgcatgtatttattttagagggcagtatttttgaaatcattagtgattctcatttagctcatatatgccatatagaaatattttgcatttttattgtggtctttctttgga

SEQ ID NO: 93796 - DNA, 2555 bp, Homo sapiens
cctgagttcctctgtactgggatgtatattttcctagccccaaatccattgctggcaatggatgcactgaatgtgccagcactgaggagttaaaatgagaactccaaacactaacgactcttcttcaagatgcagtataagacaatgaattttaacctagatgtaattatacaatggaaatggtattccagtttagaatatggaaagaccgacctagaggaattggacaactgattgcacctgaaaatcataaagggactttttctggccaataggcaggagtcctctttttgtgaagtgatcttttgtgaagtgatcattaaagggatggaaaacacagtctagtgtccagcaggcccacatgacagtttttgtaattcaaattatgcacttttaaaaaaaaaaacttaaacagggatcttaatatcttcctttgttttcctttgctttactcttctactttagaatattttcttaaaaatcactcaaaggactgtgaggaaaggctgtggtacctgaccttgttgaaatcaaggcccggcactgtactacaggcctgtttacagattattacggtgaactgaatgggtaccgaggcttcaccaaagaggtacttttttgttgttgttgttgttttaggaataattgtaccaattttaagagcattccccccacctgtccccacacacccaaacaaaatgtggtggtgttgccttcaaaaaagagaagttttgtgtcattaacatgacagaagaactttttaaaaaaaaataactgtcaactattctatttgcatttaggagactgttcatctatgctagattgtcattttccctccttctcccacagaagtttactggtagtccatgtcatggctcgtagctatccctctaaccataccatggaaatgcaggcacccaatgtgaaaaggagcacttgctgggcatcactgacaccgctcatgttttacacatagttgagtaatcagcatatctagaattatcttgcattgcctaaatcatatgtatatagtgaatgttatataatatacctggcaggtctgttttaatttaattgaataaagatacaaatactttgtttggctggcatatattaaattattatatgaagaaaatggttgattcttatttcttttagttgaaaaacacacaaaaacactaaacataaaagcacgttttgtggtacgccttggtttctagttctggatatatgtattaatcttaaagaatgatctaaagtcacagcttggcatataggaagatacttggttagaataggatgggtatcttttaagcagaactttgtaagtaagttttaagttcctaagcaacaagtatacagtttgttaaggtttatattgaacattctaccttgcttgaggttttctgctttatcaaaactattcataatagaacatctacctgcatcattactatcataatatggattattcataaagcgtatgtactgttcttctgagtctaacaaatactgtgactgaaatgcatgcaccttgttgaagagaaaacattttattaatctccactataatgtctgtgaaatgtgcagtattccatccttagagagtttatctggttcatcagcatctgcatgtatcctctgaataatgaagcaacatttcagcaattctgttaaccacaccattagagacatttttagaagtgctgcaacatggtgggaacctagtactttaataatttcctatgatatttattagagcataaaatgtacatcacgatagtacagtatgtagtcctttaagaccagaaggtatgttaactgcaccatcattaagcagtctatcctattttcttatttatttgttagaattgaatcctttctcaatatctgtaccattcctatgatggtagccattcttctctttataaaatatttcctctttgaaaagcgtcctaaaacattaatttcaaatcccctcttggatgcaaagtgtccctaagaccatccattcaacagtatttatgtgagccaacttactagagccgctacaactaatcatgatagacagtccagaatctccctggactttatactgggccagcctcattgtccctaagatttctctttttatgtctcatggattacttctctttttaattgccccaggcacattccaaatgagaacctggtaaaagtcacattggacccccttcagtatgtcttcggctaatgtgttagccttcaataaggtgataaccccttttcaacctatctagtctataaagaggaaaaattcagatttggagttctaatcctatttctcccaaagggaactattcttctaccccatggttctaggagaccacttcactgtgcaacagttttacatgcattgtggatggaggatatttttattctgaactgttacatttaggtaaaaatattttctgcagtggtaactgattagaaaaatgccaattggatgcccttaggtggaggtgagaaaatggcatccttgccttcttctcaatatgaaacattaactagttgac

SEQ ID NO: 93797 - DNA, 1033 bp, Homo sapiens
taatcactaaaatcttgcaattagatgaagaatagaacacaacagaattcttgaattctactagaatacacccacatcacaaagacctcacaaagacctccatacattccacaagatagtggcctcaccagttaattctgatgctaatagaggatgcaccaaatatagtaggaaaatgattgtttgactgtaccagtctagaagacgggaaagagcagtatgcctgactggaggcactgccttccttctatcagtcaccctgaatgtgtcttctctatagtagttatactatcgccacccccctactctctacattattttatttactaaattctttaagctataactttattggaaaaactctaaaacctttagttcactttttttttattcccagatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgaggtaggtttctacatgtgtttttaaaatgaactttcattccctattagaaaaattagatttttaacaattattatctttaatttttaaatgtctcatttgtcttttcagtagtagattaaaagactgaattatctaagttttgtaatgaattggttgctttttaaaatttaagcattcctattaaaatgtattcacaggtcccagcctaagctagaagaaaaaactttcggcacttaatttgtaagataatgtacagttaaatgttcacataattgtgtaaggaatgacatgataaactagatctctctcacacacacacatactttaagtttatactgaggtctatgaagataatttatttgaagcaatatttgaagcaatgttacagtcataaaatcaaattgatactgttgtatttgggcgtttctgttagcctagtattttttttgacaagacctttgattccttttgta

SEQ ID NO: 93798 - DNA, 1674 bp, Homo sapiens
atcatcctcttagcccattaaagctttgctctcacccaccttctttgtgtattattggcaacatattacaaatatattacatttctatgtcaataaattcaacaatgtttatattattttatacagttgtttaagtcagttatgagaagaaatgagaaaaaaatacgcatttacaaaatgtctttaataattacacaattacctttactgatggtctttgtgtggattcgaattaccatctgggatcacttgcttttcagcctgaagaacttcctttagtatttcttctggagggtgggctagcaacaaattctctcagtttttgtttatctgggaaaatctttattttaccttcgtttttgaacaatggctctatcttcaagttaatattttttttttcagttcaaatatactattgagcttatccagtaagttttttatttcagttattgtactttttaattccagaatttccctttggttcctttttatagtttctatctctttaatgatatcctctcttcgatgcacattgtcatcaataccttcctttccttctttttcatgctttcctttaattccgtgaccgtattcataatggctacttagaaatcttttttgttactgttgttaaatctgacatttggttgctctcacaggcagtttctgttccttccaccccctccgccccacccccaccccttgtaagagtcatactttcctattggtttgcatacctcatctgtttttgctggaaacctgacatttcagataatatagtgtagcaactctgagtactgctcctccttccccagccccctttccagggcttcttattgcatggcagtggtactggaaagactcatccactccttacctgaccacacacacccagctatgaaactccacaatttgccagctgattgctctgatgttttcaacaattttctggtggcataaatgctatacaaaataatgcaatcaaattgtggctcctttgaaggaatggtttctgagatttctgtttgatacttgttctgaccccaggagggctcctctcagccgtcttatttcctagttgtctcctgcaaactactctgcctacagtctagggtgtatcttcattagatccacaaatctcttccccattgcctttcaccacaatttccactgttcctaagggcaccattaaatttaaactactttatactttgttgcaaatgacaagaaattaggagctatctgtttgaaacagggctctggggctgggcaacaatggcaagcttttctctgagtgacacttctgccctaggagctaagtgcttggttgagcaggtagagtggcagacggatgctactgcagcctgaggtcttcttacccgcctcttctggcatggaaccacgccctcaggaaccagaggaagggctcttttctcagtatgctcaaaacatcacacccaaggtagcgtctccattccataagtggaagttgggcaaaaaagggtattcctacttctcagctgcactcaactgggacttggcctcagcaacaggcagcagggacaggatgagaaaactgaagtcctgctcctgcacctcaccgggagctaggtgttcttgactgcaggaatctggagtagatgctcagttcaccctcactgagctgggagaaag

SEQ ID NO: 93799 - DNA, 3142 bp, Homo sapiens
taagggtttctttaatccagggaggttatacgatatgatagaaaagagcactaaatcaggaatcacatgatctaggttctgggtccatctctgccactctacagtatgaccttagataagtctagttacatctcttccagccctgctcacctcacataaatcatatgaaataagttatgtcaaagttctttgagaatgttacataatagaccaagaattggtgtgatcccatttgactgtggcactgagacacatcatggctttcccagcattataatcaattactaaagaactgaaatggccagaagttttggcttaagaagatgaaaagtctgtttagaaatagcttgcctttaaacatagccacagttttcttaaaacatactttaagtcacttagaacttggcttttattctgtttttcaacttaaaattcctcttgatgtccctcaactttttagcctgattttcatggcatttgagaaaatatggaggtgagtgttgattttagatttttagactgaaataaacttttcctttaaaaagggagagggcaccctaaatttggaacacaggtcaaggatgcttggagtactctgtactgcgggtatgggctctctccagcagtgacaactcagcatctctctagtggccactgcttttgcttcctaaacatgctgttttgagtagcctcaccttacaaatagatttgcagaacaggaagaagattcttgaaagggaagattgtgatgaaaccgataaaaatctctgtattaaaatcttgtacagccttctgttttaatatcttttcttctggatgagacattagtctttaacttttgaggaactctgtaactgaagacaaacaataaaataccaacagagaggaaattattaaaggattatatgtatttaaattacttttatcagtaacccactctagcctcagaaggtataaagctaacggagaaggggacatttaaaaccaatgtatttttattctgtaaatctttaacttaaaatagtattttgaattcaaggttgtctgatatttaaatcagttattatctcgatgaccacatatcaatagattggaagtatatttctgttttgtgataaatccatgaatttgctttttggggaaaaagctattataaacatgttattttaaggctaaacctaggatgggtcttagtgagaatcagcctaaatgaaaattttccaaacaaatacattctgcttttgctaaatcctatgctaataaaagacattgtgcttcttataaaactttgacccacattatgtagcctaacagaaataaaggcatctgctaccctctatgaatttactattggagtctaccagtccctaatacaaataggaaaagaatgctcccaataaaagactcaagttactgaactttcccctccttaaaaaaaaaaaaaaaaaaaaaaaagatttacaattaaatgtgggccttgataaaatttgagttatagaagtgagtgatttctcccccctattatgggagatgtctttccccctctttatgcagaagacaacagcccaagtctcttgtgctggtgagagcagcctttctccacaacttaggataatactgttaaggagagacgggagtaggtcaggcctaggggagtgatcacactcagcctcttgttttacttcatggagatgtgaatgaaaagtaggtcctttcatggaagggattggagactcctatatttatgattgacctctcattgtgactacttgaaataaaggcaattaaaggttggaataggaccaaaccaacatattctatcacatttaatagttttaatagcttataagtatttgtaagcatctttaagtagttgtgagatttttagcaaataatttaaaaactgtatttaactttagctactactttataagttccaatttccagttgcatgctctgttaacatgatttaaagaaagctagataagtcatcctagataaactcatcttgatgtaaggaaaagtaatgggttattgctgtggcctttctctttataagggggataaaccaactggtgatactttgagatcctggtagcaggtgggaggggagcctggttccctgctttacctttgcttttctttcttgctcattcctgtggccgatgagtttaagatcatcttgtcagtgtgcagagggcaagaaataagttgatgtaaagttttaatatcaccactaatttaggaggcactaagctagcagtgcattaccaagtccaaagccttctacttggcaaaacattttggaacttttaaacttgactatttgatctattttgaaaatgtacataacagttttaatcattttgaatcatagagtttaataagatatttttcctttttcttcttagatcccaattttgttcggacatttcttacaacatacagatccttttgcaaacctcaagaactactgagtcttataatagaaaggtctgtccatttaaaaaatatttaaattcattattttttgttaaaaaagagattgagctaagatccttttcagaaatgttagatgagctttaaaatatacttcacaagcactttttcaataaataaaatctcttagatgaacatttattttataataatgttagcttttattatttcaatacaaaaatattcttttttgtatgtgaaaactcagtatttgaaatttcaaatttacagaactaaagacctatataaaatttatagagtcaagaaattcaaattctgatgagttagatgttctaagtaagttttcaaacatacttcatgttgagtaaaatggaacttgtcagtgaacaaatactgtgatggaaggaaaatatttcatgtacccaaacaaagagcagtcagtttttctggaattacccttaacagtgattatgtcacctgatttagagtaattccacagaccaaaaatgaatatcagtcccgtaactttatagtcacatttatttttagaatttgcatgtattctttattttgtttgtagttagttttatctatattggcaagtactaatttcttttaaaaattttaaaataattttattagcctttaatactataggagtctcacttgtttacactgatat

SEQ ID NO: 93800 - DNA, 1759 bp, Homo sapiens
ttaagtccccttagaggactcatagaatttttataacatgagcattctaaactttatcatttcatcctaagtacttttgtttggggttcctagactcatttggagtaaaattaatctttagatttttctctgtgtttgtaagaaagaagttttaattttttttttttttttttttttcctgtagagcattgtaagaagacttactactagtgtttactgtcacaagtcagtgatacttgggcaggaaaacattttcaaattacaaaatttttaattgtttctgtaagacttgattgagtgatagaagttttctctaaattgctatatttcacaaagttaatttatgattattaataagcagctgaagaatggttacaactattgtctggggaactgtcccttttatttatttttttaaatgaggacactttaaagcaaaattaactggaacaagctgatacttgttttgtagtcctgaaagtcttctttccttaatgtgtacaatgttaggtaaagtccgtggacatggtacttttgtaatgatgttttattagttatttctgtctgatacttcttttctatatcaatttttagctttggtatagagtaatattttgagtgcttttacttataatgaatataaaacacttaaatttcaagatttatagaactttgccaaagttaagtgtattgaaaatttaagttgatgagattattttacttaaaaaaaatgtttttaaaaaattccttccaataattttttgagaaataaaaggccagtgttgtggctaagttttttgatatttttcttttctgtcttcttttgaagcttaactgaatattttaatttatgtcataaatatattactggtgaaactggagtctacaagcagctttcgtgagttgtggtttacagtacacacacattagtgttaactgttagcttatttgggctattctgtaaggtctgttactgaagttattactggcaacatagaatggtttttaatagaccatctgtgaacttgtaaaactgaaatggacttttaaggcctcactacaatggtaacagatcaagttaccatttgtttttaagaactactggtctgctcttctcctctcatctttcttcagcctccccaaagagaaaagggatttgtgatttggttagtaggtatgtttattggagaacatgcagtacaggttgtggcttacactgaaacaaagctaacatttaacttacacatttttattttattatatagaattgtaataaaagacattggatataatacatgagaaaatttaatgaatactataagacacgacttacagacatcttttagattattatagtttggttagacattgtcataaaaacagaagagaaactggtttaaccttactttattcagacttcactgtggtgtcagccaactttatccctcaaatattttaacagtaatgtacaaaatggagctatagatctctaatgctagaagagatgcccaagccttcactttgtagacaaatcccaaggcccctgaagattatatgatttcccagaagttctattacgagttaattccagaacaagtcaagaattaggtttcttgactctaaatagagtatattttctaccatgttacattgactcatataaggtgattgttttcatgaatagaatatgttgtaattttttaattatatgtgttaataattaagtaaaaggatctggtacagatgtgagctcaaaaaa

SEQ ID NO: 93801 - DNA, 2594 bp, Homo sapiens
aatttgatcctagattttgtaattgagattccttctactatattgcatcgttctctgtatatttatcttccttatcatctcaatattatataacaataatataggggtcagaaacctaagaccaaattccacacttaaaaaaaaaaaaacctcgtctacatgcttagtggtatgctaactctatgataattcagtagatcgattatgctccccatttcttttcagtggtatgcaccttgaaaaactacatattactgcctgtcacaagatataacccatcttaacactgctaatcttggtcttttaatgtagaaaacttggttgtgtattaatagtaacacacaagaaaaacacttttaaaaagaatatttgatgacacatttaaaatttttattgtgacagttgaataaatgttatttttatccttaaatgagtttattattattttatccaaaaatgtactactggttcagatttgtcattttggctttacagcagttagaagaaaaaagtgaagatcaagaagacaaggaatgtttaaaacaagcaataacagctttgcttaatgttcagagtggtatggaaaaaatatgttctaaaagtcttgcaaaacgaagactgaggtgaatatttttactttttaaaatatccttttttccctgaatattgtggtgtaaattcagggatcccagttccctcctcaagtaaacaatgaagaaaatagttttagtgacaagcctggtcttttagaggaagtgacatcaaagccaagagaattgttattgtttgaaaaacctttcatatttgtgcattttccttgcatactcccagacaagacctcctgagagtcaactggtaagctgaaggagagacagagtaaaatgtatcgggtagatttatgttggcatcgttattctgtcaaagtaaaattattagtgtcctttattttagggattatataacttgaggcattaattcagataacattgcttccactttcctgattataatatgtgctacatgtttttagctttgggtcttgtccatttaaactcttctaaataatttattttaatctttcagattacttttttttactgtattgggctactttttattagttgtcattctaaatatttagtagccaagatagaaataatcattttgtagttacatttaaggagaattttgtcagcaatcattgtgctttttagaacactgaaaaaaatttctaggttgctttaattttcaaaattgtgtaattttgtaattctaatctatttggggaattagtgaataccttctcagtgagacttgtaaaaatctacttttacactttcccttacttacatgagctctaggttttctgtcatctatgtactaataatgtctttttctttattccagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcaggtaagaattatgcagttgcctgtcacttttgttttcctgcttcaaactgattttctttcctgcatgggtttattgtgcctaaaatagaaaagaaactaacaaccaaagacctcttttctttgactaaaaataccccactttatatttctttggaatgttttactttttctactacacttaaatacttttttttaaccttaccatcagttatagatgagaaaatgaggtcacttggctaaatttatccagttagaaagtgacagaaacaagactaaagttagtagtaaatcatcattattgggatctaaaaagttttttactcctttatcttttttttctttcttctttttccatttctgagattataaataaaaattttaatataacaaaattgtgctggtagtacaaatatacacggcattgctttctctcagtttccactcctaaacctgattatttaataataaatgttgcaatcctggaagccaaggattccagttttattataatttttcacctagaaatgtctat

SEQ ID NO: 93802 - DNA, 1043 bp, Homo sapiens
taaaaacatgtctggcttcagtattctaaatgtttataccttacctagttgtacatatctatattctttgttgttgtcaagttaagatttgttttctagaaccaaaagtctgcccactcttatggccatgtttgttgataatactctactggaaacctttaatgagagctgttataacatataaggattttattattcatcagaaagaactgatttactctcttacttgagaatattgggatctcttctattaaaattataattagtagtcatataatttttgcttagagactttcaaagacatacataattgtgctcgcatagtcgtgccccataattaaatctttctgtgtttgtaatggtaaattatttatgttttaccttctttattttctaaggaactggcatttgatccatatgaatcgtatgctcgagatattttgcgacctggttttcatgatcgtttccttagtcagttatcaaagcctggggcagcactttatttgcaggtatagtaatttttaaatgaagatgtacaatgtctgaaaagtaaacttaaaaaaaaaattaaatcacttttttttccagtcaataggcgaaggtttcaaagaagctgttcaatatgttttacccaggctgcttctggcccctgtttaccactgtctccattactttgaacttttgaaggtaagaaaactctttattgttatttgtaacatattcaagtgtgaatttttttttttgctacttcatttgtaaattattgtgtgagtaccctgcacattagtgtgtttctgttttctttttccagtcaagaagcaaatggaaatcagtctgcaaaagagtagcatattttctcgtcttagtagtgaattttatttttgttgttttttaatttttttgttttttgttttttcttttttttatttttggttttttagtgaatgttaaagcaattgtcagatatttttgtcttgtacctttactttttgtttacatggctgattctttgaaaacaaccttggatttatgcatcgcagttt

SEQ ID NO: 93803 - DNA, 1027 bp, Homo sapiens
gttcaagcgattctcctgtctcagcctccccagtagctgggattataggtgggcaccaccgcacctggctaatttttgtatttttagtacacacggggtttcactgtgttgctcaggcttgtctcaaactcgtgatctcaggtgatccacccacctcggcctcccaaagtgctgggattacaggcgtaggccaccgcgcccagcccaggctggtcttaaattttatttcttgatgaaagatttttgccttgttttttaacctcagagtgataagcacctaaagcatcaaacattgactaaagaattgtaacactaagaaagagatttgattattccgatctttattacgttttatctcaaattctgtctttatatttttaaataaaagtaacagatctgagctcaagacatgacagagcataatttagaagcttttccaattctccagaaagccattagctagcaagggatatgaaagattcatcagaattcaacagagtattttctggcagtttacccaaggggttcttgaatacacttggagaactcatgtatcaaacaactaggaatcgatatacacctaaatccctttgccttttcagactccacaaaacctggcaataatagccaataaagttgcttcagaatctgctggaacttactagagacaaaatgaactgtcaagatagaatcaagtagtccttaaggaaggtttataattcaagagttttcatctttaattgaatatagtgattactccttaaaagaacagttactataaaattcttattaaggctgttgttaattatttagtaaagtatttgcattaattgtacttaaattactttaagaaaatataaagaagtatatgaaattttctgtgtcagtaaacataagtataaaatgtaatgttttttgaaaactattaggttggtgcaaaagtaattgatgttttgccattaaatggcaaaaccgggaaaacccacatagtttagtcccaatttgaaatgcttatttataattgctc

SEQ ID NO: 93804 - DNA, 1024 bp, Homo sapiens
tacagtttttccccatttcaggtgggtaatttgttcccaaaaaacccctgtatttaaaagaaaaaaaaaaggatgccttaaggtgaattcttaaaagtcagaaattaattttcattgaaattaatggtacacaatttacttcagtagctaatcatataaactttgcattcatattcaatgtttatgtaattaaatacttaatatgcaaaaccacaaacagaacagtaagacaaaagaaaacaattcaagtaacaccccaaatttttactctatgaactggtgaaccaggagtacttgaggcaaaccagcagtaagttcgtgaatagtccaaccatgtggccacgaagatgactccttgttggttttccttgctagtctgggctacctcacaggcagaaaggcgcaaaccagtgaatgaaattcctcagaatgtcaaattctggtaacttcctgttggagttgggagtggagatatacatgggaaaataagtaatttaaagatttggttttatggaccctgaattactcagatgttttgtttttttttttgtttttttttttgagacggagtctcgctctgtcgcccaggctggagtgcagtggcgggatctcggctcactgcaagctccgcctcccgggttcacgccattctcctgcctcagcctcccaagtagctgggacgacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggccactcagatgttatttaagaaagttttttttttaaaactgtaacaggaagattacttgaggaacctttaatgctactttaatgcttcatgctgatttgtgtgtgtgtgtgtgtgtgtgtgtgtgtacagtagcacagtctcagctcactgcagcctccaccttctaggctcaagtgaacctc

SEQ ID NO: 93805 - DNA, 1133 bp, Homo sapiens
gtagctcaaaacctacgtttttacttgcctgctggacatttcatgtggatatctccatatcttgatttcttcctttgatttgttattgaattattcgtagatacatccgacttgtgttctcttactcttacctgaggctctttggatatgctagtcccttcatccttctttgcctggtccaacactactcatccttctagactcactcaacctgaactgtcaaatcatcagggctgagttggatattactcctttgttttctttttgcaccctgtcctagctctgtgaattttaagttcctatttacttgcctataactagattggatgctccttgagaacagggatgatatcttacccacattttattccccatacttatagtgcttgacatctggtaggcactcaatttgaataaataggtgaggggatatacaaactaaaactatcacttctctcctccacctgtcatttcagtttttcttctcgattaatggctttattgttacatttgactggtttaaaatgttggggtcatctctggcttctttgtattactgtgcacactcaggtagagcctgtatgttcatttccctttgacatgttcttctagtctattcctcctccgacttctctaattgagtctcctttgtcagactactgtgataacttcttaatggggttcactggcccccacctcaccttctgtttttcaaatctcaccagttataggacacttctgaacatgtcacactcagaattgttgatgtcttttgagttcaacctatgctaaagtgcactttttagcatagaattaacagcaattgatatttggcttcatcctgcttttctgactggattgtctaccataaccttttatctcctttttgctttagccagtccggactgctacttttcctgaatatggctggaatgtcccactgtatctgtttcaccgcatctatgagtctaagtcctatcttatctattgcacaaatatatcatgcctactatagaccaggtattgcccttgacactcaggctaaaaaggtaaatgacagggccgggcgcagtggctcacgcctgtaatccagcactttgggagagcaaggtgggcggatcacgaggtcagga

SEQ ID NO: 93806 - DNA, 1090 bp, Homo sapiens
gtttcccccgctcctccgattaacaggggctggtgcacatgctaccaatttcaggggggttttgttttgtttttgcagcgttcgagattcttggtgctgtcatttggcttgttaagaatttttagcctttgtatgtttaagtttgctacattgttacctgaagttacatacccccgatctgtgcttttaaatgttttagtataattaggaagtgttcttacgtttttaaagcttctaaagcagcagtgtgacaaccagactatttttgttttcttttcttcatttaccttttctgtaaagattgctttactcttctaatagtgtttctaaatcccagtttcttgctgctcaaagaatgtttcatgctaactgcttctactaagaatggagattatgttttaccttttatgctaaacattaaaaggtgtctgatatttctcaaaggccagtaacttttactttcccttttgccctgttctcctccggtccctcttgctgtcttacagtggaaactatttggtttttcaggagaatttgctcatatatttctggcttaaattacggacattttccccttcaagtgtctgactagtcacaaacatctatgtaattttttttaaaaaacagaagaaaagatgccatatatcttacatactttactccttagaaatcccttcaggctctcactccttacttttgctttacttgcaagtttgacttcttagcttgtaatggaaggggtgtaggaggtctctgtgatgctagaagctggtgtccggatagagtaaggggagacacggaaattgtttaaaaacgtgtaaaggaactcataaagcattgccaaataggggccattttgcttagaggcaaaagcagctcctttcccaggggaatcaccaaggtatcagctgaggatcctttgaagcagtggaaagaatattgtaggagttgacagacgttgtttaattctgccacactggtggcccttgctgaaatctgtccacaaaagcattttgtttggctggcatagtgttgttttatttttaaatgtaattagttgctaatatttgaaaatgggagatattacata

SEQ ID NO: 93807 - DNA, 1057 bp, Homo sapiens
tcttctaactgtaccatctttgcaaaggcagggatggaaacagagagggaggaagagggcgggggactcaaagtattagctaaaggtgagtaaagagtgggcatctagtgttcttctcagtcactattttctctggtgtgtttcctggagatacattttttggaggagaggaattgaaaggaggcattggaaagacagagggtgagggaaagacagagggtgaatatgttctggaggagagagtaccttaactgctgatggctgaaactgctgttccttctacctgttcggctctgaaggaatcagagccgaaaacaaaaaaaaaactttagagagaaggtagcatttgagctgagggcgcgcagggtggataagagttccagcgcgagcgtgtatctgggagctggggtggggctgtggtgggcggcattagagaaaaaaggcgacaggcattctgaatagcaggagacagagacagaagtgatgtgtttgtaggaggcaagagcagttcattttgagtgagagatacagctagaaagataagtagcggtccgattgtgcaaggccatggataccaggttaaggactttggaatttatcctgggacgccagtgtgagttcttgaacagaaaagtaagtagctgggtccgaagttcgcgtcagaaggatcactgtggctgcagcaaggcagagaaccaggtggccgcgtcctggccagcagggcaggcaaaggcgcggagcgttgcacttgcacctgcagggggcacactgaagggccaaacgcccacccccgcccccgtcctcgccgccctactccgatgcgccgcgctcggaactcggctagcccgcctggacgcgcccctctcggtcttcgcctattccgcccggacgcgcctcgtgcgtcacgtccgccgtggcgtgaggctccttagagctgaggagggaagcgaaaagaagcctctgcgcctgcgccagggcgcacccgtcggcggtaaaagctgaggggctggcgcgggggattggtgggcgacacttttacgtctacacgtgcctaccc

SEQ ID NO: 93808 - DNA, 1555 bp, Homo sapiens
tcgtggttttggaaagtaggccaactgataaccccacagcaaatagcaatttgtacatcctggcgggtcatgaaaacagttactgagaattgttgtgctttgacagttaactctagaaagaaagaacactaccactgcaacattaatggatgcttgaagctgtacaaaagctgcagtaacctgtcttcagttactttgtaatttattgtggcatgagataagatggggaaaattttgttttaagtggtatggatatatttagcatattgaaccacacaagtgcttaattcattgttatgtaatctttgtacatataggcagtattttttctgtgaaacttcatattgctgaagacatacactaagaatttatgtagataatgtacttttatgagatgtacaagtaagtgtcttatctgtacagatgtaaatgttgatgaaaatgcaattggggttaatattttaagaattctttagtatattcttgggtgtggctatattacaaaatgggatgctggcaatgaaacaatacatttaacactattgtatttttattatatgtaatttagtaatatgaatataaatcttgtaacttttaaaattgtaatggaggctgtaatcattttataatctttttaattttaatgcaagtacactggtgtttatatttgcacaaagtattgatatgtgatgtattaagtcacaaaagtaagctgtgacattgtctataagcatttggctccacaaatgtatttggattgttttctatgtgaagcaaaccaattataattaaccacatgttgtagtaactggtctttttatatttaagcagaatcctgtaagattgcttgtctttgcttaaaaacaatacctttgaacatttttgaatcacagaatagcggtaccatgatagaatactgcaattgtggtcagaattacagtatgcacaaagaattaattagcattattaaagagtcctcactaaacatttcatatgatcacactgaagaactgtaacattccatagagtgaagtggttcaaatttctcttggaatttttacttttgttggccttattttatgatccttttcatatttcttttgacttagagtattaatacatggccaaaataatttagttactacctcatacaaacaatataatggttactacacatcacaggaacttagttttggtttaagtcatttttgattgcttttttccaatggaatatgtatataccaggttttagcaaaatgcacacttttggctctttttggtatatgttctttatattttaatgtgagtatatacactaagaacaaactaaattgtgatttatgatcttcatttattttaatgataatggttttaaaatatgttcctgattgtacatattgtaaaataaacatgttttttaacatgctgttgtatagtagcttgtcatctggtttaatctgtatatagtaacactaaaatatattaagaggggaaagctttatttgttttgtagttaaattcttaagtattgaattttggtccctcaaatcatgat

SEQ ID NO: 93809 - DNA, 2009 bp, Homo sapiens
ttgagaactacatgtatttacaaatctcccactaatagaaaatttggtttttaaaagaagaaaagttgcattataggatattttaagtatgtttgttttctagtgcagtcggcattctgtatccatgtgttccgcattgccagtagtattgacaacagccaacatatgctctgttgagcacttacgttgtttagcacttgcatcagcatttaaacccactagcctggctcagtcactacatgtgtattacagaagacatatccgtttcaagtattgttatcctcagaattctttttcttcaatgtttccatgctttaagtatcacagtttctgtaggtttaccaaaatttgtttgtattgtagataccccacagacaaatgttactcatgtaacccaactggagagagataccatccttgtatgcttggactgtaagtttttatttatgaatgtcttactttaataagacttcttttatcttagtttctgagtgactttttttcctctaggttgtataaaaatagtaaatctccaaggaagattaaaatctagcaggaaattgtcatcagaactcacctttgatttccagattgaatcaataggtaagtcaaagttttataattctttgcattatgaactccttaaaataatttatctgctaattatccaaaattaaagattgatattattaagattctttttttaaaataaaggatatggctgggcatggtggctcatgcctgtaatcccagcactttgggaggccaaggtgggtggatcacttgaggccaggagttcaaaaccagcctggccaacatggtgaaaccccgtgtctactaaaaatacaaaaattatccaggtttgctggcacacgcctgtagtccgagctacttgggaagctgaggcatgagaatcacttgaacctgggaaggggaggttgcaatgagttgagatcgcaccattgcactccagcctgggtgaggaacgagactcttgtctcaaaaagtaaaataaaattagaggatataataaatatgaggtcactatcagccttcattcttacacattttctaaaatagtttaataactgtagtgtagataatgttatcttcctggtaagaagtaatatcatttcttttttttttttttttttgagatggagtgtctctgccacccaggctggagtgcaatggtgcagtctcagctcactgcaacctctgcctcccggattcaagtgattctcctgcctcagtctcccgagtagctgggattacaggcgcccgccaccacccccggctgatttttgtatttttagtagagacggggtttcactactttggccaggctggtctcgaactcttgacctcgtgatccacccgcctcggcctcccaaagtgctgggattacaggcgtgagccaccgcgcctggccttgaaataatatcatttcttataacatagttttgaattcccatttcctccagactcctgtagggtttttctataagtgctttaaaatttagtactcagtataccagattatgttttggctgttgtgtctgctgctcagagaattttaagtatatggaagttccttcttgtcattctcacattttgcttaataggagtatttttctggaaaaggatttctgacaatcaatacttttaaatgactacattcaggaaaaataaggtgaaaatcatcttatgtaggatagtgctgggaaaatgaatggtgattaatatttgactaggcacactttttctggtgttccttatcagtaaagatatttgcgtgtatgtgtattagcagacggtaaggctaaaggcagttagttcattgtcttattcctggttctgttttctacattctcccaactagaatgtcattcatccaacaaacaaatgattataataagtcagtttcgagggatatctgatcaagatgttaaaatggaatccgctttcaaagacatagccagggtcaaaaagcaagatcaacaacagaa

SEQ ID NO: 93810 - DNA, 1066 bp, Homo sapiens
gtagagatagggtttcaccatgttgcccatgctggtctggaactcctggcctcaagtgctgggattatagatatgagccaccccaccccagcgtcttttattcttaaaatcctcatgacgccgagcatggtggctcacgcctgtaatcccagcactttgtgaggccaaggcaggcagatcacctgaggtcaggagttcgagaccagcctggccaacatggtgaaaccctgtctctactaaaaaatataaaaattagctgggcatggtggcctgtgcctataatcccaactgcttcgaaggctgagacaggagagtcacttgaacccgggaggaggaggttacagtgagccgagattacgccattgcactccagcctgggcaacaaaagtgaaactccacctcaaaaaaaaaaccttctggagcatgttctaattaccagatactgaagacaggttaacaggactagtccatacccttgagaagctcatgatctaatagggaaaacaggtgtataaaccagtaactacagcactcaggattagatgtcatattaggaatgagtataagatattggccacagaggtggatgtcaccagcacctcctgtggggagatgagtagaggcatttgagatggaccttaaattatgatgaatagaagtttgtcacacagacaggataagcatgatggcatagagatgtgaaatagcatggcaagtttgggaacaatgactgggcatttgactggagtacagaatggtaacaatagatggagctgggtaggcaggcagaagccaaacaccagagcttggtgtactatgctgatggaacagacctgtgttttagaaatatctgtttgcagtacggtgagagatgagactagaaaccatggtcaaatggtaaaagagtgttaattcagggcaaaggtagagaacagaggggaaaagatatttttcaaaaacagttttatcgagatataattcacatatcatacagttcacccacttaaagggtacaattcagtggcttttagtacgttcacagcgttgtgcagccattacaccatca

SEQ ID NO: 93811 - DNA, 1044 bp, Homo sapiens
aatatgtttctttgtgctgttatcagtgtttgaggtgacacataacattaaaatttcactgtatagttaccatatcagtatagtgaagccatgtattctgagccaccctagtttcctccagaaatgtttctgctgctgctgcacagtagtctggtatctttttttattttttatttatagggaaaatgttttgctctgccacccaggctagagtacagtggcatgatcatggctcactataacctcaaacttctggccttatgcaatccccctgcctcagccacccgagtagctaggactggaggcacatgccaccattcctagctgtttttgttttttaattttttgtagagatgggagctgtctgtgttccccaggctggtctcgaagtcctgggctcaagcagttgtcgcctcagcctcccaaagtgctgagattacagacaggagccactggccagtagcttcatttttttcaaaacagccattatggaaggaatttagctaccaaggatccggggtttagtgaccactttagaggatctctgaccttaaaaggggccataatcacaacagttgtccttaggcaaccactaagaactgtctgtgtcctctcactgtatatctgattcttaatagctgtctatgtaagatacacatagaacatttatacgtgaacatttttatatacatacacatacactcattaaatatgctgagtacttttatgtcataggcaaggaaattggcactcagagaggttcattgtttatagccaattggtgctagaaagggtcagtttaaatccaatactgtctgaccacaaatcttatgccattaatctcccagtactaatcttaaattctgggcactttaggaatgctcttagcattctatactgttctcagcgtacttcagtttagcctagttagtctagaaaagttcttgacctgtattatcttaaaaacagatcgggcacttttcttcaagttgcctgcttggatctcttggaagtgttctttcctttctttcctgttctaaagtc

SEQ ID NO: 93812 - DNA, 1034 bp, Homo sapiens
gctgggcgtggtagcgcatgcctgtaatcccagctacttgggagactaaggcaggagaatcgcttgcttgaacctgggaggcggagtttgcactgagccaagatcacgccattgcactctagcctgggtgataagagcaaaactccttctcaaaaaaaaaaaagagcaactaaagtttcttggatgacataataataaatcaccccttttctaaaagtagttatgaattcagtatttggttttttaatgctaacaaatacatgcacttatacacaacctgaatttaaatttgcctaatatgccagaaatagaggtataaatagaagaacatatatataaatgacgtcttactttcatagtaaatattctgattgggtgatcccaaatgaataatgacactatgtcagagttaatattttttctttcctacttgataactttctgaataaaagttttcatgaagattaatcattttcaatgaatatatcttattgaaggaaatggaatgagctccttccagttaaatggtgaacgagatggctcattatgtcaacaacagaatgaacatagaggcacaaacctttcaagaaaagaaaagaaagatgtaccagtaggtattgatagtcataagttctacttgtatttgtttcctttttaactgttaagttagttttatgcttacaattagtgacactatagcactagtatattttacaattactatattgatattttagtatattaattataatggtgaatagattatttaaatcttgaaaaaagtaacttagctatggtaaacttgaatgatggctttttatcgtttacattatttagaccaatttgttatgtagtacgttataaaacatcttctttatacagataaatgcttagtattcttgtgattattcacaaaataactattattattctcattgaggataattgattcttgatagtttctcttacagtctcatgaagttacggaaagaaggacatagataaagaaagctgtagcttctaccccaggacaa

SEQ ID NO: 93813 - DNA, 1945 bp, Homo sapiens
tgagaagtctatcgagtctttatgctcgaagagtgtaatttaggaggtatgctgcatgaacttgcggtaaaaagaagtaagggaacttcaggaatgccatagttctctcttacattcctgaaaattaaagttttgtatactgctcctaatggtaaaatcctcgacctggtctgatacaggcttagtctcccaaaagtgtaaatgtgtttgcccgtgcaccactggagaacaaatccttcaggtaagtgagtgtcttccgtgaaagcaaagtgctactacattcatgtattcacatcacatgcatgcatgcttctgcagagagatccaacatggtgagtttcattttgtaggattgcctgagagcatgatgttattttgaagtgtgtcaccttccttattttaagaaaaagaaagtatatataatttcaggtgtcaggtataaaattccaggtaaaatttgaatcctggagactcctggctatgaccctgcaattattgttttgtcagtactgttgtgacattccatggtgagttgtcttctgtttgaattggtatttttcaataaatattaggatttattttgttcatttaaaatacatatataaagacattggcaacaggaaaatagaggtattttattaaatataacttgatgttttatggttgcagaggtgatcactagcaaattttcagtaaatggtaaaaaagtaatcattcaaaaaatgtatggttaaggttaaaatgataaaaacacattcgatattcctttgataatttattcacattattttttgtttttgttttttcttttaaggagtcttctcaagtctgttgaagaagaattgcatcagcggtaattttaatttttaatcttaaagtactttatgtcacagacaagtaaagtcagtttgccttcttctctgttatgtagcctatttgtttgcgttgtcttttttttctttaatagagatagggtctcgctctgttgcccaggctggattgcagtggtatgatcatagctcactgcagccttgaactcctgggctcaagcgatctttccacctcatcctccctagtaacggacatcacgatccaccgctcccagttccttgttttaattctgaatctatcctatcctataaagatgcagaaataaaattttatcttacagtagcttttcctgcattttctaaaatttcttcttactgttttggtaaaatccatttaataacaatgacattatcctttttatttagaggacacgtcgcacatttagaagatgatgaaggagatgatgatgaatctaaacagtaagttctgtctctgtttttggtaaaaagaaaaggtgtcatttgacctgatttcatcaatctggcagcttaatattgatggaaatttcaatatcagtaacacaatatcatgggttgtatctcagtttccttccttttttctattctagttacattaacttgggctgacataacaaaataccatagacttagacaacagaaatttatttctcacagttctggaggtgggaagttcaagatcaaggtaccaaccaacttggtgagggctgccttcttggcttgcagacagccgtcttctggccatgtcttcacgtggcctttcctcagtgtatgcacatggtgggatcaggggtaagagtgatctctctctctcgtaagatcaccaatccataggattaggatcccactgttacaacctcatttaagcttaattacttcctaaaaacccatctctaaatataatcacattgtgggttaatacttcaacatgtgaattttatagtgacacatttcagtccattttttccaaaggacaataattttttattgtagatttatcagtgattgatagctgctgtaattttactacaactacaaagaagcttattataaatttgattaaattttaatctgtt

SEQ ID NO: 93814 - DNA, 1594 bp, Homo sapiens
tttcgtagtgtatagttattttggctaggtaaaatgttaataatttgcccaaccttcattttttgatgaattggatccctgcttaaggaactgtattctatgtaacgaacccttggcaaggtaggttggccaaaagtttgctctttggctgtgtttcgtgtgtaggtatagacatacatgtgacatgagcatggatgtagcacttctcttgctgtattgatatgtctgctttattcttgtgattaggcagtgttttaaaaacgggatttcctgctttctccataggtgatcaggcagacagatttccattgacgggtttctacctattccagaccgtgcaggaactatctaattataattgttaacataggtcttttctttttctaacaggaagcatatgtactttgacttatacttgcttgtctccttttctttggaattctaatctcactaaggtcagcttttctgataatttatttaaaaccaacaaaatactatttttaaaagaaaacactaggccgggcatggtgactcacgcctgtaatcccagcacttttggaggccgaggcgagtagatcacctgaggtcaggagatcgagaccagcctggccaacatggtgaaaccccgtctctattaaaaatacaaaaattagctggacatggtggcacacgcctgaggtcccagctactcgggaggctgaggcaggggaatcgcttgaacccaggaggcggtggttgcagtgagccgagatcgtgccattgcactccagcctgggcgacaagagtgaaactctgtctcaaaaaaaaaaaagaaaagaaaacattaaattatttatgttttgttttaatttagggcaaaaatgttgaaggtaaattctcttctaataagtaatagttaaaagagtacattgaattacacaattcctggcacagttgagtatagtagtagtaaatgccagatggcttttcctataagctacatgactttgagaaatttacctctattattgctagtaaaatggataatataatagtacctgcctcatagggtgctaaggatgaaatggaataattgctataaagcatttagcacatttaggacttagtaaatacttattagttgcctttatttatggtagttattcagtaaataattgttgattgtatgaacaagtagtaatgtgagtgaataaaactgctgtttaattttagagaaatagggtttttgtttgtttgcttgttggtttgaaatgtaatcagagcagtacttacagattgggggcagttagacaatttttaaagatgttaataaccgcagcactgattctttagctaatgcaaatatgctgagtattttggtggtcattttagacctctgccatatctgtttgtacattgtttcatttttaaccttttcgtcaacatttcttactcattttagattgtcttagaattcagcatctgaaagcattgtttttgttttgttttgttatttactttataaaacttccataagagaagaattcaagtggactagtgaatagtgacattgtttattgtgtaacattcaatcttggtgaataaatcagtatca

SEQ ID NO: 93815 - DNA, 1061 bp, Homo sapiens
tttacttttaaaatagcacccaatttcatatctttaaaaaattgttacctgcgtgaaacagcagtagaaatatgtgaaagtgtttatatacgtaattattttagatactatatacaaagtaaaccaagatttttgtcacatattcacttctctgaacgtttttgcttcattataactggagaataaacaccttatttgagcttttttctttctaaaaactgatttttacaaaagttaattaaagtaacagtaaccaaaaatgaaactttgcatatattattcagaaaaattccaagaaaaacactcaaataataaaatacttaaatcaggactatgaactcgtgaaatccttctttttaagaatgtatagcaatacagatttatttgggggtctgggacttatcttttaaaaataatatgtattatatatattaatgtatcatggtgtgtcatatactactattgtgctaaatattttattttgtactattaggatctgcaactggaatatggacaaggacaccaaggtggttactttttaggtgcaaacaagtaagtaaagttcttttaaaacttaatttaaattcaagaattattaagttgcctttaatattatattttaatatttaaggtagaaaattgtattaggctggtagatatattttacaatatgcatttcacctttttccattgcttccttgctcattatttagttaatagttgtcctaatgggaagcatcaacataatttttttatatcaagctacattgctgatcttgtatgttagagaaaaccacatgtattgccactgaaggcagatacatgttttagcactttatttctaaaactgatctgtttatttcttataaaacttgctttggtacatctctaagatgggttggtcactaaaaacagctggaattattcatacaacttagaaatcttaactttttagctataaggtttttttaaagtaagatagcagttaaaatgtgtgtctgaattcttaaaagttaccaatctatgcagtaaataaattcaacagttatttaatgcctctt

SEQ ID NO: 93816 - DNA, 1289 bp, Homo sapiens
ctatttgagatgttaatattctatagaacaataaaaaaatgagacattggaaaatacaaaattctaaagaaattattttgccagagttccatatgatgtctgtttcatttttttatttgctatttaataatgagaagaaaataactgttaataagtactaaggattgaagtaggagctttcttcttcagtttaatgcttattttaactcacttgactgaagcatacaaagggtgtcattagcctttaccttatagttactctaattcagtgtaccagtgtggaggaataggatgttaaagaaaaagtcttaaaatgatcatattgtaataccaaagcctgacatttatgaagaggggtggagaaaattaagaaaaagtagtcatgatatttataaatgctaattgtgttttgttaaggcagtttgagtttattttttgtttccctttgtaagttggcattgcctgtatttaaattctgtactaatttagtaactgcattttagagcaaagttgttgcaatgttgcttttttagaagctgcctaatacagtttgactctccatttgccttaataaaattatattagcaggacttacttcatttgtgaaagtttccctttgtgaatttgtggcttttagtctaagcgtaaataacttgggtttcttggtctctgctaaacagcccgacagtgatggttttttggacagttcagaagaaatatactacactgcaagatctaatctggtatttctcatcttctgattttctttgtcagcattgttttagtcttaattgttttcttttaagatcaaacattttgtccaattaaagcattgttttataagttgctatcatttagcaaacttctatatattaagaattgtagcagttttttcccataacaagttacatatatatatctactcaaatataatgctgtagtaataaacatgcttgtattttttatgaaaaatgttaatatttaattttctcattcatatattagggttttttttttaagaaatggcatttccctgtaaaaatgtccagtttaatgatgtaacttgttttaatgaactagaaaccacccatccacatgtatatatataaacaattcatatgttatatggtacatatattcatatgcattacatatataatattcatatatcatggtacatatattattcagataatatatggtacatatataatttttaaagataatttattcctacattaacaatgaaatcattctcagatgaagttttaatttttcagcattactat

SEQ ID NO: 93817 - DNA, 1022 bp, Homo sapiens
ccaccgcacctggcctgaagaagttttttggtgttgatttgcttaattttatttttaagaaagttaagttttacaaactcttctagtcttatttagtatacaggcagtccttgatgtgcatggtagtatgggactgtaaaaatgactgcataagctaaaattctgcaaagtaatcttaataatcaggaaaaattataattgtttcatgacttttaaaattttttgttaaagcataaactctgttactgtcagttgtaattgtagaaatgtgaaaaaatagtaaaactattatttacagtgtattataaatattagaatcatcgagagttaatgtgtttcatttctttgttaatgaacttttcatgcactttttttacttatctagtagtctgcttattgagtagtttgccttttcatcatgtgtctgtgacacagagcaagtatcttttctatgccttggcaaattgtcatattgctttctaattttctttctaatcatgatcatgatgtgcatctgttatttacgtagtaatttgtgaactgaaaggctaccaataaagtttatactttatgcaatttcaattaatatacagtggtaactgttatttgaaccatgatgtagggaactagtgttatttaactaaattatggtaactgaaattggtgcataacaaagctgtaaaacaaggactgcctatatccttttcagtgcactaaatgctacatgattgtttcttacctcaccctatgtacttgtcatgtctttttaaaaatgtactcaaagaacagaaataataaaccaaatagagaagcaatctgtggaatgaagattcttctaaaactttctcatatagcagggaaagaaactcatctttcttatccagacattgttttggtattataattataaattgttacaaatctctatggtaagtaggtaaaataaaggaatttaattattccaggggtaggatgaggggaagctgttacattccctctcacagtagcttagaataatgttt

SEQ ID NO: 93818 - DNA, 1731 bp, Homo sapiens
taatgatttgttgatttttcagagcattatttctaatgacaaaaagcaattttcagcctcctaaactaaaggataaaatgaaatggtaagtatttttatgttatttacttttatggtgagatgagcaaaaaatgaattggaatgtaaaagtctaattttctaaatttcttaggtcaaatagttttcatcactttgtgaaaatggcacttaccaaaaatccgaaaaaaagacctactgctgaaaaattattacaggtattatttttgccctgaaatatatatatatatttcaaaagataaaatgttattcaatcagatttatagtaagtgttctgcattgtatttaatttttatagcatccttttgtaacacaacatttgacacggtctttggcaatcgagctgttggataaagtaaataatccagatcattccacttaccatgatttcgatgatgatgatcctgaggtaggaattgcttttaccagcgggcatatataacatgtatatgtgtatgtatatatgtgtgtctgtatgtacgtctcaaaatccatttttttaattttggggcctagtttaaataaaaaagctcttgagggaacaattaattctttgtctttgcctttcatggaaagtcaaatgctaggtttttcttactgactacttataggtgactatagtgtgaaaatggcaaaggcatatcatttaatccacttgttgaaatcactgtagttatttcaaaatagccatttttggtgaagttgccaaataatcattcactgtaaaagggaaagcaaatgggaagtgcctaaacaagacatttgaatattcaaaatttcccctcagtttgcttctcaaaaagaatcctcagtttggcctggtggctcatgtctgtaatcccatcactttgggaggctgaagcaagaggattacttgaggccaggagtttgaaacctgcctggtcaacatagcaagaccccgtttctatctttaaaaaaaaattcttatataatacttcataaattattagaggttagtaggaagtataggcttgactttgccagtgactaaaactcagctattcactatggaaatgttttaaaatgagccagtatagttgttaataaaataattctaatatgacagaagcattgatattaatggaagcttcacttctgtttgcatatgtaacattcctagcactgctaatagttgtggcaaccaagataaattcagtatatgtgacatggcagaattctgttattgggtctgtaacagaagtggataggctttaactctactggctttatgggaggcccttaaaaatattgtaaatttcattaatgactgaaggtgaagtgtttagaaagacggccacagattgtcttaagtcagagagaacctttctatcaattcagcattgtcccagcttgccatcttatgatagataagctatttgtccttttgtttaagggtctggaaaagagtttggagcttaaaaatgtaaggaatgtaaagtataattaatcttataattatactctgaagaagttttttttgttttgtttttgtttttttttgagatgagtcttactctattacccaggctggagtgcaatggcatgctctcagctcactgcagcctctgcctcctgggttcaaacgattctcctgcctcagcctcctgagtagctgggattacaggagcccaccaccatgcccagctaattttt

SEQ ID NO: 93819 - DNA, 1100 bp, Homo sapiens
aaggagggaggagagaaaggccataatgtacaagtgatgtgattataagctataacttaggaaagttagtctgagctgaagaaaggccaaactgaagcctctgacagaagtcttagatagctaggtactagatcaagttaaaatccctgctcctagtctctttcctttttctccttcccctactattccacagagctacagtagtatcagtgggtgggtgcagctcagcttcactggtgacatttggagtttaggagcctttttttttctccccaaccccctgtctcctgtgccagtcttttactgttttttcctcatgttggttgagagtaggagggttcccagtattttttccaccaaacccatacttacatgattgatggcaccttggaccaaagagcccacaatacctttgggatatagtattgctatctcttccaaaagctttgagcttattgaagatgaagtcatcattatctactttgagcttagatcaagaagcaaaagtggctaaaatgcaaccagatcatgcagaggggtgacattttaattttgtgggcctgtggctagttgtttatgtactggatgggcctaagcacttggtaaggcacattaggatagacaacctcatgtactaagcagcaaggtacagtctcacataccaaccctggttcaattgatggtgagttcctagaaagggaggttcttttaaaaacacacacacacacacacacacacacacacacacacacaaaaatgggaaacaataatcaagtttaaagtgtaatgtaaacagttgaaaatgcattgtacggttacattatagtgtggtgatagtgtttgatcaatgaggaaataacattttgatgaaaactaatatatcacttttatattaacattcatactatgttagtagcagcttttttgcaaggcagaacattttataaagatagtcaagttgcctaaaaagtggacagtagatttacctatgactctaatgatacgacattttaattaagcacactttaagtatttctaggtctaaggctgtgattattttaaatatgtatatttattatatatgtgctgtctgataaaat

SEQ ID NO: 93820 - DNA, 1267 bp, Homo sapiens
tattaattgtcttcttttacagtaactggacctctgtcagaactgcaaattgcatatgttagcagagaaacactgcaggtaaatcaagtgctaattcaaaaataacatttttcattaaactaaggctttacttactgtgcattacctgttcagcaaagtaagaactaaatattttagtttggtaaactcttaaaatgagttttaatacatttgaaaattgtgtaatgaactcaaattatatttacaaataaatactttaaagcataaatgtgatgatataacctaaaatttaagcactatgcatctgttattgtatattttcctcttaataccaaagaaaggcttgaaaattaagcactatcatgggaattcaaacactctgatactaattaggtatatactttttaaaagttatttcaaactatttgtagaattcactgaaaattttcttagaaaaattagtcattttcttgatctttttttaggatatctcattaaaatatgttaatgattagtactagatctcctgtaaagattaaataaaatacacagaatactacccatttgattacataaaatccaaaagagtgctctttgataaaatcttgtttatttttctgttttttgaaactccagggattatattatcttcacagtaaaggaaaaatgcacagagatataaaggtatacattatatttttaacataataaccctctcttcatttttaaatactctgatcaaattgttttgagcaaaattgttttatttgataaatgcatctgaaatgttaccataataaaaatgagtgatacttttaatagtttaattttttatagcagctttattgaggcacaattcacataccataaaattcacccttttaaagtatatcattcagtagattaatgttttaataactcattttagcttctttgtagttattgattagtaaaatgcagagtaagcttatagctttcatcaagttatagtttttagtaagttttatgctttgactatttcagtgagctttcgcagtcttaagtctaagtcttagtaatgcatcaaaatggataaattgacctttgacactttctcatagtcttttttttttttttttttttttttttttttgagatggagtctcgctctgttgcccaggctagagtgcagtggcacgatgtcggctcactgcaacctcccctcccgggttcaagtgattcccctgcctcagcctcccgagtagctgggattacagccacctgccac

SEQ ID NO: 93821 - DNA, 1047 bp, Homo sapiens
gtagcaaaatgccaaggccagaaatgtcagggcttaccacaatgaccttatacttatgatttgagcagtaattggggaagccttctgttttttactttgctactaatttacatttaatcaggctattcatagtatataatactttaaaagctgaattagtaatacaaagctacttttctttcagagtaagcacttccatttgttctctttctgcatagtctctggttcaccacatttgcattcactgcagttctgtttctctccatgacaagtgttcattcaggagccacagcatgtgacactgctataggattgccagatcttattttagagaatttggacaaggaggcagtaggagagagattatttgctaatagtctgaccaggctaaaatacagtcccattctgcattataacacagttggaacaaggcactcaaatacaggataagcctgtgaatgtgggccatctggtaatccagtactgcttgagtgtaggcctctcagctctacaaacagcctgtggagataaatttgacacacttggtgtataagggttcctgccctaacttagaaaagaattacttctttgtgctaaaattatattaaatgttacttggaaataaaggaaaaagtaatttacatttcctattgatggattataccgatgattatgtccaaggcataataataatagcaaatacttgtataaagcatactccatgccaggcactgttctaagcattttacatgtattggttcatttaacccttacaacattcctatgagataggctattattattttactgaggatggaattggcacagagaagtcaaataatttacccaaactcacaccgcttagtgtggaacagagttaggattttaatccagaaagtctgggaccagagttcatgcttttaagcactatgctatattttctctcaagtcaggactgaaattgtcattaaaagtaataccattaacttattggctatgttttatttataactcattaattatgttatacttattaatacgtataat

SEQ ID NO: 93822 - DNA, 1054 bp, Homo sapiens
tcagatttttgaattagggaaattcaacgtgtattggcaagagttaaacattccactctttcctggagaacctaagtcactttgacatagagaagcagtcttgatttacatcccagatggcagagcttcaggtaagagacagtgttcacatccatcgtaactttgttgcttataaggacaaagaaccttgggttcattttataatccaatcctgaagtctgcccctttacatacagctctcctttgctctaagcctatcaaaacaccacttcatttaaatttcacctcacttccattttattcaaaatattacaaaaactcttatcttttcttttggtgagatgccctaagatttctctggcgtgtagttttcctcattgcaatgggtcagtaaacctgaatttgtcagatgacgggtttgttcctgtggtctgtggctgatccggctagaacactgccaattcttgagacttatttgggaaaaaaaaattaaaaatggatcaagatgagagctatggcagagcttgctagtagaatagaatttatatatatattctttggggctttattttcaagttctgataaggtgttattatataaataagttatagatctggaatctttttgtgatttaaagtcagaatttaaaagttacttatactcatttgtggtattgtttgcagcactagttattataatatgatacaaatgcagatagataacagtgattcattaggtagcaactcataggaaaaactcttctaaatggggaaactcattccttttccaacacaatgaaaactactgaggttgataaacagagaaacttgtagtgagaaaatagggtattatgctttgtttccgtgagagcaacatgcgttaaattgtaaagctaaattttaaaagtgcaaaaaagtaccaataagaccttattccactattttttcatggacctccaaagttaaatgttatggaatattctctcctgccagcctttgacattagttttttctttcctgagaggtagtagaggtgctttctgcctccttatctt

SEQ ID NO: 93823 - DNA, 1165 bp, Homo sapiens
aaacttagaaatcttagaaaaaaaaatcataggaaaaaagtatttgtgaccttgggttaggcaaatggtttcttagctgcaacactaaaaacacaagaaacaaaaattagttaagttggacatcatcaaaatgaaaaggttttgtgtttcaaaggatacccataagaaaatgaaagcatgtagaatgggagaaaatacttgcaaatcatgtgactgataagggatttatatccagaatatatgtgaagaactcttacaattaacaatttaaaaagaatttaaaatggacaaagaattgaatagacagttctccaaagaagatattcaaatggaaaattgaaaacaggtccacacaaaaatgtgtacactgatgtttatagcaccattattcataacagctaaaaagtagaaacagcccaaatatggtatttccatacaatggaatactatttggcagtaacacataaatgagtttgagacatggatgagtctgaaagcattacaccaagtgcaagaaaccagagtcacaaaggaccatgtgttatttgatcccatttacatgaaatatttataatagtcaaatccatagagatggaaagtagattagtggttgccagggattgagagtcagaggaatatggagtgactgcgaatgggtctggggtttctttttgaggtgatgaaagtgttctaaaattagttagtatagttacataactctgaatatactaaacacaactgaatcatacaccatgaaagggtgtacttcatggtatgtggattctatcccaataaagctgttataaaaagtgctgtatttagtgaaagctttaaatactctgacagggaatttggatttttgtctttaaagcaatgatgtgttgtacccttgcagagttataagtcaagaacagcatgatgagaacatcattgtgggagcatttgaagaatggtggtcagatcagtgttgcagcagactagatctagctgcttagaatattttatcctgttttctgcccttcacaagtatgaacattttatgttacatattctgaattcaaaatttttaactttatacgtgctaatattttataatttctatcttgctctcctttttaaaaaataaactgctcaaggtgattgaaaaaaagaatagcagttgcag

SEQ ID NO: 93824 - DNA, 1076 bp, Homo sapiens
tttatatctagtctaacttatttccaaaagtgaaatcttggaaggtgtttacgcacattggggtctgagcacctttgggctagaaatgctgctgctattgcttctatagtgcaaagttggaattggttacctgatctcttatgctttcccaaactcagtgctactgttaagttttatccatattattagtgtggtctgccagttaccatttagaagtgttattgatatggaacaggtccatttttgaattccaaaattcagaattaaactttgaaatacaaattactgatatgttggaactgtctgtactcttttatcactcacagattattttccatgtctatatccaattattatctgctaagtgcattttttgaaagttaatgatagcctcaatctgtttttaaaatttttttttattaggaccaggtagtcctagaaatgtagatctttaattatctggttttaagaaacaaagagccattcaagttaacttaagaaaagagaggctattgtaaagatacatgatacacggaactggaagcttgtcaggaactcaaggcagcttggagatctgctcttttcttatggtcttgtaattttttctgtccatctgttgggttatttgctctttattgattgtctcttcattgcgtcttttctatttcttcaaaacttcactttatgcccaaagtcctgcatgctgtgacactggcacatagcatggtttcacagtgagttacattgcatggtggtgctatttctcagtatttccagtttcaaacattttagagttgtgctgtctaatgcagttatcactagccacgtgtgacttttaaaatcaaaattgaaattacgtataggatctgtatgctgataactgcaaagcactgatgaaagatatcaatatctaaataaacagagacacctgccagtagtgttcatggattggaagactccacatagtaaatatgtcagttctttccaaattgatctatagatttaatgtacttccaaataaaagtcccaacagcagatttttttttttaaacagacaagctggctcaaatttatat

SEQ ID NO: 93825 - DNA, 1101 bp, Homo sapiens
aagggtatagctgctttctgctactgtattttggccatatacctttcttttggaagctgaaaattactgtattactcattagttaaagaggaaattacagtgaaaattatacaatatctattttgatgaaaaacaattaaagctatagatataaataaagcaggacttccagtcataatttataataataaattcacttattaaaaaataaaaaataaaatgattagatatgaacaccaaggaattaaaaaaagagcagagtaaactcataggcactggaaatgtaaataataaggaggaacaggaactaaatgaaggggaagaaagagaggggggaacaataaaacctaagctcaacatttgacaagatatgtaaaaaagaaaaacctggtaagaacacccaagaaataaaagagaaggcataaatattatttgttaattattgttgcaaatataaagagcatacctactaatttagcagtactttaaaatattatgagcaacttatgctaataaatgtgaaagcttcgatgcaaggatggtagagtcaagactggagactgtagtattccagagaagagattatggtggcctgaactctagggcactagtaatagaaacagagaagttaaaaacatacaacagacatttataattctgtgaatggagggatggggagggttaaggtgttgggttatagcgttctcccttgggcagttgcgagatgttgggtggtatcactacacctaaagtatagcagggtttttggggggattaatttgaggtacatggatgtcggtagcattgtctagttggttatatgggtctgagctttgagcttactgaagtctggggaaattgtcttataaacttaccaacttgtttttctttttgtgagcatgcctttaaatgtttccagaaatataaaatatcctctttttaaaccacattaaaccctcccccatataaatattatgtacctggctagatcttagttagatatgagaacaaagatcctacttacagcagtctcttgtaataaacactaaaatgtatgcttgtaacaggagcccttaactttttggcatagtttctgtgtaa

SEQ ID NO: 93826 - DNA, 1069 bp, Homo sapiens
ttttgttcttttaaacagtttctcaaaggtgtatttaatgctaatgtagattatatggtgaagatatgtttctttgaaaagatgacatacaaaaacaattctaggatatcagtagcaaaaactatgacatatgtgcctttgatgtcattgtaccgtatatccttttgtatagctaaaatggctattctgtgcattttggtttaattgctatagtgaaaattacatttttgaagagctagaaaagcttttcaaaacttggaaatgttgttatccttcatattatgaaaagtactagttttagtcttccaccatgcaaagacctttttaaaaatgatcttttaaatattattttcatgataaataatttaccatttgtctgtggaagagaaatactgctttctgcacacacttgtgtatgtgttccaaaatcatgtaataagatttttggctgttagagtgacatgtgactgtaatggttttcagtagagtttgttattataatgtattagcaaagaaccaacatttataaagatagaaagctttacaagaaatgctaagatcttcataatattaccagttgctttgttatgattttattgctctaattttctaggattgtaaaattatgtctaattattgacatgggtacaggatgttgcgtgaatacagggaactccaaattcttgattgtggctatttgtggtatgtcctgccaatctataaagggttcagctgcctcttatgtgtagatgatgcagtggcctgttgctgaactagaaatcagctgttgctttaaatgacagattagcagctccctcctccacaatcccaaactaccatacccagacctaggtgtaagtagaaactaaaaagagattaaccaaagttacttcttcgctgtagtcagaaaaacgtaaaggatattgaaaaagcaaatgttgggcataatcatatgtagcattttatgtttcagtttgtggtaagaagtttttcaaagtaccttaacaatggaaatacctttctgctattttcattccatcattggaattagcacttagaaactatccct

SEQ ID NO: 93827 - DNA, 1975 bp, Homo sapiens
aggggacagtggttagaaaagagtaaatttctttaaatagtcaaacttgcagaaatggaactgtatactcactaaaggaaaataatgcttgctttcttctggttgaagagattgtgtctgtgaggaaaatagttcatgcttttaaaaatcttctggaataaaacatggccagcttttttttctgccctccttaaaccaatccatgatgattgccagattattttttccttctggtagaagcatgtggttctcaccctcttcacatatgtctcttgcacagaggggaaaggagtgggtcagaattgcagttagcaaaggcgttttattggctgccgatcaagtcaagaaccaaattagttgaaggaatttctttattaacatgccagaaacatcttatctatttggttttaccagagcctgtttagcatttggtttcattggtaagctcatgtagaaggcttagttattctgaagttttgttttcaaacaggacagccctcccaactccaccctcccagcatctgactgaaaatttttgacagtttaattgagatataattcatataccatacaatttaccatataattgaatgagttacccagttagtatgacttaaatttgagtcctaaaatcagaaacaagatagtgatagagggaatttattcttccaaatgttatttttatatatatatatatatatatatatttttttttttttttttttttttttttttgagacagagccttgctctctcgcccagactggagtgcaatggtgcgatctcgactcactgcaacctccacctcctaggttcaaacaattctccttcctcagcctcccaagtagctgggattacaggctcccaccaccatgcctggctaatattttgtatttttggtagagatggggtttcaccacgttggccaggctggtctcgaactcctgacctcaggtgatccacccacctcggccttccaaagtgctgtgattataggcgtgagccaccgtgcctggcctataattatttttatattaagtaccattaatgaacaccaaaagtgactattaatgcctgacattaatttataaggattggagagacataaataccacaggaacttgataaagtggcacagtgtgattgatcctcattgaagtaatacgtacggttatcttttcaccataatttcactttcctttcttttaattgactgtctcctttttcccactcaaatttaagggcatttaattccgtaagtctgtttctaagtaataattaaattgaaactagattgtacttacttacttgtgcaccaataagtgcaaaaggattttgcactgagaattcccattattttagtgcagaacttgtcaaattttcctttgttgcttaaacaaagtcatatcagtaagcataaaacatctgaaggaaattttaatacttctgatgcttgttcagttgtagtacatacttttaaaatgaagcccattcatttggaactgtttttgagagctataacatttaaataacatctaggagaagtttggacttttacaagtgtaggctgtcattttgcagaaaagaaaatctggttgtgaaccaaacccaacttagggatttggctcatggaattgcttataacctcttgaacttttcagttctctaaaaaattgttggtgataatatttaagattctctatgaagttggtggtttaattttggataaatgaattcccattttttacataatacttggctttcatacaaggttcaaagtattagattggtacatactcttttttttttttgagttggagtctcactgtgttgcccaggctggagtgcagtggcgtcatctcagctcactgcaacctctgactcccaggttcaagtgattctcctgccccagcaccccccgagtagctgggactacatgcatgtgccaccacgcccagctaattttttgtatttt

SEQ ID NO: 93828 - DNA, 1884 bp, Homo sapiens
ggcagcagagcgagactccgtctcaaaaaaaaaaattgatgaaccaatactgatacattattattatgttaattaaagttcatagtttacatacattaggcatcactctgtgttgcacattttctgtgcttttgacaaatgtttccatcagtatagtatcatacagaatagtttcactgccttaaaaattccattttctatctattcatcttccattctcctctgcccaactccaggcagccactgatctttttactgtctctatagttttgtcttttccagaatgtcatataattggaatcatacaatatgtagccttttcagactgtcttctttcccttagcaatatgcatttaagtttcttccataactttttgtggctcaatacctcattttttaaaaattactgaataatatctcattgtatgtttataccacagtttattcattcacctattgaagaacatcttggttgtttgcaggttttggcaattatgaataaagcagctataaatatccatgtgtaggtttttatatggacataaattttcagctcatttgggcaaataccaaagagtgtgattgctggattgtgtggtaagactgcttttagctctataagaaactgccaaaatgcctcccaaagtgactgtagcactttgcatttctaacagcaatgaatgagagttcctgttgctccacatccccaccagcatttggtggtgtagtgttttgaattttggctattctaataggtgtgtagtgctaccgcattgttttaatttgctgtccctaatggtatatgatgttggtcatcttttcctatgcatatttgctatctgtatatattttttggtaaggtgtctgttaagattttttccctttttaaaataggatttttttttattgttgaatttaaagagttctttgtatattttggatacatgtcctctatcagatatatgttatgcagtattttttcccagtgtgtggcttgtcttttcattctcttaacaatgtcttttgcagagcagaagtttttaattttaatgatgtccagcttatcagttttttctttcatgagtcatgcctttggtgttgtatctaaaaactcaatgctagaccatggtcacttagattttcttgtatgttatcttctagaagttttatgttttgcattttacatttatgtctgtgatccattttgaggtaatttttgtaaaagatgtgaggtccatgtctagatttttatattttattttattttgttttgcacgtcaatgtacagttgttccagtactatttgttgaaaagaccgtccttttcccattggatcacctttgcttctttgtgaaagattagttgaatatatttgtgtgggtctgtttctggactcttgtgttaatttgctatagcttctattagaaagtaccacagactaggtggcttatacagtggaaatttattttctcagttctggaggctagaagtctgagatcaaggtctcaatagatttggttcttctgaggcctcactctttggcttatagttggctgttttctcctggtgtctatacatggtctttcctctgtttccaaacatgaggagtttgggattgtaatttggagtcagatatatagcagagaactaggggagataaggactgggagaagactattgagtctagttaggagggtataattgctgttcagaaagagtagttggtaaagcatcctaattagaaatgattgagaaggcaggaggaaatggtgacattgtctgtggtctcttttcaaggagtttgatcatgctgctttcttctagtaccatagcatttctatcttagtgtttttctcaggagtatttattgagcacccatgctga

SEQ ID NO: 93829 - DNA, 1030 bp, Homo sapiens
ttgtagatggccttcttacagagagagagggcatactttctggtgtctcttctcataagggcacttatcccatcctgaggccttccctacctcaggaactcatctaaacccagttatctccaaaaagccccatctccagatgctgccacattgagggttaggtcttcaacatgtggattttagagggacacagttcagtccgtagcagattgcattgctttttacattttattaattatattcctagatatgtgttattctttttcaagtctttgtattcttgttgcatacttaattgttcttagtgctttcggattagtctataatttcaaattttgggggatttcatcttgcagtttgttgctttgttttatgctgactcatgcctgtgaatttctatgttaattttgaattcatctactttttttctgtaagaatctttgtggtttaaattgacagctgagtggaggggctgggggggtggtggggagtgggtgggagactgtggctgtccttccaaaacagttttgcttttgtttcttccagtaacctcatgagtctttttggtcttggatttttattttaatttctcagtttgggattccccacatcttatagataatacaaacttgaaccccaaatcaaaagagcaatgactcttggatttgaattcttggaggactgtttttcttctacccaaacacagactttgttgttatcctcttgtgcttgtaggtaacttttttttttttttttttttttttgagtcaggttataactctgtcacccaggctggtgtgcactggcacaatcaaggctcactgcagcctcaacctcctgggctcaagtgattctctcacctcagcttcccaaggtagctgggactacaggtgtccaccaccttgcccacctaatatttgtattttttgtatagacaaggtctcactatgttgccttggctggtatcaaactcctgggctcaggcaatcctcccacctcaacctcctaaagtgctgggattacaggcttg

SEQ ID NO: 93830 - DNA, 1640 bp, Homo sapiens
tgatctcagctcactgcaacctctgccttccgggttcaagcacttctcctgcctcagcctcccgagtagctgggattacaggcacccgtcaccacgcccagctaattttttgtattattttagtagagatggagtttcgccatgttggccaggctggtctcgaactcctgacctcaggtgatcacctgcctcagcctcccaaagtgctgggattacaggcgtgagccactgtgccggccccaaagattataacaaataccttataaaacttggtttacttttatatatgagatgtgtgtgtttctgtgtattttgcaaaactcacagcttttgagcttattaaaggaaaatacacttaaagtttacttcatccttaagtgaaaaataacactgctaggttgtttaggagatcctaaagaaaattcttaccctgaggaacttaaaccctgatataaggaaacaaaatctgcatgtatggaacatctaaggaacatgcctaaggcactattttaacaattagaagaaaacaataaaactatataaatactgtaggaattttaatttaagggaaaaataagttgacttcctgaaagagtgaatcttgacctgggacttgaagaaaaattgtatttgcgattgtggagaactgtgaagtcataccaaaagagtaaatatgggttaaaaatactgctgtagaacctaagtgggcaaagaagtaataagacaactattctaaggagacatattgggaaatgtggtagataatgtttcacatatataagatacagataaatgaatgccagttgaagaatttagaactcacttgacctacaatgtagtatttttcaaattcattagggccactcttttctctaacgtgcttgggtagctatttagatggtattcaataagttttatttcttccctttcatctctattgatttagaagttaaaagattttacttttatgcttttggtggttaccgttaaatttgcaacttgtgtaattagtctgaagttaactgatctttctctgttctctttctggtcagtatgtggattttagaaggcttaatttcattcactaccttactgttttgtgttgtctcttactttggttctactgttcttaaatgtcccagtttagtttttattattgttttatacagacagtgcttctttacatttacgtgtaggagttttcaatttctttgctcactgtttcttcttggccttatattccttcattctgggttcagatttctttaatcttgaagctgtatttggtaggattttttttctttcttttaacttttctttttaagtgaggaactgtataaggtaaactcagtcttcctcctccccctcctcattgtctttattttgtctttacttttaaatcatagtttagtggggtatagaactctaaattaacggttgtttttttctcagcactttgaagatcttttgttgtcttctggttacctgttgtgctgtggagaagtctgttgtcaatataattattgttgcttttagctaatcttactttttctttcctccctgtttgacttttaagatttttttctttgattctggtgtgtacagtttcacagtgttatgtgtggattttaataaaaata

SEQ ID NO: 93831 - DNA, 2173 bp, Homo sapiens
tatttattggtgaaacgtatctaatgcatcattttgtattaagaatgaatagtaagttctctcatgagagtacattgaacagccatcatacattgaacagctgtaatatgagaggaaatgtgttatgaactgtgagtagagtagcagaaatgacaaggcttggtacttggtatttacaggaacataaaatgtgtacctgctattagctgtcatagtttgagatcagaaccttttggtttcctcatttatatcatattaaatctcttgctggctgagagactctctagatactccataattgcacaaccgacctctgtagcacagcatagtgatttgagaacagggttctggagccaggctgcctagtttcaccacccactagctttgtccttaggccaattacttaatccctctctgtgtgtctcagtttcctcagctgtaaaatggagatgcttagaaaagtgcttgggacagtacctgacacaaaaaagtgtggtcattgttaattgctgttagtgtctagaagtatttattattatgtatttctcctcctactgtccttctaaccaactgcattcctcatgctttgcctcagggtttttagcttgctgtctctgcctaaaatccacccctccccaccaatatctgtttggcttgcttcttcgtttaaagtctcagctcaaatgtcatcttttaatgagcctgctcctttccaccctacaaaaaacagcacttctcccaccactttcagggatacagttcagggatggatccaggttttacgggacctgaagttgatgcagttttggggaccctcattaagaaaacaaaactagaattaaaaaaggtatgaaagtgaatctttagaatgagaaaagatatcccaacaaaatactgtaaccttaggtccctttcttctgagacttccttaggcatttaatcacaaatgctcacaaaaaaatgctttctgatgactccctggctccctgtctccacctggaatactctacatgtcccagcaactctcagcactcatagaggaccatgcaagtgaaggggcctgaactttaagttttgttagcttcacaaaaaattcagttggactctttacttaatttttaattatggcatgtatcaccacatgtttatttgtttatagcctgtctcttcccactagagtataaatccaggaaactggtgattttgctttgttcattgctgtatccccagagcctagaagagtagctgacccatattaggttcttaataaatatttatggaatgaataaatgaaccaacacgagaggaacaaaccatggctacatgagtttagaggaaggagatcattatttctgactgggagaaatcacagcaggccttgcagaggaggtggcattgggcttgacttagagttctggcaatagtgggtacagaatgagttaaatgtaatgggttattattaggtcttaaatctaatcagtagggttaatgtatctttggcatattaagcaatgttcataattgttatatgcatatgaagatactccgtcattttgaactaaatacccctagtgactgactagtgaatacagcagtaggctatcacatatgacttttattttgttttttttaaaatacgattaaattgggcttttaggaagaggactttgttcaccaatacaaaaaaaaccttcgattcaagagatgaaatcatgtttcttttttaatttttatttattttttcataccacctttatatgtacaaaaatcatatttcttttctgctttaggttttttttagtctttttttgttctggaagatgccacatttctgagttctaactgccttgacctgattataggtttggtttcctaatgtaataatgtactgcctaccttagcccttaaactctatagaataattttagatttgaccataaatttacatatgttgaaataagacacttattttgtttgtttaagctcttagaaatttgagattgtaaaaattctttctgtataaaggatcatctaccttaccttgctcaaagaatctcctcttcatcgcctgtatgctaacctacatacaccatgatagtaaggcctccccagccatgtggaactgtgagtcaattaaacctctttcctttataaattacccagtcttgtgtat

SEQ ID NO: 93832 - DNA, 1563 bp, Homo sapiens
ccttggtgaacaaagggccgaatgtttaaccccgagacctccccagcccttacctgagcccccccggtggacatgatttttgccacctcccttcttgcgcgcatttccagggaagggcagaacgagagcaggccacactgctcatccatagtgcagagaaggtctgggcgtttgttgcgttggcagggtcagcgcgacgaaccggacagcaggggtctggtgttgtcaaacctgcctgcttcacgccaacctggggtcgtccgctctaggttgggagctgctgcccaccaggcctcggtggtagttattatactatgctgagcgacctccatcttccatcgacagctctcagcctttagcgccttattcatccccctgtcagtttcttttaattttccagagtaatgacttttttttttttttggaaagagcaactttgttttctctaagtcgaattggactgcgatgccatttaaacttgttttttaaaaagtgacttgaatacttagggaaggtactggtttgacaaggttagaattcaaagtccagtagcggtacagcattcctgttgtagagggaccacttctaaatgtgggaagataaatcactcttccctggccaactcaactcttggcctcacagttactgccaagaagagaggaggttgttgccaaatgtggcagcagtcttgatttagttgtgtatcttcttactggtaactgaagttgaactcctccagtttcacataacacctgaggatgcacaaagaaacttaattttgcattggaaagttcagtcttaactttattttgcccatgtttaagcaggtttttactcttcagtgtaatgcctgtggtaacttacatatttaatacagtgcagccagtgttctgctttagtctgattttctggatgatctacttttcaccatcgtggatctcatcacttttcctactatgcaatatagatatattgagcccacctacaatgtatgagatacttggcaagtaagcactttgggttgtagcagtaaacgatagacttggttccaaatcttcctaagtgtttctatttttttggacaaggacagtattaaatagccatttaaataattattgccgtttaattttgtgatgcagaaaagagtattaggatcagggttatgagagcatgtaataggaggacctgatcctgtttagggtatcagacgctcatcgcctttcagctgagatctcagagatgattaggcgttgcttagggtactggggagaggggattacgccagataggggagcatgatatgtgaaggctctgaggcccgatgtgaaagaaggcctgtatagcctgagcagccagagcgggagggtggccctagatcttgcaggcctcttagttctcattaggagatcggacttgtttaggacaatggggaactattgcaggcttttaagcagaggagtgacattagatttaggtttttaaaagagctccctactacagcatgaagagtggaatggagcagttgggaggccactgtgatagtctaggtaagaataatggtgt

SEQ ID NO: 93833 - DNA, 1066 bp, Homo sapiens
tcctagtatgacaccctggtccagttactctctgatcctcagtatccttaaatataacatagacatattaataacacctacttcataaggctgtaggaaagatgaaataacattatgcacataaaggatttagttcaatgccctcaaatgttaccttgtagttttgatagtaggctaaagtcactctccattcaattagctaaaaagcctccctagtctgagtcacagaatgacgaaataaaaaacaaaatccattatgtcagtaattagtcttttgcggggggaagggggtctaaagtcacaaaaatcgagcattgcctttctctgtcctgagagccaaccaaaagccaaagtaatcaaggtttaagaagaaagacaaaaagcagagccatactgttgatctcctttcgtatgagggaagattggagtcgaataaatattgaatcacatattttgttttcatttttaaaagttagaactttactccaattcaataagaatggttagtgcccctttcaagttctaggaattatgataggaaataaagatgcaaaaagaagatatcctccttgctcttaagcaattgaaggtcttgaggctcccaaggagggaaagggcagggacctggccagggaatccttcccagaggagaaaaaggtattggtattgccaatgcactgcggaagtggaaaaaagaagaatggaagccactaattacttgcattatttaagtgactacagcaagatggtgctttgtctgaaattcactgctagtgtatttgttcattttgagctcgtcttagtccattcaggctgctataacagaatgccacaaactgggttgcttataaacaatggaaatttatttctcacagttctggaggctggaagtccaacatgagggtgccagtggttgagttctggtgagggccctctttcaggttgcagataccaacctctcactatcaccttacatggaagaaggggcaagctagctctctagggtctcttttataagggcactaatctcaatcataagagcttcacctatgaggtgaactaatga

SEQ ID NO: 93834 - DNA, 1056 bp, Homo sapiens
gctgaggaggatgtttctggcccacaactactccagccactgacttcaagatcaagtcagctgggtcctggaaaactcagtgtatccctaaggatttccatgaattgagaatctctaaatgaatgcttaagaggcatttgtgcacttactgattctaacccacacatacacaagcacatacacacaaacaaatatgcacacacaatacacatacacatacacacacagagatctcttctcaactcagggcagagatatagaaaaccctcagggagaaaccagtgcccttctattaggagatgacacatcaaacttcaacttcctaacaatagtgattattctgggatgctgggcaccccctagtgggagtaatggagagagaagacagactgttttggtgctgttctcagtaacccattccacccacaacttcctgccccttcgctgccttctctttccagcccatctcactgttcttggaatgattcattcttcccacgatgattgggccttttgccccataaaaccctccctctctttacagacataatggactaaaactaagcagaaggcaactcaggcagaacagcaggaaaaacttcctatggggagagcgattaaaatctgaaatgaccttacaaggcaaactaagtaagacctaactgcactgggcagaacaatagagaatatctcagaaagatattcttggagatgaagaggatgagggaaaagctatttccctgatttcatatattaatgcccccatccaacactctcagactgatttcatgacaatataaatgccctgtgctacatctaaccccttttaagaccaagagaacacccaacatttatacatttgaaataaacagatgaagcctgtcccagcagagtggcagctcatccatgaactgggcactatgtagtactgtgggacattctgaacatttgtgtactaatacccactcttttcaaggccactgccatagctccccacgacgggatgagtcctactatactgtaaacaataaagtgttttctgagtgtttacgttat

SEQ ID NO: 93835 - DNA, 1082 bp, Homo sapiens
cccaatctattctttccttttctgttttctaggaagaagaggatttatctgactcaactggagatggctcccttcccttatttattgttgcatcctgaagcttcccccatgctgggctcagtgtgaacaaacagcgcgggagaatgcaaccactgcagaggtacaagttcacagaggcagagccgcccctcgactgggccagaggcaaagacaaaccccaaactctttcttgtcattcattgaattttgctgaacctggaaaggaaataaattccaaaggcaggaagtgacccagagaccataacaatatgtgaaaagcttagccggtgcttccgcccctttgtttcaaactattctaatctgtgtcccaggaagcctagcccatggccagatggagatctgtttgcagatgcctcctggcatctgccactcccggctggtgacatttgcacatttcagaaggcaaacctgtcccaacatcttcaaacttccagagaggtgtagcaccaggaaagtccttgggtctctggctgtcagcaccaaccagctgatttgcttcatctgcagctgaactgctgctggactccagcctagaacactagtgcacaccgggtctgttcttgaagatttgcagattctgaaatcaaaatgccctgtgttgccagaaaaggctggctcccttgcctgcttcataatcccttctcaccaggctttcctaaagaaactcaatgagtcaggaaggaagaaaacatgtctgagggagatctggaggtgggccgttctctatcattgcttctgaaaattcccttctgttttgcaatgtgggtaatgtttagggatttgcttttagtttttctctgtttcttcctctgtcagctctcactttgagagacccttcatttaccactcatgaaattagctctgcaatcgcaggaggctctctgatggggaattagtcactgttgcaaaaaagtttagactttactttcatccccaggagcagggcaagaaattgttcccaccctgctctcagaaggaaccatcactcaactgctctgctctgctctggctctggggcctgt

SEQ ID NO: 93836 - DNA, 1712 bp, Homo sapiens
agggtagagtgtactgtgttactttctgataacgtaacttctgagaagaaaacattaagataaagcaatttagaattaatcagacacaataatttttagtgataatcattgtgttgattattgattatgtagccttttctctagtcttaggacttaatagatattcttaaccttccaaattctcttttaaaaatacaatgatagctatggatcctctccctcaaaaacaagtagatctaaacgtacagttttaaaatgggaaatgaaagttgtagaatataattttgtggaagatttttctaggcaatttagtggagctagcagctttctatacaagctatatatttagagaattgagttttctggctaatgtaaaattctgcttaacttacattttattgtatctgaaaaaccaattttcaacgaacagaatacaataactatcatttatcattagtgattgtgaaagcattttgggatcttgtaattactttaaaacaatattagcaaccctaaatgttaatctgttacgcaaaaataatcctgtgtacttcaattttctcattatttaagttgtaaatatttgaccctactgtaataggattctctgatttctatatttcagaattgccattgccttcagaaagtgttgatattattatttctgacattccatttgggaaaaagtttaagttaggaaaagacatcaaaagcattctacaagaaatggaaaggtaagttgttgaatttattttcataatttttttagctactgggcatttaaccgaaatacatcatagctcttcagttaaggtctgattgctttttagcaatttcccagagtttttgtagcttaattttctaaggttttaagtcagaagtttataattgaaataaatgttatccatatcatcttacactataaattttattcagaaaaatattaattttctattatgtactgagatttgaatgtatgaaatagtgacctatatttcagtcagtggtctgaagcaaaattttacatatttgcttccatccctcacaaaaaaaaaaaaaaacctgccttctctgtgttaatcccccacacttaacagatgagaatctggggcacagaaagattaactttcttatgatcactctgctactaaacaacagaacagaattctgttaaataaggaaccttccataacatagaatgggcaacaccttattatttattgttgtctttgtccattttctgttgctatgaaggaatactggaggctagagaatttgtaaagaaaagaggtttacttggctcatgattctgcagtctgtaaaagaagcacagtgccagcatctatctgctcagtttgtgatgagggccccaggctgcttctagtcatggcagaaggcaagcccggtgtgcagagatcacatggcaggagaggaagcaagagggagaagggggaggtgccaggctctttttaacaaccagctttccctggaactaatagagtgagaactcaattatcacccctcacagggagggcattaatctattcatgagatatctacccacataatccaaatacttcccattaggccccatctccaacactggggatcaaatttcaacatgaggtatagggggacaaacatccaaactatagcagctctgaaatgaaaatgtgaaagtattcatcttatggtttctaatgacctaaggg

SEQ ID NO: 93837 - DNA, 1033 bp, Homo sapiens
atttaactaatataactttatattaatgttttttaaaaggtatttgattatttaaaattattttaatgcttgctagaaacattcaagacgtcatgccatggcatttcaaataataattgatagtgtaccttgaagtttacaaataaaagatatgtatctgaaaattaagactgagaccttgaatgagcactagttgaaaatgaggttacaacagatgctctgtgtttagtcagtttgactacctcagtgtaggaaggaagcagtctcagtgatgagtgttggctaaaaagaacaatttaccgggacatgaaaagggagacatgaagacttgcacaacagatagcactggacaagagaagtgacagtggataacagaaactgcaacctggtgaccctaacaacagaagaaagtctgaaatgatgaaacaaagtagagagcaccatgaagttaaaggatcacataaaaatttgtcctaagttcctaaagacattgttcatatttgagttttactttctttaaaggaaaaaaccatttggatatcaatagccccatgaagcattaactgtatatagctgttgccactctgtacacatcacctactacagtatagcatagcagataagaactgtggacttgaattctatcttctccacaaattattataactctgcaagtttgggcaagttatcatatttctctgctataaaatcaggaaaataatagtacctactttatagcttcgtccttgggattaaatgagataacccacgtgaaaatctttcctgctgtttctaggatacagtaagcattgaataaatttcaacttttgaaacagttcaatccagtgttagcacagatctgtgataaatgcttgattagagttaggaaagagaaactaactctaattacggacctgtgagcagaaagataaaggattgtccctaagaggagacttgaaagcaataagaaagtgtatgccgcatggagaagagaaggaaagggtattacaggcaaggaatctctgtgcaaagg

SEQ ID NO: 93838 - DNA, 1998 bp, Homo sapiens
ctacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccctttccaattcttaatcatcttctctctggctttctcgtccccatctccctgagtccatctcattgtctcagaattgtttttctcatagattatctcataaataaatatagcaaattcaattcctatcagccatttaatgcaattaataatagctattatggatacaaataattaacacaaaattggcaacacaaaaatcacacgtagtaaaatttgtgactaaaaaattgacagaggaatcaaatctcaacaaatttccttctgcaaaattgataggaaaacatttatagtgggagaggctattcttaataacatttgatatatgaacatgtcgtatctttagaataaattgtcaatagaaaacaattctaataaatagttttgctaaaatgcataatatgtaaaattgggaagtttagctgtgatgtatcagttaatcaggtaattaaattgaccaaatggaatcactccaggtaagtcttttcttgatgaaattgatcaatattggaataattctgattaagctgttaatatttaaagttatcttggggtgcgagtatcagggaccagatattcttgaggttcataacagcatttaaaatattctgtaaaccttatcaggctacaaaagtaagattctagcttttaaaatttatgttggctactaattataatgtggggcgcttaaatactcttcatggcctaacagaagaaagaaaataaagaaagacagaaacttatagagaaaacagcacccttgctgccatatatttggcctaaacaaagttttctgttaccctgaaagtatttgcagcctctgatagtcctgtgtggcctcgcatcctatttgaggttaaaatgagggtggatttagaaaatcttctcaacgcaaaatactgaaaagcgtggtccacttatgataattcctagaatctctaggaagaaagttggttttgagttctttgtaacatgactctcctatataataaattgacctcagaatttttctatgaaatgtacttaaaatttagtttccttctgcttaagaaaaaaaaagattatagaacatttttctagatatgatgaataaggccttggagtttctttttaaaacatagatcatgtaagtttaaaatggaaatttcaaattgtcagtaatttggtaatgaagtttcttgttccattctaacttctgtgtttgttctttcagatctttatacatctaaatgacatttactctgtggtggggattcctgtgttcaggtagatattctaagcttccggtttgtcccataagacagatggttaaattaagaacttgtgttttttatttacagcatgaatgaagcattcatataacagagaaggctaaaggcaaagcatttgaattctttgcttaagacaataaagtattttcacggaacttagtggatatgatttgaactgaccagttagagctgggaaatatttggtcatggtaatctactgattacatgattaatactgaaaattatatctagttctattattaaatggttttcacagccctatacctatacctaaaaggcttctaggctgccctactccagtgcctttaatttgaacagttttgcctatatggtttttttaaattctttgacaattttaaagacagaaagggtggagaaaacgaaaagatggacatattttagcaattatattaagtataattattgatgatcaccaagacaaaagtaggaaacactagcaaaacaagcaaaatataaaatgtatatttttttaaatttataaagtagttaattttttttttaatactttgacccccaaaaagtgagcctaagtatctaaa

SEQ ID NO: 93839 - DNA, 1057 bp, Homo sapiens
gaggctggcgcccgattcttctgcactgcgggtcgcggcctggagccgttcgtaatgcgagaggtgcgggcgcggctggcggccacgcaggtgagttggcctcgctgcgcgcctggggaggtgggcggccctgtccctgccctgttgcccaccccagtcgtggacgcgggaaagcgtcgctggcgcccctctctgttccacgcgacggtcgccgacccccgaggttgactggcaggcgcttccgctccggccgagagaagccaccattcctttctttccttgtatagcaaatccagttcctcacttctcagggctcaagtttttaagagaggtgttgaggcaagttatttcctggattctttaaagtagtaagtagtgcctgtaattagaatctggcctgtcagagttagaacccttcgctctttaaatgcaaacataatctccaagttcagttacctgactttttgttagtttcttgacagtgattgtatttgactacataggattgttgtgagaattaaattatatagcgtatgcaaagtacactttaaacacgcagtaaatagcagccagaaaaataatatactcttgcaggcctcatagttatctgttattgatttctgtgaaatgaacaaggttttaagcatcggtttaggttttagaatgttgaaaactggtttcttgaaagtaggggatgaaggtataatagaaaaggtatcttgatggggtgtatgggacactgtgagtgatgtactcttggaaaaggagagcttcctaaatgaaattaacccctccaccctggcagctcctacagtgtgggaagcccacaaaaggagtttctgcagtgaaaggttggagtcgtgaagaattatgtcagttttgttagactacctgccacttgtgttttgggtcacagaatttaatagagtattgaatgtagctaatcttaaaaagcatcaatatataataactactgacatttattgaacatttaatatgtgtcaggcacatgttcttagatctttaccctatatttatttgcgtacttttcacaaca

SEQ ID NO: 93840 - DNA, 1028 bp, Homo sapiens
attaaacaactccccttttccccttctcccagcccctgataactaccattttgctttctattaattttactacttcagatacttcatatcatgcaatcatacttgcctttatgtgactactatgtttcacttagcacaatgtctccaaagttcaaccgtgtaccatgtgacagggatttcttccttttttaaggctgaataacattctgttatattggtgtgtgtgtgtgtatgtgtttgtgtgtgtgtgtgtgtgtgtgtgtatatcacattttctttagccagtcatctgtttatctgtttactgacacttgtttgctttcacctcttggctattgtggacagtgctgctatgaacatggatgagcaaatatttcttgaagacctttcttgtgaatattttggatatatgaatgctatatattgatttttttcaacttatggactaaaacagaacaagcctttactatagtaaatgcagtgatactcttcattaagcaaacaaaaaaaatcagagatttattctctgactcatcacaatattccttcagcatagattggtggaaagtattaccttccccattccctggataggaaaattggagcacaaatgttacttcacctggccaaccagccgtggagcctggccttgacttcagatctgctgatttctacttacgtgcagtaattgacattggggcttaattaagaaactgtgttccaaacgaaaagatttgccattatttgggcaaaggcttgttgactttggcacgagaaccaagtgtcacactttcctttggcaactgtgaatattcttgtccagttggtatatatttccaagaatgtttcccattggcctattttggattccatttataaaatgttaagggataataacatttaccaagtacatgtctgaaagtttgcactgaaatattccacgctatgcccccccccacaaccattcctttttttatttatccttaaatgcccttacaccttcagtattctcacagcccttttgttct

SEQ ID NO: 93841 - DNA, 1059 bp, Homo sapiens
gatgtctctgagcattgcttttacgtgaaacaaatggggtgagctgacaatggttagattgtaggcttagatcgaaatgcaggaccatgttgcttcctccatggctgacctctcagcactgcacacacagccttgagtaacagagggccttgggttcccacagctctgccacactgatcttatcagtccacctgggaagatattcccctcttctagcttactaatataccgtctgcccttagccttcaccttagatcgtgtgatggcccattttcctaccctcacttgtctgatagtgaaaagctgcagactttgatagctcaataacccatttagaagttttgaaattttctgacgtttatttattatacatccattatacaataaataagtaatcatgtttattatatatttaataatagaactattaaaatggcctggggaatcttctagcatcttggaaaaataactctgcattcatgaagaattacaaagtctaggaatccacaaagctccaagaacagtgatacattctattatttttacactgcctaacaaaaagaaaatgttctatagggagatcatattttgcataatctttggcatatatgtttaaatttttgagaaaatgcggaatttaaaacgcggagcctgtgtccatgtgcatttgaatgtgtgtatattttataaaggtgactgacaacaaatgaatccaatattaactgcatttttccactagtggaaacaatttgggagttcagtgctatagaaagaggatgttgtatgtatagaatacagtgatggaagacatattacataaaatgattttgtgaagattatagtagtctttgaagattcagctaacagatttttcaaagtcatgctaatcattttcaaaacagcaaatttatggaaatgtaagttagatttcagttagttactaacctgatttcaggtcaaagcttattcataccatcagaataatttacagctggagtgttgcatggattgcccggaataggaggacaagggaagaaagaatagccaaggaaaaaaata

SEQ ID NO: 93842 - DNA, 1022 bp, Homo sapiens
gggcaaccaggtgttgcagtatacttagcaattcacatattaataaaataccctaagatattttccagatatagttttttgattttatttttgcttttctatgcttacatatgagatatctggggtcctaggtattctgaagccttgtggtgacccttgaaaccaaggccacaccatttttccatgacaaatttcctgagataaagatgggcttaggaggatcgctaaacttggaaatttgagctctctgtcccctaccagctttgtgcctttcagccagttactgaggttctgagtcaactttctcacctgtaaaatgaggaagatggtcatggtgctgttggtgatggtgattttggatatattggtaatggtggtagtgatggttgtggttggaatggtggtggttctagatatgttggaggtggtagtgatggtgatgctgatggtgttggtggtgatagtgttggagatgatggcggtagtggtgattatttttggtgttggtggtggtggtggtgatgatggtgatggcactaagatttattaaacaacaagtttcatgctattcttaaagtatccgtatgacttaatctttgcaactatatcaagtagctactcttattagactcattttacagatgaagaagttgaagcttagagatttaactttctctgggtcacacagctaataaagggtggatccagaattcagcagcactgcttgactgtaattcccatagagtcttattcagggctgtttcttcctttgaatggctttcatacacaaggaggaatatgtatcaggctgtggtgcagtgacagtaacctcaacacatgctcaagctgctcagaagatgagaaactagagcagtcatttatcttttctgggattctagaacgtgtattaaccacattgcaccccgtgccccactctccattaacctagaaggccatgaatagctgagtttgagaggcaagggaatgcttaatgttttagtccctccgtgtagctgacctac

SEQ ID NO: 93843 - DNA, 1071 bp, Homo sapiens
atttttctctttgttaactagtccttgggtctctaggaatggttctgctttactttaatcctatggatattgagcagcttttgaggagtccttagccattgacaattagctattgtcacatcattttctcaagagttattgctctgtcaccatcttgtaaaatctgaatggattttacactaagttgtgaaatgggaagaggttttctttgctttctttccttaggacaccattaaccaagggaaggagatttaagtatacttaattcttttgagtagagcaaccttgagggtctaagacatacaaggggttatttgctgttattttgcttctctgtcagctaacaaagctgagatgtggaaaattgcctataggcaacattgtaatatcatgggaactattgaggttttcctataaaatatcttcatcatatttcctccatggctgaaatctgaccattggagatttactgtttggggtagaacatcgattagtcccttattacagtataaatgccatgaaactcagaagtttagccttgcaacagtagagttaaatggctctgggccaggtggcaggaaagggtgagaagatagctgaatgtactgtgggtaagtggcatatgagataatcttcgtaactgccttgggtgagcccgctgagggtcccagtggaaggtgctgagtgggcaggcaggactcaagctgctgtcttcccatagtgccttgcagttcctgccctggatttctggtgggaagtccagaaggccctgggagggaaagcagcaattaacaatatgggaagcattagaggaaatctcctccattgcctcctctcctggctcgacatgctgcctacataatacccatgtatttgccaaaggttgagccaagccagggccctttcttttcacagacttatacagctgtttcactatagagccaggctaaataaacaattctttttcatttcctgcctttctcctgaggacttggtgctgtagatgacagtttctttctttcctatagtgtcttcacagggctaaatatgggaataggcattgtgttcttt

SEQ ID NO: 93844 - DNA, 1037 bp, Homo sapiens
atccaagacgatttcaggtgggaagaattaggagattcgtggcttagtacaaaaatgtctgtttttctttttctccccccaactctttggtcacttaaacacacatggagttggttttgctcaaaagcacactgtcatatgagacttcccttttaacagttaaaagggaacatgttcattttctccacgtgctaaatgggcttaaaatacacacatgcgtgcacacacacacacacacacacaaactagaaagtgggtagcttgggaatcatgtttcaagagggtctgcctgcacatctgtgaaataagatgagagaatacgaatgggcctgaatctcccaaattctatggcacggtaattccctgtcatttatagtctttcactagcttccttggtgagctagcaggaggggagaggaggattattcattaaaatcctttacttttgtttcagtcttttttttttttttctgtctacagaaggtgtcccccttgtggttatagaaaaagctggactggcagtttatctcatcttgtgaaatttcacacatggacaaagacttttagtattctgtctatccaccttttagtagctcttgcttctaaaagggtaaacttttactcagatactcatttctatctgaaagttaatgctaaactcaaagccagatattcagtcagctggctttaaactttttaaccccacttatgattatttttaaaattctctttccctgtggctggtagtatcgtttttccatgaagtggtatcagagattaaatggtgttatctgtccatgaacaatttacttactggagcatgaaaaagtgattaagcatgtgtctgtttcaatgccatgactgaccattaagttctctcaagtatgcaacccagcttggccttttcagcagcagtgagaaaaccagtctgagtgagcaggttccgcaatgggcttctttcactcctgttcccctctcttggagtcacagtgaacactaaagtagtgggagtagacagttttggttattcttaagga

SEQ ID NO: 93845 - DNA, 1053 bp, Homo sapiens
agttacacagtccatgcactgtgaatgtgtcaccttccaagaacatcctgccacactttgcaacctgaagagattgagcctcttgcaccatttcctatactttgctagaaaatcatattattacattccgataaaaattcccacatatcctcttgctaacagctgttctgtgaatggagcaatactgagtagaatgaaatatcaattcttgtaaaataaagccgctttcctaatccaagaacaaactgcacttggtttgagaggccccatgaggaccaaaagaaatacttgagtaatgcatcttttttgcttgaactgtataactaaatttaagtttatatagatagcataccctaaaaagcttctttgtatgacataagttgtataacttacagaacaattgtcaagatgggaagtttgtttcagtttcgataacttatgcaagttagcatatgaagctaggacccccaccgaggtcaacagctggatttaaattttctctgaataacttacctcaaaacagttaagtttagagggacagggttgataacttagtgtcagcatagtaaaagaaggttcaaggggcagtgggagaactctgctctaaagcacagcccttgttaatatgtgttacaataaacagtgtggagaataatataaaagatatagaagggagtcttttaaaagttcatatggacaatgtgtattataaataaaaaactatgcatggatttgaaaagtactttgcaccaaaataaacttgtaaacatatttgaacaagatttaggttggggagaaactaagaaggataatgcatcagtttgaaaagagctcctatcagagcaaaacaaattctgctaaaattgaagcaaaacaaacatcaattttatcgtgaagcttgggtagaagaatggtgagatcattgatgctttaagagatgtttatggtgatgatgctccaaataaaatgacagtttacaaatggataactcattttaagaagggatgagatgatgttgaaatgaagtctgtagtagcagaccatacacatcaa

SEQ ID NO: 93846 - DNA, 1027 bp, Homo sapiens
agaccttatttttatcagatgcataccccttcgttgaatgcaaatttattgaactatgagaatgtaatcttctactaattaatgagttacaagtgattggaaatatggtatgatgatgaaacactgtgttcaaaatgcagattattctaaagaatcagagtaacaatgccttaatattattttaacaacagtgtctggaacataatcggtgttagacactttaccacattgcattatcaggcataaagtttagctatcatttcaggaaactgatgataactcaaaattaaacattaaaattgacatagtatctgatattgtaggctgattccaactataagataaaaagtgacttatttttgagaacttattgggcattttttttcccaatatgttgtttcatacaaggaagcaaataatctgagaattagtgacactatctgtggctatgtgttgatttgtccatttgaagtattcccaaggtttcatggaattgaatttttctagtgtttagcacatgctggttcctttctcttgcacaaataaagtcagccaaatcataaataaattattctctcccaaaccactcaagttcacctaaacataaagacacttctagtaggttgatagcatttgtgaggttgagttaggcataataaggtaattcagcaatgaccttaacaatattcgttaaaaaataaagcaactggcatttcagatgtttactatgtgacagataatgttctagatgttataaaatattacttataattctcatcccatgcaaatttagaattattatcctcattttatttatgtagggactgaagagtaaagaactggataaacttgcccaaagttatgccactatcttatgcaaccataatattcaaacacaatctttctgagtcaaatcctgtctctttttactataaacactcattgagcaataaccaaatgcaagatagttgttaagtattacaggaatcaaatatgcccctaattatttataaaataggagaaattt

SEQ ID NO: 93847 - DNA, 1223 bp, Homo sapiens
aagagaaccaaaaattatattctaggtaagaacataatactattcaaaagagaaatataatcaagagactcagattgcaaagaaacagaaggtatagtccttactctcaaaggagatcttggaaaagtatgactctaggattgctatccataagccatgaatgtggcagatgatgagtgcagactgatcttctgtcactgcaaaatgtgtgctccaaaaacactactgcagaaattgcctttctgcatcttcagatacttatgacttctgtaaacgaagtctgtagtagcagaccatgactgcctactcggcataccttaataaccttaaaaatttcacagggaaaagtcataggtgatacccctgtaactgtttgaaaggaacattttgaacaatgatgaatacatggaagctattagatgcagacaaaattatatcctccagaaaacaatggattggtttataatagctgtttccaagagtttaatcaacagaggaaagtctgactacaattctctgtccctcatgatttctactggcatcactcaatgctacttgctgggtgtgacctttcatcactatacattgttttatttggttggactcatttccaaaggtctgtttctataaggcctcttggaggcaggcacttcttcagggtgaggtatatcagatttggggaattctctaaaagtctcaggaaactaaggcagagctcattctgacatcaaaatacatgcatcattaattcactttcagttccaacagaccagcttttttctttttttattattattattattatactttaagttttagggtacatgtgcacaacgtgcaggttagttacatatgtattcctgtgctatgctggtgtgctgcacccattaactcgtcatttagtattagatatatctcctaatgctatccctcccccctccccccaccccacaacagtccccagagtgtgatgttccccttcctgtgtccatgtgttctcattgttcaattcccatctatgagtgagaacatgcagtgtttggttttttgtccttgcgatagtttactgagaatgatgatttccaatttcatccatgtccctacaaaggacatgaactcatcatttgttatggctgcatagtattccgtggtgtatatatgtcacattttcttaatccagtctatcactattggacatttggttccaagtctttgctattgtg

SEQ ID NO: 93848 - DNA, 1422 bp, Homo sapiens
tttcatgaacattgatgtctatgatgatacaatatttaaatttttggctggatagaaagaagctcagaagcaaaacaatttggcagcaaaaaacatatctctttgcaaaaaaaaaaaataataacatgagatgaaacctattactttgaaagagctagaaatatgaacaaaattattcttgagacagaggtctcaaatgagatttatttgttttcatggttcataaatattctgtataatttgtctttttggtcaagagaaaggatttttagcttattggatagtctctgaacattgaaaaaagtatttttaggttcacgtaagttgactcattgcttcatattaactaaatagggtttctttttaaaatgagactttttttctgattttatatttctgtttccctgggaagaagcttatactactgttttcacagttcataaaatatttcacattgtatgtggttcatctgagatacaaaatatagagtatttgcctcttttttttttaactctagctcttgttttggggtatttcttaaaactggtctttggctttttatttattttctttatatactctctttgtgatcccattgactactgaaaaatattaactctatacaaatgatttaaccagtatattttcaatattgcatttctcatttaataaaacaacaaagcacaattacccagtatatcccatgtgcaaaatactgataataacataaaaaatgtctgcttggattttctgcaatcatctgaaatcattagaccacctttccttctaagtcaggttttcctctttgctcctggtttctgtgaaagccagaatcattttcccagaaatgtttcagaaacataatacaatcttaaaatcatcttctacaaacttcatttaaaatcagtcactatgtgttcttaactgttacttcgtaatgagttttcaatatttcctttctaatgaaatttctttcctgttgaatgcatttcattcccactactttaattcaatacagactcccgtcacctcatccctcaaagattccaaatgcttttaattctccttgattttattctgttgtaattccaaccatgatggtaccagttatttggctctttgctcacagctctgtttgcagtgatttgagtgccctgtccagaccctcttgaatgggcagtgcacccatgccccacttactgtgagtgtggctgatgacccactatttaccccctttctggaaactcccctcagtcaagtggaaggtatcccaacacccacacaaacttcagtgagtgctggattggcagggacaaaaggtatgcccctggccttgagatgggcctaactgcacttcctgaacttttctatggattcagaggaaagccaggatacagctgtgaccatagtgttgcttaggta

SEQ ID NO: 93849 - DNA, 1032 bp, Homo sapiens
tgtgcatgcacatacacaaatacacacataacaaatatgggcaccatcatactgactttttttttttctttttttttttgtttttcaagagagagtttcactcttgtcacccaggctggagtgcaatggcgtgatcttggctcactgcaacctctgcctcctgggttcaagtgattttcctgcctcagcctcctgagtagctgggattacaggtacctgccacaatcccttgctaatttttgtgtttttagtagagatggggtttcaccatcttggccaggctggtctcgaacttctgacctcagatgatccacctacctcggccatactaactttaagatgcaatatcaaaccattatagcaagtcttgttatcattaagcctatgctaactccttataactgccaattctgccactaattgctcatgaaagctttgtttagctagtttattcagtatttttagttctgtcatccactatttttatctttttgaaaattgaaagaacattttctcacctgatttccatgatgacatctggagttcatctgtgatcacatcttcaatgtgtagtatctggaaggatttcaattctctaaagcctaaagacttaaattaattcaagggagcttctcactctcttttatcatcttcccaaactatatctactctacttccacaactttggttatattatacctcatttcattattttttattcactcatctttcagttcattgaattatgccataataattctagagcacagagatttctgaactactccagcattatttgttgtttattgttattgttgtttttgctctaaagagaggaagtcttgctatgttactcagatcgaatttgaactcatgttcaagagatcttcccatctcatgtccagagtagttgggactacaggcatgcatcactgcactcagctccattacttgtttataccacttattcagcagcataaataatataatgtgtaatattgtacattggcttctcccctatatgtcttatat

SEQ ID NO: 93850 - DNA, 1020 bp, Homo sapiens
cattcctgttcatagtcacagcagccctggcggcgaccatggctgagccacatctggggtgctgatggccacatctgcatccacccctctgggagctggttacttctattcttttatctgcatctgtggaatcgggaggggatctgggcatggtgggttcccagccctaagagctgtcaatttctacaggagggcttgggaagactccatgtcacaggccaccatctctttgcagacatggattcctggctcttaagtttcagacaaagacaaccagggagccattccatgagagcccctgcatctccctcttcaggtcttctccctcctctaggtctactctgcttcgcccactcacctctctcctccaggagccaattatacttattattattactgactccactttatgggtcccaaatgacaaatgaggatgagggcagaagaaaaggaatgctcaggttggatatgagagggagatgaatgtgggaggtaggaggaggaagaacaagatgggattggacgcaggtggattcaggaggtaaacccaggctgtcttggggtccccagcctggtttgggagaggctgtaagtcatgccaacatgcaacacatgggccaagggttgtgtgggcaagaagtccagtgcttgcaggccggtctccagtatccatgagggacttctgttggcttttaagccagagcgcttcgggccataggctaggtccctctgctggtctctggataggtttctttgcatccagggtgtcctggctggatcacattttccagactgatggagagtggtatgggtcggggctctgagcgtgtcttgatgtggtccttcatggttggacagatatcctggccataaaaaccctgactcaaagcctgacccaggaaggaatggaggactccagagagtagatgcctttcttctagtctggccagacctgctgatgtccatggattcttgcaggccagcatgcccctgagtgaggtcttctaggatgaaggaggt

SEQ ID NO: 93851 - DNA, 1047 bp, Homo sapiens
gtgtaagcctttaaaggatagaggcaggccctcctggagcagtaggggaaaaaagagggagacaggaagaggcacattgaagagaatcctcccctgtccccccataaagaaaaccacagactcaggagctaggaccagacacctatgaagtgtttctcggagactccagagggcgctggggggagagagaagaaatcaggagtgatggtttataaagggttaacaacaccctgggagtctgtggaattaaaataattatttgaaaagttccaaaaagcacaaaaaaggaataaaaattacacaaaatccctccattaaaagagattatctgcagtaaagtgtgcgaactacctcgtctgcccctccaaccccaaccccagaggtaacctctgttaaccatgtggtgtgtaaaggctctcttagatcccacacgcactcatcatctccttccctccaccaccgtcccatggtgattgttgtttctgtaccaccagcttcaagcttagacatcttggagtctctttgatgtttccaaactcaaattcaagtcctgtgctttaaaaaaatatctcttggatttcctccgtttttcctcattgccgtcctcccaagtcttggctcttcctctcacgtctgctctgttgattggtttcctaaatgttctcttcccacctcgaagcgtgtatgggcaccagattcatctgccaacgacattgcttccaacacatcattttcctgttctaaaatctttgatgattccccatcatttggaggataatttagcctggcatttaaagtccgttgcaacctacctcttcacttcttgtattcacaagtgcttcctgactctgttttgaagcctggctggttgccttactaatcttagagcaaactctgcaactcttgcctgacgatgacctttctccacctagccaaagcttgtccatccttcaaggcctatctcaaggctttctttttctttccttcttcttcttcttcttttttttgagatggagtctcactctgttgcccaggctggagtgcagt

SEQ ID NO: 93852 - DNA, 1409 bp, Homo sapiens
agcccggcgctttccccgcaagatggacggtttcgccggcagtctcggtgagtacggctggggagtcctgcgtcttctgcgaagggtaggaacttttttccttccgcacacagcccaggccctgccctcccgcctgcccctcggggtggcagcggctccactgcacatgttcccttcgaggctgccgcccctccgcggactccggtggactgagggcccctcccccatgtccaactctcctctgtgtcagaccctcctttcctcccggagcccctttcagtgcggggccctcgttcccccaaagtgggaaccccttccttctcaggccccccgatagctggcacacccctccccgtacactcacggctccctccacttaccccccttcagagttgggacatttcttcaaatccaggctcctcttcagggtacaaccttccaccacctttccacatacacgcctctctttcagggtggggatcgccttcacccgaacagaggctcctttttaggggagggaccctcattccctcttcaggaagggggcatcccccgcccccaagtcttcactttagatttgaaggcgactttccagtatccttcagagtagtaggcaacttccttttcaatccctccacttctctgagcattttgcagtggtggagagacctagaagcatcggagcatcatttgcttaatgcaggaaaggaagaggtgcatctgtgttgggggaccctctttaagagtgaaagcagaagtgttttctggttctgcatacatgctggggagaagtgattctgcccaatgaatcaataggaaagggggcctctatcagggaaggaaaggattctccatttttggaagatgttgtctttgtggaatggagaaagggaagaggttattaaataggctgaagtgccttttcagtgttcctttcaccagatgaaggtaatcttctggctaggaaaatcaaaactccaggctagtattcgctgccctagaagctgaatctggaattactattcttcgaggccattgaaatctagtaaaagattaagttcaactgttagaatggtgagagaaacagtttcagctttggctgataacgcagttgtgtgatacctactgctggaactgtattttgagttttttatgtgcaggtagcttgtattcagacgcctttcttttacatttcttgataataagtctctacttggttaatgttcactgatcagtgagcagtctggccataggccgtactatatccagataatatcgagatgagatggatttttaaaatctaaagtaaaaaagtaagtcaaagagcaatgggcctattatagatattaaatagtaaaacctataattttggccttccctttttcttgggcagaaaaaattgtcgttat

SEQ ID NO: 93853 - DNA, 1141 bp, Homo sapiens
gggaggctgaggcgggcggctcacttgagctcaggagtttgagaccagcctgggcaacatggtgagaacccgtctctaccaaaagtacaaaaaaattagccaggcatggtggtgcacgcctgtggtcccagatactcgagaggctgaggtgggaggattgctggagcctgggaggtggaggttgcagtgagcgcagatcacactactgggctccaacctgggtgacacagcgagaccccgtctcaaacaagcaaacagacaaacaaaaactcattatgttcttatttctcatttcacctgaaataagtgaaatgttctagactttattgggaatctgataaagaattctgtgccagattctagggtattttcaagtacaagtcatgtgcatgacctgttaatggtttttgaaatcagtttagtcgtggtcaggaccaacattagaaaaatgaggagaagaggaagagataatgtaaaatatcagtacttcgtgtgatattgcttcatggaacatttaatttcagttacatatatttgtcttagatttcagtgtaaaatttctgttggtcacaatcagatgaaagatacatttttagtggctaatccctatctttgagagaataggtggaaaggttgacatacatgaaaaggtggatgaacaatcagaagtaatcattgcgggctatgtctttgacaagtttttagaatctgaatataattagaatatgtttaacagcagcagcagcagaaagatatttattagttgtagaatcagtgtaattcaggcaaactcagtatgtaaagaagtgattttataaaattggtagggctagggtatgtttaccttgcaaatcaattctttactttgaaagagaattttcaggccaggtggtatagctcacacctataatcctagcactttgggaggccagggtaggaatatcacttgaggcctggagttcaagaccagtctgggcaacatagtgagaccctgtctctaccaaaaaaaaaaaacaaacaaaaattagctgaacgtggtggtgcatgcccagctccttgagaggctgaggtgagaggatcgcttgagcccaggaggtggaggctgcagtgagctatgatatgccactgcactccagcctgg

SEQ ID NO: 93854 - DNA, 1496 bp, Homo sapiens
gcaggcttccattctcagttccttttttttaaatcgtttatatttaaggtataaatataatactgtgtatacaagtataaataatatactatgctacctttatggttggacatatatttttatttttagaatttttttcttattaaataatctggctgtatttcaataaaatcttttttttcaggttaattattataggtcactgtttatcaatctggattcaggacctacatccagtcactagagaattctcaggatgctggggaggtcttaaaacagctgtttgtgggtggttgtgttggtagaggcaaaatgtgggttgtaccaccaggatgaggtcacctctttgaccttctggccctctttctttccggactttaacacctactttggtacttaaagcaatttgggctatttgctgtgctctgaagtgttgtttagtagtagcacctataagatggtgttaaatgttttttgaatgagtctgtgtcacagcaacaaagaaagagttgttttcagtagtttgaaaaccattgatatggtttttatctcactctattcttacttaacctgtatatggccaccaggttattcattctaacacactgttttctttttttcattattattattatattttaagttttagggtacatgtgcacaacgtgcaggtttgttacatatgtatacatgtgccatgttggtgtgctgcacccattagctcgtcatttaacattaggtatatctcctaatgctatccctcccccctccccccaccccacaacaggccccggtgctaacacaccattttcattgtcactccctggtttaagaactttcatctcaagtttctatgagataaactctagtatggtgtccaagttgtcctgccacctggctctcacctacctttccagcttcaccccttactgcgccccctacatggattccctctgtatcccttttcttgcttagttttttgtgaactgctttcttcttataccgttatttattcaatatctctcctttctcttactaattcctgtttatccaaagtagtttaagtccatctcttcttttgaccactttaatccacagggattttctgtcctattttctgaaatctagcacatttgattttccttacagagatcaatcatatatttgccttatgttcttaagtcatatatagccctttaagtatttcatgtttatcttgtctcttcagttaggaaatacatttcttaaggacaagaatgtgccttatactaggttgaatgtattgccttttgagtggtaactgctctcatatccagtgcctaaccgctttggccgatgggaaaaccataggatcagtggattgataaaattctctttaactttttgtttttatgtaatctaattttctctcctttgtgcaatgatacatctgtgacatattggcaaaatcattggtcccggaataatataatacctgagcatatattgattttttt

SEQ ID NO: 93855 - DNA, 1030 bp, Homo sapiens
tcagggaggtggtggaaactgacatgtttggctggttggctccacttagccaaaccttagtctttagctgcagtacaatatgtttcatagtaaagaacagtcatataccacatatgagggtatttccataagattttaatactgtattttactgtaccttttctgtgcttacataccattgtgttaccattgcctacagtattcagtgcagtagtattctgtacaagtttatagcctaggagcaataggttataccgtatagcctaggtctgtagtaggctataccatctaggtttgtgtaagtacattctgtgattttgcacaatgaaattgcctgtgatgcatttctcagaactgacacatgtctgtactgcaaaacgtgcatgcagtttattctgctgaaggaaaaattagtagaagctggtttttagatgaacgataaaaagagtaaaagcatttagaatggtgtctgctgtgtgattgtttagactgacagtggaaaatttcttagcaaagaagttgctgttgcaattttatttcttagggccaaacccaatctgatgctataatgagaactaaaatgatttaaattcctttaagttttgacctttttcattgctgagatttcttaaagggacattgttgatatattttgcttttaagttttcacttttgtcatctatctattgagtcattataggcgttcttttttttttttccttttcttaatgaagtggggtcttggtatgtcacctaggctgttgtgcagcagcacaatcatggctcactgcagccttgacctcctgggctcaagcagtcttcctgcttcagactcctgggtagctgggactacaggcatgcaccaccatacccagctagtatctttatgttttgtagagacaggatctcactatgttgcctgtactgtctggaactcctgggctcaagtgatcctctccctttggcctcccagagtgctgggattacaggcctgaaacactgtgcctgacctgcagtcttattttaaact

SEQ ID NO: 93856 - DNA, 2105 bp, Homo sapiens
actgcttggccaggatctttaatcttgatggtctgatttatcatttgttccttagggctttggcttttaggtctatgttctaccttagattaatttctgtgtatggtgtaagataagagttaaaagttaatttttttcttacaaatatgcttataaatgctaacaaacaacattgtttggcaaagactttgctttatttccaaatcaggtaatcagtattatattataaaattattagttatttcaaagtagttgcatggttagctagttcattgattatagaagctgtatttttttaggtcagaattatgggtttataccttcgggatccagttaacttggccttgttttgtggccatggaatgtatttctcctaagttgttttagtcatttgttagatttgtttcattgcaagtaagagggtatatgataacttcatcatgctaccagataaaacattagagcatatgccttacacgactattaactaattttattttgtgtgagagagattacattattacattttaaggatacggtattcatagtattataatgtttaatgtatcatactcagtttttatgccatactaaaataagcaaaaataaattgattttagtaaacattagaaataatttttcagagttttgtatagagtgggaaatgtagatctgacactgtgaaatccgtttgttaggttttgtgggtaaataatgctaagtataaaaatacaagacatagaaaaatttaaaatgtacgtttgcatatgcttgtgccaatatatagaccattccataaacccaatcattggcttacatttctgagataccagcattaaacatgagttatcttttaagaggctgaatttgaattatattactctgttaggatttgtgccagcttttggttaatcattatcttgttgattatatttggttcaagatgactcatttttcaaggagctttattgcaacactacatatttactacaggaagcctggatggaaatggagcatcaggttattggagatttttttctccaatctttattgtaccaagtgttattaaagttaattatttttcaataactgaattccctgtggaacctagtgcttcattaaccaactgtaggaggatcatttactcctttttcatggcagacaaatatatctttgatgattgtttaaatattggtcatacttctatactatacattgaccagacttagatatagtattttattctcatcaaattgagtatggtcattaactgagaattttggaatcagagagatttgagattgaaccttgtttgtaaaatttactagctttggaagcttgtgcaaatacttctctgaaccctagcgttcattcagtcattaatgagtgaattaatacattcagtcattaatgagtgaattaatacattcatttattaatgaatttggataaaaatatttaccttgcaagatcagattaaaaggacatataaaagtattagcacttaatatgtgcttaatgatgatcaccatctgttgacgcttgcttatggtatatattgaggttaggagtgccaatcatttagcccttctgtctccaggttctaagagataaataatggacacagcatctgtttctaaaatttagactgtctgataacagcagaatttgagaccataacatggatctaaggataaattgagagtcagctgcaatcaccaacaaatctagactgtgagactatgataagagttccgtctgccatgtctgctctgactacacttaatctggcagctggcgagaagattagaggcttactttatgtatctagttatcagcgaaacaaagagctggagtgagaaagggaaagatggccttgttttctatgcagtaacgtaatttccttcttgttaaaaataaggtccaaggaaagctaaatctaacccaccaaattagtaacttcccttccccctctgcccatgcaggagtttgtggcttgagtttgtggaagagagactgggagagttttctgtaatacctaatacagtaaccaccctgcctccaccctgccctctactgtgggaaagagaagggaagtctcattc

SEQ ID NO: 93857 - DNA, 1075 bp, Homo sapiens
ggctaacatggtgaaaccccatctctactaaaaatacaaaaaaaaaaaaaaaaaaaaaattagctggacatggtggtgggcacctgtagtcccagctactcgggaggctgaggcaggagaatggtgtgaacccgggaggcggagcttgcagtgagccgagattgggccactgcactccagcctgggcgacagaacaagactacgcctcaaaaaaagaggaatatcagcactgtgtagacaaggggaaaaagaaagaatttcaacaaaaattatggcctttgctccacatgtgacctgtaagctgtagagagcagtcttttttgaatttggcataaatgcttttatggacaaatgttaatttgaggttgttaggtattgtggttgtcaggcatatttaattcaacaaatgctgatttcttatttgctggtcattgagatcaaaagctctctttttggcttgaactccctttctccagttgaaaagatggtttcagaaattctggcactaattcagacttacagactttctttgtagagacagtaatcctcaagttcagcagtttgactctaaatatcataacaattctaaattcatatctagaggaatgttttatatcttttttggcatttttaaagagtttttgcagacactcatagtcttggcatgccttctattgaatctttggtgggagaaagaatgtaaagcaaaggactgaaatttccagcgctttgcaggggacagtaggggaaatgaggcaggaaatgagggcccacttagaatgcagtttattccaagtcttttccacttcccctgttctccatgggctgcctgctgtattctcctaaggatgaccctaagaaattaagtgaattgcatcctctaattgttgtctatagcagtaatatgacagaagtatagtacttttaagttcttttaagtgaaggatacctgtattctaatttccatcaatcaagtcgaatttctgaagattttgtcaactgtgctaattttcaaaatgtttttgttggctacatgctagctggaaattaactctgaaagcattaccatcaaaat

SEQ ID NO: 93858 - DNA, 1040 bp, Homo sapiens
aatagctgttgttccttgaatttgtttttcagctatttaaaaatgtaaaaaatcattcttagttctcttaccatacaactaagggatggtgatgggatcagatttggcttgtgggcggtagtgtgccaacaactactgaatggcttgctgtatttgttttttctccctactaggataaacagaaatggatgattcttctaacagtttttcagaataatgagaaactgttacagctagagttagacctagttaactagttaacctagttaggtaggtagagttacaagctagtaatgaatctgtgtaaatgttctttgcctcagatattcatgaatgctaagattatggggtccctttaatattacagttcttcctattactataccatatggttttagaaatcataaatattcatctcttaatcatttgcaatacattgccattttgttctataatcatccaaagaactttgattcgaggtctttttgtatattaggtgttgaggtaatttgattcttttattaagagaaaaatttattggaaataaaatgaagggttctcaacaaagatgattcatgcagtctttacaaagtttgcctcttagattacaatttgacatttataaacttgaccttgtagaattttagtataagttggcttatgtgcaacaaaaaacacttccagatgtgatcactgatacaattctgaattaaaatgcttaatgaaaacttctagtgttgacagatcaacactaatcaaataatctgtccttacacatagtgaagtttatcagcaaaagttgacatttttatatttggtagggaaaagagatatactctaaaagtaaactaatttcagcttgcccaataataataataataggtgtagatggtgttgaattaaatgcccctgccctcagtcagcttccctggcttacctaactcacagtaagcactcaataaatgtttgctcttagaagctgtgtggtgtggcctgaatcagtaggcacttaaatgaaggaagtggaagatctgttagtg

SEQ ID NO: 93859 - DNA, 1032 bp, Homo sapiens
ggcaggagaatcacttgaacctgggaggcgcaggttgctgtgaggtgagatcgtgccattgcactccagcctgggcaacagagtaagactctgtctcaaaataaaataaaataaaataaaataaataaaataaattacatacttgaaaattgctaagagagtagatttttaaatgttctttctcctcatagaaaaatgctacgtgagataatgcatatgttaagtagtctgacttagccattccacagtatttacatgtatcacagtatcatgttatacaccataaatatatacaacttttacttgtcaattaaaaagtaaatttaaaaatgtgaaatgagattaaaaaataaaagaactgcttacttctagaaatatatatataaattttgattatagtagcagtatcccacaaaatttccatgaaattcaacaaagggaatcctctcaaaaggaaagcaagattttgttgagccttgtactgaacttgtttaatccagacttttttccactttcagttttatgtgcatgtgaaatgatgttcattctttttctttttttttccccttgaggtaagatctcgctctgttgcccagctggagtgcagtggcacagttgtggctcactgcagccttgacctcccagattcaagagatccttccacctcagcccccacagcctgccccaagtagctggctgagactactggcatacacctggttttttttaatttttaattttgtagagatggggttctcactatgttgctcatgctggcctcaagcaatgctcccacctcagccccgcaaagtgctgggattactggcatgaaccactgtgcccagcctccattcttatttttttaaagaattacatcctacctgctttcaaaattaatatgagcctgttaaggcttttttttttttttttttaaaccacccctcttccacaaagaaaaactttaaatttgcttctggtccagcaactcaattttgtgtgacatattgcaatatatatgcccttcaaatacag

SEQ ID NO: 93860 - DNA, 1050 bp, Homo sapiens
tctcttttctgttacagtcaaatctctttttcaaaactcctattcatccagatatttgagtactactgtatataaaaaattttcaaagtgctgagaatttaaaaaaaaaattactgccagaaatttatctaccagaaattagaaataaataattttttttttttgagacggagtctcactctgttgcccaggctggaatgcagtggcttgatcttggctcactgcaagctctgcctcccgggttcacgccattctcccacctcagcctcctgagtagctgggactaaaggtgcccgccatgacgcctggctaattttctgtatatttagtagagacagggtttcaccatattagccaggatggtctcgatctcctgacctcgtgatccacccaccttggcctcccaaagtgctgggactacaggtgtgagccacagtgcccagccataaagggataattttaatagatgatactcaagacagaattgatggaatatggtcattgattacataagaggataaaaagtacaggaagatccctgtttttctatttggatgactgaataaatggttcaataacatgcactgatagagaacaaaggaaaaaaaacagtgtggggaatgagggagcagaaagatgtgtggttttggatctgctgagtttgaggtcattataacaaaagtataactaggtcttgggcttaagatagaggcctgaattagagattacacttcggagctttattaggacatatctgataactggagttgtgagaattgatgacttggagtgagaaaggaatagggccaaagttatccagcagagaagacagaataaaaactgtcagaaagctagtcataggttcaggaaaggagacataatgttagactgcaaagatatcaaaagacaatgactaaaaatggtccatctgatttggccagtattaaggaatctttaccagagaagtttcagtggagtcatgggaacagaagcataactgcaatgcactgaagtgaggctgggaggtaaggcagtcttttaaggaatgtg

SEQ ID NO: 93861 - DNA, 1997 bp, Homo sapiens
tttcctgttaagtacttaagtatgaataagttttaaaaagtgattacttattggtagcatataagttcagagtcaggaatgatggttatgccaaaaaacaaccagttgtccatgtgggtgtctgaaatagtgacacctttgttttctgatagttcagtatacactttatttcatgcacaaaattattttttaaatactgtataaaattaccttcgggacatgtatgtaagatgtaagtggaacataaatgaattttgtagttagacttggatcccctccacaagatatctcattatgtatatgcagatattccaaaatctgaaaaatttgagacctgaaacacttctggtaccaagcaattcagataagggatactcaacctgtaatatgtttttaaaatagaagaggtcctcattttagagacttctcatataaacagttcaaaaagcttagttattcaatgtaccataatataggaaattagattggaaagggagcattgctatggataggcatagctaatcccaactgcaaagaggtaaggggaaaagtagaaagaaagattagaaaaccaaaaatgtggtctggtgcagtggctcatgcctgtaattccagcactttgggaggctgagaggggaggattgcttgaggatgggaattcaagaccagcttgggcaatattgtgagacccatctctacaaaaaagaaaattaaaaatgtaattttgtttttatttttttattttttatttttttggcaatagggtcttactcttttgcccaggctggagtgcaagggtgcagttatagctcactgcagccttgaactgggctcagacaattctactgcctcagcccctgaattacaagcatgtgccaccacacctggctaacttttaaaaaattgttatttatttgttttaaagacagggtcttgctctgtcacgcagacttgagtgcagtggcacagtcatgccttactgcagccgtgacctcttaggctcaagtgatcctcctgcctcaggactgggactataggtgtgtgctgccaccccctggctaattttttttgtagagacagggtcaccctaggttgcccaggctggtcttgaactcctcggctcacgcaatcatcctgcctcaacgtctcaaaagtgctgaattataggcctgagccatggttctcaattatttaattagaagtataatagcctctagggcatcatttcaccacagtgcttgcagcgtagtaattaatattctaaatgaagactgagtcaccaagaagtggttacattatgatggtgtgcccccactaagaaaacaagacagtaagtattctgttttagaaagatataaaatcggtaaaatccaaaggtactagaatgtgtaggcatgtcttattctgatatgatactggattgccaacttttggatatttataatgaaacacaatatacttacctttgcaaaggtgacacatttctcaacagttcagaaaaaaattaactgtgattcagtgtaataaaagcataatgaatagctatcattgtattctttaaactgtaatatttcaaactttataaagtttacgaagtcacatgtagatttccttgtatttctaaaaagagactgactcatgccggtaaatagatcagactgatagtgagaggtttctggatctccgttttctcttcattctttactttttttcttaatgagttcaaaaatgcttgagaattcatttgtatttcatattttaaccttcaaagctggaaactattttgagaaggggcaacaatttttaaaaaccagggggcaattagaaaaaatgtttaaagggaggggattaccatttttagcttatactcctactctataataaaggcggcggggggtggggtgtaaggaaaatgatctaatctacttgatcaagaaaagggaatgttaatagccctcagaaaatatattcatttactgaacagttatatcccttag

SEQ ID NO: 93862 - DNA, 1096 bp, Homo sapiens
taaaatataaaaatttctaaggcgagagactgaattgttcttatcattccttaagcatctcagagttggacacatgtgcctttaagtaacaaatgtgctcaaagttttcaaattgtaacttttgtactttgtacatatcctaggcacaccctccttaaaacaatcctatttaaaggtgaagaaattaatgctcaaagaacttgcctaagattatgtaactagttaatatggaaccagaatttgaagtctagattaaagatgaaacccaacttttccttcaatatctacgtctcaaagataagactgtcagtgaaataccagtaaagacagaagagagtacatgtgtatgcatgggaggtctggtggtgtatatcatcttaaatatgaaatatgaatattgtttactgttccataatgtaatggtgatagctttggttttttaaatgttgtggtggtggttttaaactttgaattaaattaagttccatagcatattatctcagtgtgagaaaaaaacagtacattctgccttattgtctgaatgactgaaacagtcatttaaatgatctcagtgtggtccaaacagctcttacattagaatctaaaacttgccctcagtgtaagccaacggtgtttttaacagttagttatttccctgaattttcctgcttatactgaatgaaccaatagcaattaatgttttttttgttttttgttttttgtttttgttttttgttttttttttttttttgagacggggtcttgctctgttgccaggctggagtgcagtggcgtgatctcggctcactgcaacctttgcctcctgggttcaagcaattctcctgcctcagcctcccaagtagctgggactacaggcacacgccaccaagcccggctaattttttgtattttaatagagactggatttcaccttgttggccaggatggtctcgatctcctgacctcatgatctgccctcctcagcctcccaaagtgctgggattacaggcatgagccaccgcgcccagccagcaattgatgtttctatatgtttggattcttattgacccaacaaatacagtagtatagtctaaag

SEQ ID NO: 93863 - DNA, 1034 bp, Homo sapiens
gcactcatcatgcctgtcaagttgtgtgaggaagctttccgttctcactaaagaaagaaagcagtttcatttcctggttttgttttgtttctttgtaacaagtatttattgaaagcatcactatatttaaagaaattatataactgaattttccatagcaagtgatatatttgatacagcatttttaaaggcaaaacagaatcttcgatatatctatgttagtgggaggtcaaatgctattataacttttattttttaaccataactataaaattaaggcttatttcaaaaatatagtactatctggggtgtgtgggggtgtatgtgtgtgtgtgttaggggatggtgggcaggagggctgtggaattacagcaatataagtttcagtggattacagatttgcattctttatgttcttttcatcagttaactaatttactccaataaaagtgctcacaggattttcccccttttgtaatttctagcaaattattcgatgtagagtttggagagaccataggtgatcagctacaaaatcttaaaaccgttttcttcaaagaatgagtgaggaaaaatcttaagtaataagatcatgtgtaacaatgtactgatggaaaatgcttacctcaataaactaatgctagtgaccgaattattcattggtgtggattcatagatacttaaccaaacagttgatgacaagaatgttgaagaaataccaagatcttcagcccttttaaaaattccgtctagaggccgggcacggtggctcatgcctgtaatcccagcactttgggaggctgaggcgggcggatcacgaggtcaggagatcgagaccatcctggctaacacggtgaaaccccgtctctactaaaaaatacaaaaaaaatagccaggcgtggtggcaggtgtctgtagtcgcagctactcaggaggctgaggcaggagaatggcgtgaacccaggagggggagcttgcagtgagccacgattgcgccactgtatcccagcctgggtgacagagccagactccgt

SEQ ID NO: 93864 - DNA, 3038 bp, Homo sapiens
tcacactaaatttaacagcaatttttttgataactcattttttttgtagtctttctagaacattaaacttagttttcatagaaattgcaattctctttgtatttaattaacttacataattaaaataacaactggcataaacagacttggggaaaacttaaactcttggtaagtttaaaactcaattgagtggagtagaagtatacagaaaaaaaacaggaattggagaataacctattaaacatgaatatttagtgttcttttggcatcagtcggtatgctttacacagatagtcctctgatttgggtaacttgaggtcagttaagagaccttcatttgtcccccaaaatctgccaagatggcaaagtttattagagaccatttctgtctaaaggggcaatcttcatggggtgtatcgccttagaatttttataaattctttactgaagatgttaatagcttctggaattttcaaagaaatattgtccttattgaatgaaaacagtgcaaattgtattagctgtatgacttagggttttgaattatataataatcacttttctatcgtttgattttttttcatttgtttaaatgtgtattgttccatgttatactttattttacagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaaggttttaactgtccccaagtacagagctagggaatggttgtaatgatacctaaattctgtgacttgggaaaaagttagctatccaaggattctgagagaaaaagctggtggctttatttttcccttcttcattgcttataatttatgctttatagcccattggggaataaagaattaaggtcacaatttctcagttaaaactggaaaaaaaaaaaaaaaaaactaagttataaacaatctgatgaaaagaaggcaggaataacctagtcgaaaaccaaacaatattttcttaaccacatttttgaatacttttaaaatatgtatgtaactatgcataaatttatagccatggatagaaaatggccatatgtaattgtcctcactgtattttggcatcattacaaccttcaacctgcaagggcccatctcaagtggctcttcactgtggctgcatctcagtttcagttttgggtcttgggaggataagttcttgcttgagtagagaaatgaatccatttcacctggtcttttctatgctaaaggcttgcttgagggcttctgtgtccgtaataattaatattttaaagttatgagaaggggaaaagggagaaatattctaacaatgtgtgtgagcctaaattgagaatctaaacctgcatgctgggagtacagtgctacagctgcctcctaatcaaatattgagaccaatctaattaaatttgcctgtttagaaatgcttattcaagccttgtgattaggaatagtcatattttatcatcgtacttctgcttggaaatcttaggaaactattaaaccatttccagaactggctagaattttaataaaataaatgacaaccattcctaaaagatttaaatttttatttgatcaatttaatattttgcctcaaatcgctaatggaaattgggaaaaccaaaatacccttcacttgatcgatgcatgtttaccacttacaaaatgctttgtctgtgtgtctcatgcagattcttacccaatctaaatggtttgtagtttatctgcctggtctcctgtggagtttttcttggatatagcttattaacgttacataactttggattgtgtgtggtttaaggtggctttttataatcagtctctttaaggttctgatttcacttgatatcttctttgtcccagcatctttttttcagcttcttgaggtctcctggaaatgtgcttgccctcctaaattgctctttggatatactgttgcaagaagtattggagactggatgagtttgaggatagttagcaatgcaatgaaaaaatcatttgtaaagaaacaaatttcacttataagtatagggaatcaggattgccaataaccacattcttatataaagtcttgtttatttctgatcattggtaaaattgtccctaaagatataaacaagagtttataccttgttatatttagaaattgtcatttgtaccatatgtaatgtaattacctgaggacataattgcacaaaaaatgaaaatggcagccttataaaattcaatggctatgaaaaaatacaggtttttttgtaactacaaattataagaaacattactcagatgtaaggaaataatttttttctgttaacaaaagtgttttttaaaaaaaatcaggtaatatttgttctagtgaatcttctgagtgatacagaaaattataatacagatttgggaattgccttgtttaactccttcactcatccaggcagtctttcaactaatccttctcttttctggattagctttaaggaaatgttaattgctgcttttgtgttctgtttaaattgtcagttacatgtctttgatactcagaatttttctctaagaaattaatgttccttctagcataaaacgaccatcaccagctgaaaagtcacataattcttgggaaaattcagatgatagccgtaataaattgtcgaaaataccttcaacacccaaattaataccaaaagttaccaaaactgcagacaagtaagtattgcactttcttcattatatctgaaaagtaataattatttggctattatgtttgcatgtacagttatgtatgtctggtttgaatctttttttttttttttttttttttttgtgacagagtcttgctctgtcgccaggctggagtgcagtggcaccatcttggctcactgcagcctctgcctcccaggttcaagcaattctcctgcctcggcctcccaa

SEQ ID NO: 93865 - DNA, 3368 bp, Homo sapiens
gatgctcttgtgggatattcattgttttataaaatagtgtatattagtagttcatcagtgagaaactttaaaaaatgctgatttcttactttcacttccagagatttatctagattatagcctaagcattaaaacttttacagtttcttgaggtgattttaatggttagccatataaacttataaaataaatgtgtttcttaaatttcttttctaggcataaagatgtcatcatcaaccaaggtaaattaaaaatccttttaaaaattttattttgcccttcttagtttaatttttgctaattgaaaagaatattttcatccagtgcactttatcagttcatagtaatcaaagaaaagtgcgttactgtagtcatttaggaaaaaacccagtttttattgtaaggtaatgtcatttttgtctcaaccagcaaaaatgtcaactcgcgaaaaaaacagccaaggtaagaataagctacgcagttggttgccttctaagtgaattttttcctggatctcttatttggctttttattatttatgctgcctgactttcttccttaaaaaggaaatacagtgatttgagctagatgaatccagctacattttacttttttttttgagaccgagtctcattctgttgcccagggtggaatgcagtggtgcaatctcggcttactgcaatctccacctcctggggtcaagtgattcttgtgcctcccaggtagctggggactataggcaccaccacacccggctaatttttggtgttttttgtttgtttgttttgtatttttagtagagacggggtttcaccatgttggccgggctggctgcaaactcctgacctcaggtgatcagcccgcctcagcctcccaaagtgcagggattacacgcatgagccatggcacccggccaatttttgtatttttagtaaagatggagtttcaccgtgttggccaggctggtctcaaactcctgacctcaagcagtcctcccgcctcagccccccaaaatgctgggattataggcatgagccaccacacttggcccggctgcatttttaaaaatccatcttatttctaagaaatctgaagattcaaggtgaacagtaaaaatacagtattacaaaaagggataaaatactagagggagttttctcccttaaaaaaaagttttacctagaaataaacgattgataaattttaactcagtttcctgtcttgccaacttcattgcaaataatcactcatttcttgatgctaagactgaaaatatgatgagtctagcaaatccatttcctcttaagtttttcttttatattgattgtaacttctggctacttgctgttgttggcttgttcagaccaaaaaaagagagcagacttttggcgaatgcgtatttaatttaattgcactgtaggtaagttttatacatcagttttacattctctttagattgcctgcaaatttaattgaagcatgctgttcttaatgaaagcacgtcctttctgtgcatggttttcacagctcatttctatgtttcatagttagccttattttctgttctattatagtaaccagctgcaacgtggttaaagctttttttagagatttaacttgatttctgtggatttttacttctttcgttccaaaaagaaaagaaagaaatatttgtaatagtctttaggtcatttgtttttacatagacattctaaatgaagttgaattttgctggcattcttctttagtaggtcttactttctcccttctttataatacaacatagattaagtaatgtttgagatactttaaagggaaaaatgaaattttatttatgaagataattcttaatacattatatatcaaaacttttaagagagagggtcttgctctgttgccccggctggagtgcagtcactgccttggctcactgcagccttggcctcctgggctcaagcagtcctctcactgaagcctcccaagtagctgggactacaggcgcgcaccacatacctggctgatttttgtatttatcatagagatggggtctcactttgttgcctaggttggtctcaaactcctgggctcaagcagtcctcctgcctcagcctcccaaagtgttgggattacaggcgtgagccaccacttctggtccgaaaacttttttttttttttttaaatagagtcggcggtatgtgataggaagagcagtgaatggggaataactgtgtttagtggttggtcctggctcttatgcataatagccttatgacctaggctgaatgacaatgtctctgagtggttttctactctaaatatagtaactataaagcttatttcacatgactactgaaggatgaaataatatatatgaaatataaattgaaatatagtggcatctactgaaatagggaacatttgaggagaaggagatgtgtggaaaaggagtttggctttggacaattgcatttgagttgtctataaaacttaacctacatgtagagatgtatagcaaacaatgtcatgtagatgtttaaacacatggattttggagtccagagagtggttttaccattgacttagctatagtgacattgagcaggttacttcaacctccctaagtctttgttttctcatctgtaactgagataataataagccattaaagggttactgtaaaaattatagtaataaagtgtacccagtacctgacatataataccaggtaagttttagttattaatatatgaatttggcagtaaaaccttgcactcagatttgtattatcagatgaaaagataattattaaataggtgagagtcattgactgtaagttgtatagctattttagaagtgtggtattcattttgcatggcatattcacaacacattttctagtatttcagctattaatgctaatatttgtcattttttgacattctttttaaaatatgacattaatttagcctctttttgacaatgatagctgtggcttgttccaaatcatctgctttgatttgagaagaagcctatttacatatggtacatttaggtgagtggtaacagagaatactttacctgaaaggcctgtgtccttcagacagagcagagtaggagaaaagctagaaagctgcatattccagtcaccacttaggcagaagtcaggaaactggttgttgaaagcaatagaaagtgaaatgagatgtacgcagggcaatctctgaggttaggtgtgagaggaagggcaggttatgccactaaaaagaggctcttactgacctatatgtttataccctgaaacctaaactttttttcattactctctcccctagttctgctgggttgtgctccagatacagcagagataa

SEQ ID NO: 93866 - DNA, 1076 bp, Homo sapiens
caagtcttcctcttactgtgctgcctccctgctctaggattagattcattgttatttaccatttcagtacagtgatatcctaactgtacaggtatatcaaaatggaaggacagttataatatcttagaaaattgagaagtaattgactgttagctacctgtccaaaaatggcttcagattaaaaatacttgaaaagtcattttgaattatatactgtctaaaatccctcagtaatttattgtagccaaatgctttatcaaataatttaaaaataaataaaacgaactcatttataaaattggggaaaggaaaaaccctgaataatcttgtcattctaacaggttacagttctgatgtgtttctttattgttctttatcagatatacattttatacattcattcattcatttaacagatatttactgagtgcttattttgtcagaccctatcctaggcattcagagttacagtagttacagtgttgaactgtgtggaacttacattcatgctccatagacaaaacagataaatacttcatatgtcaggaaggtgatatatatgaggaaagaataaggagagcagagaattgctattttatatagagtagttagggaagacatttctgatatggtgacctgaaggaagtgaatgaaatatgaagtatgtagataactgtaaaaaggattttatgaacagaggaagccgttcataaaagtatataagtatataagcctctaggcaggaactttcttgctctattaaggaatagcaaggaggtcattcatcatagagtacatacaattttgtattatttagcaattacatttataaaatacagattcattccaagcaagagaagtttcatgaggtacctcatgcaggaaagggaagcaaagtgatatagcagaaagggcaaatgagtagtaaacatgagacctagttaggggtaaaatgacctgtatcacagaaaattaaagaatcacagttctacactatgagttagataactcataactttgggagaagctgaaaattccatttgctaaaggaaatgattttagaaaactaaacattg

SEQ ID NO: 93867 - DNA, 1059 bp, Homo sapiens
ttttgatgtgtgatcagtataaaaaaattattagtgagatattttacttttcctttcatactaagtcttcaaaatctggtttgtatatttccagtatatctcaattcagactagccacatggtaagtgttcagtaatcagtgtcttgtcattttagacagagcaggtctagatcatagttttagagtggaaatgtttcccgagttctaagtaatagaattttggaacaaagtctaaaaatttatttaacctctctgagtgttggtttccccttctgtaaaaggaggttagactaggagagctataagatttcatccagccccaacattatatgtgtctggggaaatgaacaacagcctttatgaacaatatcctacagaatttcttctttaataattaaactactctatcactgatcagattgacttaagaatatttatgttgtttgaacataagttagtaagtgctaaagctgagattcaaaccaaggtctgtatcacaaagcttgtcttctcttcactccctctcagtcccagaaattttcaccataccaaggttggagataaaatgttgagtctggttatatttaagttagcatcagcttcattattgaatacctcatactgtgtttaactatcatgaggcaggtagttttcctcactttccttttctggaccaccagactttgtattgttactgatctcgtattctgctttgatcagtcccatcgcccatcccttattgagtttcctggtggtttatagtgaagacaggtagaaagtagcattgggataatacatactgactataagttttatgattgtaagatcaagaagcccgagaatctcaggaaaaagtttgcagtgagaatttgacaatgactggggagaaaagaggctcctcttcatctatgtattttacctaatacccaaggtaaagagtgtcttcctaaaagaagaggttgcaaactggtgttgtgtgcaggccaaaggtatgttttcatatgatgtttccccttttttggtagaggagtaaacattttaaaattggcaggtttcac

SEQ ID NO: 93868 - DNA, 1050 bp, Homo sapiens
cgcccggctgtctttttttattattattattattattattaatagccatccgacaggtataaggtaatatttcattgtgattgtgatctgcatttctctgatgattagtgatgttgaacagttttttgtatacctgttggccatttttatgtctttggagagactacaaaagaaaagatgtccttagtccattttaaaatctgttatttaactattgagttccttatatatttttgagattaaccctttattagatatatggcttgcaaatattttctcccgttctgtaggtggcctttttattgttgattgtttcctggcataagaaaaagttatgccgtttaacatctgtaggttcatccagtagcgtggtagacatggttgttgtctatccaaataatctcactcttcttttcaagtgttagaaaaactgctgtcacaaaattttctttagcatttttctactcagccttcctggacttcttgtagaaatgtgtcaacttagataaattatattttaattatcaaaaaattattctcagttaaggaaatggccattggtttatttttccctacaatgttttagactaggactttatagtatcactttgttttctgtatgctgtgtaatgtagttggccctctgtatccatgggttctacatccacagattcagccaaccatgggttgaaaatatttggggaaaaaaattgtctgttatactgaatatatgcagacttttgtcattattttctaaacaatacaacaactatttacatagcattcacatcatattatgagtaatctagagatgattcaaaatatacaggttatatgtgaatactatgccattttgtatcaggaaattgagcatccatggatttgggtatctgaggaaggtgttcctaaaatcagtcccccgtggatacaggacaactatataacaaaaacaattgtatataatgagactaaaactttgaagtagtcatttttgtcttgtttttattgtatcacgttaataatccacttttgtatgactatacagaaaat

SEQ ID NO: 93869 - DNA, 1050 bp, Homo sapiens
ctctgtggcccaggctggagtgcagtggcacgatcactgctcactgtagccttgacctgacctcctgggctcaagtgattctcccacctcagactcccaagtagctggaactacaggcacaggccaccatgcctggctaattttttttattttctgtcgagatggggtctcactattgcccgcactactctcaaactcctggactgaagtgatcctcccaccttggcctcctgaagggctaggattacacgtgtgagcactctgcccgtccaggacatgagttttctagttctagttcagtcttcttcattgtaccttcctaattccttaagtatccatgaaaaatctgttaacaacttgaaaactgtgtttatttaaaaccttgactctttttctgttaagatatggttatcgaggaaaggactgtagagctaatgtttaccttcttccgaccgggaaaatagtttatttcattgcatcagtagtagtactatttaattatgaggagagaactcagcgacactacctgggccatacagactgtgtgaaatggttggtatcatttaacattggttcatttttgttctttcaggccctcattttgtattttttaaatttgggttttattgaaagtgatttcttgtggaaagctcagaatgtaaaaatattatgggtcatctgttgaatatattttaaaaagaaaaaaaggactttcggcctccaaaatggtggtgtggtatcagcagcaacaaaacacatcctccataaatcatgattggaacctcttctgctttctcatgtcgtacagtccttctcttctctggtctgtagtgtgaaacatatatgggacagactggacattttcaggtttctgaaagtgattattggttactcgatatttattgaggatttgtcctatgtagataaattttatacttgaagctttattcttttgggaagaaagaaatctagctgaataaggatcataagtatgccgtaggatgtcatactacaaatgtgagaactccttttaaatgcttttaaattatt

SEQ ID NO: 93870 - DNA, 1062 bp, Homo sapiens
ttgaacttttggagttgattaaaatattgccttttacacttgcagaataatgtatgtacaaaactatttactgcagcattgtttgtgatgaagattagaaacagcctaagtatttttcagttggggactactggtgaggttgtagtgtacctataggtcaccatgtagctgtaaagaatgaggaagcactttatgtattaatatgtaaatatccctctgatgtgttcttaagtacaaatatttaagagcaagagaatgttcacagtgtacaaccgttgttgaaagagtctagatatggacataaagatgtctttttcagaaatttgctagtcactcatatacgtgctgtgagtaatttaggcacatatgctacgctacttcccatttctatttaaaaattccttgcctcagtttgacttacaagaatttagcgctaagaactaattaaaagattgaaagcactatgtgtgaagatgctcattgctgttttcttttgttgaaaagtaagaaatggcctaaaagatggaagagttgtcaagtcagcatgtatgaggattatgtagcaaaaggaaaaaatgcttgtactttaatagattaaaattaaacagcacaatattgcatcttcactataataaagtcgtgtgatttgtatgccattgtgcgtggactagaaaggaacttcagcaaatgaaaacagttcgttagcatgccacagttataaatattttctttgaacttagtgtttcattaatctgtgcagcttaacaagtaaaaagtacagctgaaaattcagaaatcttcagatatttgatgattgtttgatttgctgaagaaaacagataaacgtatgttttttaacgattaaaaactgcttatttgaaaaatgtcagtacaaaggtattctgttgtttcatgtttcctgtgtttaaaatcattcttaatactgctttttagccttgctatacatcctgacaaaattaggattgcaactggacagatagctggcgtggataaagatggaagggtgagtggcatagtgttatgccttctgtacctagagac

SEQ ID NO: 93871 - DNA, 1518 bp, Homo sapiens
gttaagaccatcttgaattgcctcataactctatcttttctaattcagataatattccaatttaggctaagagataaagaggagaagagagtaagctctgcccttcctcagtgcctctcactcttcactacaatgtttctctgttccataacattgtaaagcatatttcacaaatgatactatttttaaaaagcatttaatatcatctataggtatttttcttaaactggaatacttaaaatacgtgaatgagaatggtttcagaaaaacaggaaatttcattataaaaaaggaatttcattataattttacttaggttgtttattcaagttaatgtaagtcaggtatctcacagaaaactgaaatcagcaaactctaaaatagccatgaattttagcttattctgtcaaactgtcaaaatttagtgaggaacaaagttatgaaattgtgtacatttcttcttacctaccacaaggaaaaatagcttaatacaggcagcaagaaggaagcataagatgcagaagggactaggatagcctcaaaattagtcactatctctgaataataggagtgactagatggcaagtggaaataacctggagggatgaggggatttaaatagaatattttgtaaaagaatctttatatttttgaggaaaatacaattgtagtaaatagtgtattcattatgtttcagagagcgatgagtttaaaggattttgggttatcttactatttgcagttttaataagatggtatttctttcttagaatgttagccctatcagtgaattttaaaatgcctctgattgacttttctttaggattcaggtgttcatttatgtattattgatgactccaatgagcatatgcttactgtatgggactggcagaagaaagcaaaaggagcagaaataaaggtaaatttttaaaaaaccgagtattgtgttttagagtacgttacttgttttgcaggtatttggaactatattggtattagaactatctattcgtaagtcgcaaaagcagatctactagccaaattcagcaaatttagtgatttgtcataatcgttaagatattaacactatagttatacaagataaaatagtcaagcaacttgaagcaatttcaatatttcagacattactatagtcctgaaatgccagagtagatggatgtgtgatctcataattaagactgaacacacttcttggttttcttctttaataaaacatgtaatttcattccatctttaaagctttagaaatctagaggaaaaattcagtaggaatacgactgatgtaactgaagggcttatgttaagttttttggtcttaattgtgtttgtaggattattttagaaaattcaatagcatttataattgctataattgcattataactctttacagtacaagggttgatctctgtgtagatcaagctgtacgttgtaagagaagaatgtaaaatgcattgaagctgggtttatatgagccagaaatggacttctccctct

SEQ ID NO: 93872 - DNA, 1057 bp, Homo sapiens
aaatacaaaacttagctgggcatggtggtgggcgcctgtggtcccagctactggggaggctaaggcaggagaaccacttgaactccggaggcagaggttgccgtgagccaagatcactccatttgcactctagcctgggtgacagagcaagactgtgtcttaaaaaaaaaaaaaattgttgcgtgaatgaatgctccataataatagtacaaagaaagataagactttcttttctttctttcaatacaaatagcagtgtctttaagaaagaatgtacattgctcttaaattcgacagttttaagtgtacttttctggcatgtgcaagaagttaaaggtattcatataagtgtctttctaatgcagcgtttttataaatagcataaaaggtgatacgataatacaaggacatcaaatttaaatcatcccaaaaaatacattatcaaaatttttcaggaaaattgtcttagaagaagaggcattttctcaaaatcttgccctatcgttaattgtaagtagcagtaattgaattgatacttgaaggagataaggatatacattcatctaaagctttatttcccttttcatagacaacaaatgaagttgttttggctgtggagtttcacccaacagatgcaaataccataattacatgcggtaaatctcatattttcttctggacctggagcggcaattcactaacaagaaaacagggaatttttggggtaagaatcagattgttttaatgtcattaggtgtataagactttaatttttttaattgtttaataagcatcaagttgtcatggcaaaaagaaaactgaaaatttttattgtttccttgtagaaatatgaaaagccaaaatttgtgcagtgtttagcattcttggggaatggagatgttcttactggagactcaggtggagtcatgcttatatggagcaaaactactgtagagcccacacctgggaaaggacctaaaggtacagtattcttatattaaactcatttctggtaattctcacatagtactctttcagtcccatctcttagaccagg

SEQ ID NO: 93873 - DNA, 1063 bp, Homo sapiens
actgggctgttatttagccatcacattggtacagctgaatcaatttttaaaatactgaaattattctctgctagtaggtcaaaagccatcactgcaggtatccattgcctacctttgtcccaataacttctgtagtgcccccatatctcagcaaataaaggggagtaatccttggcacagcagaaggcctctgggttaacaatggttgtaaaacgttaaacgttgtgactgttacctcagaaggtcaaccaaagatgtttttgcaaagttaaaggaacatcaaggtgggagacttgagcctagtcacagctttgttattagctaactatgtggtatcccctaagctgctcctgtacctcttgtgtcttgagctctcatatcagaagagtgacacctaccctagctaccatacaagatgattatgagagatagtaaagttctgaaacctatactatatcccctttcgtctgtggaattatcactacttttgctttggttttttgtaggaaaatattttgaaatattttcagagtaaataaatattgacagaaatgcaaaagattgtattataccctaaactttactacctgctttgcacaaaagacttgctgaaaataggtttttgattgagtcatatgaactttctgattattaactctagttctactgaagttttcttccaaatagacactaaaatctgaagaaaagtattatcactagtgtttttatttttccctcatattaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggtaaggatggaaacggaatataaaaatattaaatactctaaactcaggtattttgtcccacattaagataacttatacttttctggcaaacttattaaattcttataatttcatttcctttcctcaagaaaggagtttgttgttgcctttaagataacttttttca

SEQ ID NO: 93874 - DNA, 1044 bp, Homo sapiens
ttaccctaccagacccccaattttttttgttttgttttgttttctgtttttttaatcttgttttcacttttgagacagggtcttactctgtcacccaggctggagtgcagtgcctcaaactcctgggctgaagcaattctcctgcctcagcctcctgactagctggcaccataggtgtgtgccaccttgcccggctcacttttttaatttttcatagagctgaggtctccctatgttgtccaggctggtctcaaactcctggcctcaagcagtcctcccacctcagcctcccgaagtgatgagattaggcatgagccactgcacctgtccggtttttaatctcaaccttttttaaaaaaaaagtccataccttaataaacagtatatcaaatatgacttaatcttgtagaatcaagattttacaggtagccctgtagcacttagcccacttttcagagaagattaatgacttgtcattggtgtcatcttgtgacgtaatggcagatcaaggacttgaacacaattctactaactcttagtagagccgactttccaatgtacagtaatgcctcaggtttttcatttcgtgtcttattttactgtacaactgatccagaagagagagcaatgtgtgacatggaataatcagaatgacttggaagtattgagaaatggcaagtttgtcaaatgcatgagacttgtcctaatccagttaggcagttctttgaagcgtttgaagaaagtattaatttgagatacccataggaactgttaaaagtttgcagtaccgtttgaggttgtaatgaaaggttcaactattctgcgttcctaattgtcttcggttttgtgctttgcttctagctttcagttcttgctgcctatttccaccggctggtcttatagtcagtcccctgcttttatctattgtctgctgttatataggacaggcaaaactgggtcaacactgtctctgctgcttactagtttgtgactttaggcaagttaacttctcagagttttaattttattatcttaaaactggag

SEQ ID NO: 93875 - DNA, 1081 bp, Homo sapiens
tgtcttcaaggagatatactagaatttgctcctgtgtttgtgcccatggagtaaagtttgaggcttttttctaagctgtgcatacactttgcattagcctgtgacttgggtagaggaaggacactgaggtgatttgtggggagggtaacatagaccccaacagctgcatttcatcttttctttgcttatttattggaattgatgccaggcagaaaatactttcatttctaaatatgagttaataactttcctaagatcttttctaaatttggggacttctcctactcaagagtcctttttgagaatactttatgttgatttaccttctgaaaataatctgtgtccaacatagatgtttttgcatgaatattatgtatatatacaatgcttttgatgctcttctaattgaactattgaaagctttgcacaaagctttgcacaaagatgcagatagtatttttaaatactattccattagggtgaaattctcagaggcctgtactttgccatgaccaatcttgttaaatcttcatccacgtagcaagttttaatttcagaagcatggcttccccagacgccagagccaggctcatgtgcactatgaaaaggatgtatgaaccctgccatactcagaaaatagccaacatccatgtgcatcttgctgtctctgaaaattgatttcttaagttagtaggtcccctgtatgcctagcaagtgattcccaacgtgttttccaatataccgcttaattctagtgatttcagaaagcttcacttctcagattcatataatttaaattggtttaaatatgtttatttcccatacagcactatggtggagattatggctccagaaaggtttggggacacatcggtagacttcagaagggtactaaaagaattagagtcattgttctaatgtaaatcattaaaaactatccctaaggtacactgaatttgttaacttacaaaataaaatcctggtcaggtgcagtggctcactataatcccagcactttgggaggctggggcaagtggataacttcaggtcaggaattcgagaccagcctggctaatgtggt

SEQ ID NO: 93876 - DNA, 1059 bp, Homo sapiens
attcccacagtgtgaaaacctaagcagaaaaagatcgttgtttcctgcttaaggaatgttttaaggaatcatgattttattgagacctactgttctgatggagtacagcgttgggtgaattttccccaaaacattctttagagatagtctttctaggatacctccatagaccatatacgggtgctgtattcctcagcttctgagttgtaccatggataattcagaagtagcccaggaaaactgtattcctgatgccttatgcacaacttataaccaacacttcattctcaaaaatggagtcactctcatggggacaccagtgacgtgaaataaggccagagggtgtggtatgtgttgcaatgtcctgtaagatacaagtttaagagactgtctttcttggaagtgtctaatacaggtagtaggtgctagtttctggtatctagataggccagaaagtttctcccaggtttcaagtgctgaggatttgctgtgagcctgctcagttttagagggtgtgacactgcttcctctcctttagaaattccaacaaatgtgtattcagaaacagtattggctagctgttgaactgtttatcattcagaactctaaatgctttctaacaatttatctgttattttctagggacattccagctacatcacacaccttgactggtccccagacaacaagtatataatgtctaactcgggagactatgaaatattgtactgtaagtatgaatgattttatatatatatatatatgctatgattatatttatatatatatatatatatatatatatatatatatatgctaagatgtgtctgtcaggggcgctaatgaacaggctgcatggaatctgaattgtgcagagaatgcttgccaacctctttaacctgacaaagcatatgttatgctgagctaaggtaatgagaatctcaaatgtgattcacttctccaagagtaatgaattaatgttaatagtgtagaacagaaggcacatatagtaataagaaattactctgtcaaattgatgctgctctgaatggtttttca

SEQ ID NO: 93877 - DNA, 2140 bp, Homo sapiens
atgtaaagtgataataaaaggaaataacggctagccttactcctgagatttgatgacttctggctttaaattggattgcccatttcacaagctgagtttaccccccttacgtatcacctccatttctgaaacaggcatgtcaagaatgagtttaattttcctgtctgtctgatttatttcatataggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgcaatggtgttgccttctttaaaaaatgccgttttcttacactaccagtggatgtccagacatgctcttagtctactagagaggtgctgccttttctaagtcataatgaggaacagtcccttaatttcttgtgtgcaactctgttttatcctagaactaagagagcattggtttgttaaagagctttcaatgtatattaaaaccttcaatactcagaaatgatggattcctccaaggagtcctttactagcctaaacattctcaaatgtttgagattcaagtgaatggaaggaaaaccacatgcctttaaaactaaactgtaataattacctggctaatttcagctaagccttcatcataatttgttccctcagtaataggagaaatataaatacagtaagtttagattattgaattggtgcttgaaatttattggttttgttgtaattttatacagattatatgagggataagatactcatcaaattgcaaattcttttttttacagaagtgtgggtaacagtcacagcagttttttttaccaacagcatacttaacagacttgctgtgtagcagtttttttctggtggagttgctgtaagtcttgtaagtctaatgtggctatcctactcttttgggcaatgcatgtattatgcattggaaaggtattttttttaagttctgttggctagctatggttttcagtacatttcctactttaagagtaattactgacaaatatgtatttcctatatgtttatactttgattataaaaaagtattttgttttgattttttaacttgctgcattgttttgatactttctatttttttggtcaaatcatgtttagaaactttggatgagttaagaagtcttaagtatgcaggcgtttacgtgattgtgccattccaaagtgcatcagaactgtcattcccttctaatatct

SEQ ID NO: 93878 - DNA, 1155 bp, Homo sapiens
ggagaagaaagagcatttctttaagtacctggggaatacagctctcagtgatcagcagggagtttatttgaggacatcagtcacctttggggttgccatgtacaatgagatttataatcatgatactcttcggtggtagtttcaaaagacactactaatacgcaggaagcgttccagctatttaatgctggcaactactgtttaatggtcagttaaatctgtgataatggttggaagtgggtggggttatgaaattgtagatgtttttagaaaaacttgtgaatgaaaatgaatccaagtgtttcatgtgaagatgttgagccattgctatcatgcattcctgtctcatggcagaaaattttgaagattaaaaaataaaataatcaaaatgtttcctctttctaagtgcgtcttaactctttcttcatttatactgagagtttccatgactatccagttatcagaaggcatgacaattcagaagacaacatttatcagtgggctactgctgctgctgtggataaaatcattctggtagtaacaaactcccatctcataatgttagaggaaattacttctgatttatgctccccctgaatatgtggatagctttgttttcacttatttcatgtcagcactttctctaatgtttaatattggataatcctgataatcttcgttacccatccgactaggctgcctcgcagtgttagcctttgtgaagtacttgaactcagtaggccatggcattctctgctttctcccatctctcccatgttgctttttaacgcagatcttctgtataccacaatcacaaattggctactacaaatgtttctttataaagaataggttgattgatagtattccaaacattccccaggtttacaatcatagaaatgatggggttttcattattgccttactcgtccctggtgactgaatattcacagccacttacttacatatactaatccatgagaggctatcctggggtaggagttccattttcactgattctgagacagaatggctagtgggcaccaaaacaaacccactcaacaatgtgatttttcttcacaagtaagaaaatccaaaactacttctatggcgaaatgatgaattagattttgggcacattgaggtgttgtatta

SEQ ID NO: 93879 - DNA, 1050 bp, Homo sapiens
aattgcacaggtagagatttgtaagtcagcttgacagcaagcagttggtgggatggcattttccattggttgaaaggcatcttccttacctttctctgaattgcgtcaaaaataaattgaggccaataagcacatgaagatgtttaacattttcagttattagagcaaatcacaaccacaatgaggtaccatttagtatccaccagaatgcctagaatcaaaaagacagatgataacaagtattggtgaggatgtagagaaacgaaacatgttacatttgtggtggaaatggtaaaatgacgcagccactttggaaaacagtttggcagtttgttaaaaaaggaaacgtaattttactgtgtgatctaggaattcctctcccaattaagatggcagaatggtattctaggtaaagggaactgtgagagtgaaggaagggagggggtctggaggagaagcattgggtaggtaagtttgactgtggaggatggaggtaaatcatgaagggcctagtatgtaaggacttaattttgtgaggcactagtaggaagttgcagagcaacttgatgcagagttgtggtagtttgtcctttcagatgagacagatgttggggatgaggagggagggcttcagcatgattggtgaattggtgcttttcacagtgacagggtgttcctgaatgggcttaggagtgaattttggacatgatgagtgtgaggtgtcagaaggacatggaggtaggtggtgatgtctagcttaccgttagaaataaatagaggtcaggtgcggtggctcacactggtaatcccagtgtttccggaggccagggcaggagaattgcttgaggccaggagtttgagaccagcctgggcagcaaagtgagaccccgtctctaaaaaaaaaataagaaaaattagctgggtatggtgaagcgtacttgtagtcctagctactcaggaggctgacgcggaaggatcacttgagcctaggagattgaggctgcagtgagctgtgatcaatgcgttgcactccagcgtgggtgacagtgt

SEQ ID NO: 93880 - DNA, 1052 bp, Homo sapiens
aggagtttgagatcagcctggggcaacatagtgagaccctgtctctaaaaacaaaaacagatgattctaatctcagataagaagggcaagttttttttttttttttcgggggttagtgggggagttgcggtgggaacgggaaggaagagtttagggtttataaatgttgagtttgtgatatgtcatgcttggtagcagctagatttttgaatatggagtttaataaacttgggtgtcttcagcccataggtggtaatttgtagggaagaaaggttggattatagttagagtatagaaacatgagggaagggtggagaaggagaatgtgtttaaagaatagtccggatgagaagggaaaccagtgtggtctcactgaaaccgaattggtaatgacttgtaaggaaggaatagtcagcagtgttgcacttcttttacagattatgtgagaaaatggccatttctatcatctgcttctatgaaatgtattctccagtgtatggatattaaatgttacagtttgatgagtttggacaaacccatgtactgtataaccacacctccctcaatatgcaagatgttacatcatcccaggaagttcccttgtaccctctgtcaatccctgccaccttcttattctgacttttatcatcataaatagatagttttgcctttttttgaacttcatgtaaatggaaccagctctgacccaggctggagtgcaatggcacagtcacagttcactgtagactcactcctgagctcaagtaatcgtcctgcttttgcctctgaaaatgttggaattacagatgtgagccgccgtgtctggctgctcaaaaaatatttttgaggttagtccgtgttgtacgtatcagtagttaattccttttatcctcttattcttctgtgggatttcattttataaatatatcacagtttattctgttggtggtagtagatgttcttttatttatttttttaaaatattttttgagacaggttcttgctgtgttgcacagcctgatctcgaactccccggctcaggcagtcctgtc

SEQ ID NO: 93881 - DNA, 1030 bp, Homo sapiens
tcaatagcaccatgttagaaatgttcttctgctctaatttcccctcattcttaataaagacacaagacataatgaggcaaatgggccctgtatttggaatgcaaatctggcctgcagagccacatcctggcagagctgtctgggaggaaaatagtcacagcagcgctctccagaagagtccttcctgaagattccccagctgaacctgggagctcagcctacagcactttcctccggaatgagagttggtgactctgggggaaatcctaaggcaaaactggactgcccagagaaacaaataggtgtccccaatgaaccttgctgaaaagagtccaaattggactctcggagaaaatgaggggaaatgaaaatataagtgaatcaatcatggtttcagacagatttggagctaggaagataacagcctgtgaatgctggtgggagagctgttctaatagctcactgattatttgttaagttttcgagtcatctaagagaaacaggcctctctaaggaaagaacaaagactttttcagtttgacagttctgagaaaggtgaggaataagtccacatgatcaaaatggccttattcagaggagtctgataaacaacacagcagccttgtttccctgggttttaaaatttttgtcttcctcctgatcattcacgtatatcatttctcactccttcgttcacttttgcccctggggattgggtcatgcagcaatcaggaatacatccaggaacaaaatattaaaggcaccatccttgttctgcattagagagtgaacattgtagagctacggaaaatgaagccaatctttcacccaggatggctcagaatagatcattccctgggatctgcatccaccattcataaatgaatccagagcttttctaaaggagcttaaaagattttattcctaatccattttttttcttagagctttggaaatatggctctgtaatttaatgattacaggagatgagcaaaagaatgaactaaataagatagcatcagcttgcttt

SEQ ID NO: 93882 - DNA, 1030 bp, Homo sapiens
tggtgtttcagtaacagctgtgcactaccacccctgaatctgctaccaccacagtgttgtattagagaatcagcaggtgggggacacccatcctcccctggcattacccactccctgacacccaggatgtgaaggaaggagatcccaaagtttcaggttgtaactagtagtgcaacaagcaaagggccaaggagaagcagagactagaggaagggaccaggtgacctggcagggcagggagatgtgggctgcagcatggactaagagcagacgggagacaaactccctttccctgaatgcattagaggaaggtggcagggagagcctcctgagttcatgcctataaggcatttctgacatttagcatcattttcttaggcataggctttggtacatcttgactttatttgaattaaactgatgaaataattatttagcgaatttcagatgctctaattgttatgaataaagagatccctaagattttgctgtatctttggtaggaaaaatagggggccaaattttaagatactgatatgagtgcctggcaccgtaaaaacatctttattgatggaattcatcaaagacaagagatataaaatgtttaggccgggcgcggtggctcacgcctgtaatcccagcactttgggaggccgaggcgggcggatcacgaggtcaggagatcgagaccatcccggctaaaacggtgaaaccccatctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagagatataaaatgtttaaaagagagacaagtgtatgctagacatctactcttgattattgagaaggctgggaaggacagctttctcaggaagctgtagagagaaatttggtctgttt

SEQ ID NO: 93883 - DNA, 1060 bp, Homo sapiens
tttgagacggagtcttgctctgtcgcccaggctggagtgcagtggcgggaccttagttcactgcagcctctgtctcccgggttcaagcgattctcgtgcctcagcctctccaatagcttggactacaggcgcgccaccacgccccgctaattttttttttttttttagtagagtcgggtttttgccatgctggccgggctggctgatttgatattcttgcgttgacagtggcccaccggtggagcagctgcccccagaccccttgacccggtggtgcttccaccctgccggaagcaccttgtgtggccccgccaacagcatggcggttgcatccccaggaagcaggcccgcagcgccaggagggggtttcctgaggacagaggcccttgtcctgattgtcgcagcaggccctgtcgatggacttaactgtgaaaatcaccctttcaggggtggatgcaaggacttctgagggcggagaagtagataccttcctggatagctgtggagccggggtcctgcatttccctctggcgtctctgctgactgagatgtgaagcagtcggcccatgtcccgagaagaggtttcctttgatttattgctattaaagttgttgctttgagagctgggcataaaccataaaaacagtggggaatcacaagaaatttgtgataattgcatttaagacaggaacccattcgtcaggtaacacttatgtgctattaatcagagcaatggtttctaagccacagggtttgcttctcatttgagttcttctttatattttatttttggaactaatcaggtttttgttttctcttggggaaaaataatagcaaatgtcagactgaacattatgtgtttggattattttcacaaatttaaaagaattaagagccagtgtgcatggttgaacttttggatacctgagaagataattaatgttttgggttttttttttttttttaaagggacggagggggaattttcatagtctatcccgaacccccatctttcattgatgtcttaagctgacaaggtgatggatataccagtcagaag

SEQ ID NO: 93884 - DNA, 1033 bp, Homo sapiens
ctggagtgcagtggcacaatcttggctcaccgcaacctctgcctcccaggctcaggggattctcctgcctcagcctcctgagtagctgggataataggcgtgcaccactattgtctggctaatttttgtatttttaatggagatggggtttcaccatgttggccaggctggtctcgaagtcctgacctcaaatgatccacctgcctcggcctcccaaagtgctgggattacagatgtgagccaacatgcccaggctaaacttaaaaaaaaaaaaatctaccttgttattagtttatatttgggatgatgaatactttctattttaaggaaaatattttgaacatgaattcagttagcactgaatgtcattgcatcagactatttaataattaaaaatacatagacactataagtctttggactagagcataaatctggagtacattattttccactttttgtagtagttaattattttttgcttttagggccccaaactgatggcttacatgttaatgtaccaaatgacctatgacttagatttgtattatccttcattttagaaagccattgacttgaaatctccaaagataaacttttaggccgtttttaacttgaaagtaaagaacagatttacttttgtaaaggtaacagaatgtagatttttaaaatatattatgaataccaagttatggattatattctatttaaattatttatgtaaagataaatgtatgtctgttttgcactaaaaaatatcttatgcattcaaccatttttatacaatgatagttcagttttatgttgaaataatttttttttttttttgagacagggtctcactctgatgccaggcttgagtccagtggcgagataatggctcactgcagcctcaacctcctgggctcaagtgatgctcccacctcagcctcccaagtagctgggactacaggcacatgccatgacacccagctaatttttgcattttttaatagagatggggttttgccatgttgcccagggtggtctcaaa

SEQ ID NO: 93885 - DNA, 1032 bp, Homo sapiens
gtgttttttgtttgagagtaacattttcatttctaaatgttttataatttctcatatcaatgtcagaagtatcctggaaacatatgtcacatgcgggaactgtttaacaaatactttaaaaatttggccaaaatttaaactgtataatggagctagatacaagcaagaatagtatttgaaagacttttccagcatacttctcaattctttgctttatttttgtgccaattattcaccttatcgtgccgcttcatggaagcttgagtatgttctcccttttccattttggatttatctctttactgtaatgactcaaaaggtatttaagaattgacgagagcttgtgttgtttagcatcttactggataatatttgaattcattgctgttcctaggtgataactgtcctaatatttagatgtccaaacaagaatacttccaacataaaaattataataggaataatttgagatgactcaatattacaacctcttcttctcttaacctcctcccccaaacactagaggtttaataagacttatcagatgaaaggatatttatatagccttttagtagcaaagtcatacttacgtgttgtcactggattatcataaaagggagaaattaaatattactgtactcttagttgctgtgtagctaagtcaattttaagccagtaaaagcgatggatacataatgatttgatctgatctttaactattgtgaatcacagctacaccaaaactcttcttgtaagaatactgactaatatgccatgttaatctggctagattattaggactagataatgtaaaagtgatgattgtttagtaactaaattttagcaacagaaattagaattttgctttttcaaccagttaccataaagaagttagtgtatatataaacacaaataattagtgacagattcataaaaaattgaatgttgtacacagtaattttgtcagaggtagagaagacagggattgggaagtggtgggtgatggaggacctggatatatttatcaaataa

SEQ ID NO: 93886 - DNA, 1035 bp, Homo sapiens
actggggactgtgttactttccattagttggagcagatggtacaaggcggagagtggcagatctgaagctttggatgataactcatgcattttagctgttatctgtggagagttaggagtcagcaatacctcagtactcagagtattcgagtattgctgcttttagtactgcgaatgtttttgtattcatgactatagactaaaacacttagcttattgtttcaggaagaccttatagtctagatactttgaaatatccctacctttgtttaaatcttttgttttggccaggctcagtggctcatggtctgtaatctgagcactttgggaggccaaggcaggtggatcacttgaggccagcagttctagaccaacctgggcaacttgttttaatgtacatttggaaactttgtgtgcgtagaagtatcattgtcctaatgtttgcagtgagtacctagtacacagtagttaagtaagaataatctgagttgagcactggacacattagttacctgttgttaggaaatagcaaataatgatatcagaatgaactacctcgcttttcaaaatgtcatttgttgaggcagcccccgctgcagccaccaccgagcctgccaccaccactgagcccactgccaccgcctctaagcagaagatggttaagcctcccacgtacgctgatcttggcaaatctgccagggatgtgttcaccaagggctgtggattaggcttaataaaacttgatttgaaaacaaaatctgagaagggattagaatttacaaactaggctcagccaacactgaggccaccaaagtgactggcagcctgcgaaccaagtacagatggaccagatatggcctgacagttatggagaaatgaaacactgaccgcacaccaggcaccgagattgcgtggaggatcagcttgcatgtggactgaagctgacctttgattcatcgcttgtcacctaatgctggggggaaaaaatgctaaaatcaaaactgctataggcaggagcatatcaacctgggttgc

SEQ ID NO: 93887 - DNA, 2210 bp, Homo sapiens
gagccctccgggtaggacgcactgcttctctacccgtcccgtccgtcctgtcgcgtctgtccgtcccgtccatacgtcccgtctccgtcctgtccgcctccgggcgaccgagccagcggggtgcgcgcccagcgaggcccaggcgcggccaactacgggaccggtcggtccccactcctaccccgttgtccggggcaccagcggggtctggcccttacactagacgcacctcttgagggcgaaatcctcaggcatggggaggggcgtgtagagatagacaaatgtcccctctttgtagtttacttttgcgcagagagcaacctgctaattacatttttctgaacttttattgttagggttcaacaattaagccttgaactaagcgcagtttgaattatttgccaatttttggtagtgtttggaaagatggattcttgttatggtgaaatgtgcactctccacacattctatacactctgcccccggcatactatgtgctgtaatggaatcgttatattataaagcaggttaatttatcgatagactctaaataatggatgtctgtgcccttttcttcccccttttcctacaaagtatggagttagcaaacctcttgtccaccgtttggtagcaaagattcacactgcgactttcagagggtctatgatatgggaagggaaaaaaccattaccttgagaacaaagaaaaatctaaactgtcctaaatccagaaaacagtatttgggtaaatttttttttctactttactaggatgaatgggaaaatattgcagtcttttcttagactgtcttaccttgaagtggtgatagcactttcctgtttttagtacaagtgagcatattcagtgggaggaataagcagactaaggatggactttcaaagaagacagccttttggggcacaaaacccaaactgcatattatagtttatctgtttgacactgtcttaagatcctccttccattcattttttaaatttaaggttgtgccctgtcatgttttactgataggcatgtacatgttcggaacggcggccttgctattgcagtggattacttctacataatattcttcctgtagggagtaaggatttttatataaatctaagaagtaaataaaattgtctagtgccacggagtctattatttcttcttggcttgaaatcgaagatacatgctttgaaaggaaattcattaggaaactcattttgtttagtgaattaggttctaacagttttgaatttacagataagagttacttatttggttctccaacaatacaatgaaattaatttatttacctaaatacataaatgccttttttttttaaggagggctttaggaaaatggacttggaattttgattctccagtaactgtagaattctaaggttagtgaaggtttgagctacattagcaaaggaaacaggagaattgaattattattagtgcagataatgagggagttgactgaaccagtatatgagcaaaaccagtaaaatacctcaaatataatcttagggggagggagggtgttttgggagagggaaagggccatatggagatcattaatgtaaagcatttgtaaagaaatgagagaaatgcatagtaattttagggagagaaacacaagaaacaaaaaagggaagacagagatggaaaagagggagactgcaaaagaagtgaagggagaaaagtaatgcttatttgtgtatatgtattttatgtatgtgtataattattcaagtcagagctgtttcctagatacttagatatttcaggcaaaagcatgtttttcttagcttaatggcccagttttagcttcactgtctgagtgtaggtatatgaaaaccaatatctgcaatcccaaacagataaactgcaggatggccgaatgaggatgctgctcattacagaggaagctcccctctgcccttcaacagagagggcccttaacctgtcactttaagtatagtcgttaaaaccctgcttgcttgtggttgctgaaattagtctttctaaaacatcattctcattatttgaccatattttgcatctgccaaataaagccaaaacttctttcttggccttcaaggctctttacagtttgatgacaacctgccgatcttgacttactccatcatagtttgcaaacatcttttgaatatctgttatgttcaaggcactgctggt

SEQ ID NO: 93888 - DNA, 1761 bp, Homo sapiens
gttcatttagcagattgctggatcattacttctggagaatgtatttgatcacaatattatgaaatatagaagcactttggttagaaatttaatatgatttcagttttaaggggcactgtttccacaggactatttcttaatctaaaatacggctgctggacttcataaaattgacaaatttactgcagcacttatattcttctttgtatttgagtatatctgtaagaccagagaaatttctgaaaatttgttctcacacttgtttgaaaatggaaatcacaatagcattttattataatctgtgtgtttttacagggaactttgtaatgaatgattgaccttcttgagagctctcagaattctagagaataggagagcaggagcctgggccccagctgcagtaaatgacagcataactgaatttttttttgaagccatcatactttggaagaacctaactgaatattgtttgcattgtagattgtagccaaaaagaaatgagagtttcagtgttcataactcaaggtttttaatatttttagatgtgaaggtaaactaagtactgcttagaatattgactcttagagattcatagacttccttggtgtagagaatgcttttccaggtcacctggtctattctgcatgatggctgcttcccacctgcagagcttcactgtccatggaacatgggatacttaggggagggcttggtgattttacacttagctagtgctttctgggaatgggtttggacgaggtgtgtttaaatgactgaaataaattatttccgtcagttgtggctttaaaaattggtgggattagtttctttctcttttgttttttttaaggctagttaattgaagcagttgggggattagtttcttaaagctaatcagtgttaactatgtctggctttaatcattaaagcagtctaatcagtttagtttaattaatgccagtgttattatatgtttgacattccagttgtgcttggaagcagaacaaatgttgctcatccttatttgaattttttagctctgtggttatcctgcagttgtggttggcaccagtgttaatgagcatgatcatataattgtgctgtatctagtttcgttgtataaattatttgactctaatattcagtgcaaatgacttttatttttcttatctcttagactgcaagtggcaacgtggaagcaaaagtagtatgcttttatagacgacgtgatatttccaacacacttataatgctcgcagataagcatgctagtaagttgtttttctctgattaaaaaaacgttttaagtcttgtgttttttgtgatgaggtggaaacatgctttttcttacctgaagtcttttgcttgtccatttatcttctttgtagttttgatgggagtaaaataagtgatactaactgaaaccaaacactggtgtttggtttcagtgtatatgtgtatatatgtgtgtatgtaattttatatctatatatatatatatttttttttttttccggagacaaagtttgctctgtcacccaggctggagtgcagtggtgtgatcatggctcactgcagcctcaaaatcacaggctcaagtgagcctcctgcctcatccttgcaaagtgctgggattacaggtgtgagctaccaggcctggcctagtatatggttttttaggttgtatcacattcattaattggtgaaaatgttgacatagaagcctttgtaaataggctttagcaaaggatctgggcagtg

SEQ ID NO: 93889 - DNA, 1024 bp, Homo sapiens
aggctggtctcaaactgctgacttcaggtaatacgcctgcctcagcctcccaaagtggtgggattacaggcgtgagccaccaacccagccaccttcttatttaaaaggcatctcagaaaagaggagataaacacattggctttgcctgtcatttaattcattattctgttgagactgaaaatattattccattctcctccctgcattgagatgctgtaaaacttctttcagttagctcactgaataaaaataccatacaattctgggatttatctcttcttgtctctttttaaaactgagttattgagtattgacaaaacatttccaccctttttttttttttttttggtttatgttttacctagagcaattagtgtttgaagggaaatttttcctcgggttgtcctatgtgtcagaaacaaataaatgaactaaaaatattttatgtgtaagcagaattttctttttaaacaaaaaatatttcaaatactgggcaaagaaatagtcggtagatgggagtagattggaatagattgccagagtgaatttatatattgctgtgtttagggatggtatatccagtttggttaaatgctcagtgcaacctgggatccaaaagcagtggatgatagagcaatatatatatatattttttgagacggagtcttgctctgtggcccacgctggagtgcagtaatgtgatctcagctccctgcaatctctgtctcccaggttcaagcaattctcctgccacagcctcctgagtagctgggattacaggtgcacgccactatgcccgggtacttttttgtatctttagtagagacagggtttcaccgtgttggccaggctgatctcgaactcctgaccttgtgattcacctgcctcggcctcccaaagtgctgggattacaggcgtgatccaccgtgcccagcggatagagcagtctttttttgttttcaggaccacagaaaacttatgacatgccctcttgcttttaaaatttaaattttttttggtagtg

SEQ ID NO: 93890 - DNA, 1065 bp, Homo sapiens
ttatggctgtgttgtatatctaatttgtttaatcctaactaatggatttttggtttttttagtcttttgctgttaaaaataatactataatgaataaacttgtgcctaggacattttagttgtgtgattgtgagtgtagctgcaaaattataccaagtaaaatagttgaaagtatcttaatttttattttgtatttatttcttcatatttctccattggtcaaagcagggaggttcagctgaaaggatttgtaaatttaatttatgtctattgagaccttttttgctactttcagagaaaaacaagtttttatggatatgtttattgaaaaataaatagtagtgctaactttatataagtaataaaatagaactccactgtggattattagtctctcttcagtttggctgtgaatgttaaaaacttacttggaatctttaaaataattggttttcttcctgctcatttaattatgacagtatgttaaagtgttaggcttttgtaatttttttggtaatctatacataaaatttgaattagccaaaagggtactgttgatacctataagtagtgctccttaataaatgaagttaacatgagaaagttagttagtatgcttagcctcttaagattgctagtaggaggaaaactagaggaaaaatacagtaagtggagaaaaatcctgtcacagcttaacattttatagtgtacatgtttagcatgctctttttggaagatgtgtgtttatactatataacctttcctttgaattaactgcttaacccctttaagggctgaagtagttttcttcaaccagaatcacagtgcacaagagcatttgggttagatgcaaagtatgtcctatgtattgtctcaagtacttgtgtgtgtgtttttttttgattttcaatttttgtggctacataggtgtatatattcatgtggtacaagatatattttgacagaggcatgtgatgcatagtaatcacatcatgaaatatgggctatctgtcccctcaagcattcatactttgtgttacaaacaatccagttatactcttttag

SEQ ID NO: 93891 - DNA, 1048 bp, Homo sapiens
tatatatgtgatatatttgtttttgcatgttggcttttggagatgtcttaatttttgtttagaaaatcaaatgatcttacgacattttaaagaaacattgtgtgagccctgaccagtatttgtaacttgaataatcttcaaaatgctcctgtcagatttctattagttatacggatttttttaggctagttagggtcattttgaaagtgctcgtaataaatgcctctacctacataacctcagtttttctcagagtctagacaagccttataaaaacagacgttagtttccaagctcagatcaaatgtaagtgctgtcagacctcaaggtccgtggatctgtcgatgtttattttgccccttgctctatagaaggctccttgtgtttaaattttaactagtttttagagtaatttcaatatagatgaattagttatatcctgatatgaatgtgtattatttttaggttcttaaatgtagttagtggctgctcataaaaatctgaatattatttagccattggtttgtgtggtggtgtctttgtctgaacatcccttttataaaattacctcataatatctatttataggttcagaaactgactcttagtctgaagttctcattgtactctttttttttcttgaataagtagaaactacctataaagtattgcatattaggatttattgcctaacacaattactccaacaggctagcctctcaagaaatgcctataaagacagccttattttataagttacctgacattaggattgtaaagtgggtctaaatggtttgaaaaaatatatattcctaactgccatgtagtttcttaataccagtctcacattcttaactttgtatttctcatcactgagaaggtgaggtggcctttgttacatttattctttttttctttttcaacaggggaaagtgcagtgttgcccttctgaatgagacagaatcagtattgtcatatcttgataaggaggtaattcacaatcatagttgttttgtttttttctccctttatttcacatgaagctctt

SEQ ID NO: 93892 - DNA, 1059 bp, Homo sapiens
tttcagaccagcctgggcaacatagggaggccttgtctacagaaaattttttttaattagccaaaaaaaaaaaaaaaaaatagctgggcgtggtggtgcatgcctatagttacagctacttgggaagctgaggtgggaagattgtttgagcccaggaagttgaggctgcagtgagctatgatcatactattgcgctccagcctgggtgacagagtgagaccctgtctcaaaaaataaaaataataaaaataaaaaatctcttccatagcaaacatgtttaaaatacaggcaggaaaagcagtgagtcttcattttatgctgtatgtgttaaggttagggtttcttacatattggaaggacttccaaatcattaaaatcagcattatggtaatttctttttaaatgagattttagtagaaatctgtttcatgttgaatcctcacaggaaggggttgctacagttaatgatatattgggggaaaaatgtaactgagttttacaatttgggcttaaaaagtagtcaaaacttgctttgctgtaatagtcaaactctgcagctgactttttattttttgagccaatttgaataaatgttttactccatgacatgttataacagagcttccctttccttcttttttaccccctgcacaggctattttttttcttgatttcatgataacgacctgtttatagtaaattggcttgtcaattattatatcttatagagtgaaaattctttttatttgatgtttgattctcattcagaaacttgtttttgcctcttcttttacagttttttatttactatccaaatgtgttttttaaaacgttaaaaaaacaaaccaaaacagatacttaattcttccttattgtgtttgtggtttattcagtgctgttgggacattcgccagagccctggattgcagcagttctgtgaggcagcctagtttgcatatgagtgctgctgcagcttcccgagacatcaccttggtaagacatggtttgaaattttgtgggtatttatccttctgttacttgtttaattttaaagccatt

SEQ ID NO: 93893 - DNA, 1288 bp, Homo sapiens
aattcctttaaacatcattttatggccaagtacactggcttatgcctgtagtctcaaaactttgggaggctgaggcaggatgatcacttgaggccaggagtctgagacaggcctaggcaacataacaagactctgtctctacaaaacaaaacaaaacaaattagccaggcatggtggtgagtgcttgtagttccaactattcgtgaggctgaggtggagggatcccttgagccaagaagttcgaggctgcagtgagctatgatcatcccaatgtaggcaacagagtaagactctgtttcataaataatcattttctgtgtagtttctgtaatacttgcctcttatgctccttctaggaagttaccttcacacccttcagtgttttttatctctcctgttttgtttccattctgaagcttagtaattttgaggtccgattacttttgtatcacatatattctttctagttatttattaccgtaattattttctaaagcagaagtaggctcagaggctcaggaagtggtgttttgtcatgtttgtatagctggtttcagagatagggtttggatctgcacttgattcctcctgagtagttatctctcctctgtcagattacctcttctatctacccttccacctcatttttgttagaatgacttggatttaagcgtcattattgtctttctttgaggcagcactgaagaagatgtgtttttttgcttgcaacatttaaataccatggtttccttctcatactgctttaggttcagctttacttagactcttagatcctgaggcatttataaaattgagtagtatggttaaaaattaattattagtatgttgataatgagctttgcagattgtttcccaaaaagaacatatgaaaggttcattggttgttttgtaccattaaatgaaaatggattcatcattcagttgaatttggggagtcacattcttttctttgagtatttatggtcctactaccccctcaccccgcttaccttttttttttttttttttttttttttttgagacagtttgctctgttgcccaggctggagtgcagtggcgtgatcttggctcactgcaacctctgcttcctgggttcaagtgtttctcctgcttcagtctcctgcctcagccagtagctgagattacaggcgtccgccaccactgccgactaattacggtcctattctgatcgctttagcacctttttctattaggtgatcaaaccttggatctgaagacctctttgagaggcctgcagagagggcag

SEQ ID NO: 93894 - DNA, 1185 bp, Homo sapiens
acacttcacctgaggtcgttcatatttatctttcatttctgtcaattctaggggaagcacttctatttctggattttctgggatagcaactcctaagtgatgctttaaaaaaaccaaagcagtattaggtttctctggttcttttctaaggctaccagcaccttcgttcagcaccccagagccctaagcacctccagaattgcttgatcttcgagttagcagtgttctaatgggccatagtgacagctgcagtggcatagctggcactgagaccttgactggtggcgggcttggagatgcacgacttaagccaaaagctaaatttttaagagttctattgttgcgtagaagtgaagctatccccatttgtgaaatttttaataagtagcaggagatactttgcgtaaaaggtgcaagactttaagtttatgtgttagaaagtctgggtgggggtgagaggtggggagaaaaacagaactagttctcacttgggcaagaattagatcactttgcagcacccatgtgctaatccgcgacataggcagagatgattttgttgcttttcagttttcctgttacacatacacatgtatgtacatgctatggatgactctctttaaatcaaaggtttttcaaacctcgaagttttggaacctagttattcattgttctgattggaggaaaatgccttcttttttaaaaaatagggcatcactctgttgcccaggctggggtgcagtggcatgatctcagctcactgcagcctcgacctccctgggctgaagtgattttctcatctcagactcctgagtagctgggattacaggcaatatgccaccatgcctgtttttttgtagagacggggtttcactgtgttggcccaggctggtctcgaagtcctgggcaccagcattctgcccaccttggccttccaaagtgtgattataggtgtgagccactgtgtctggccagaaaatgctttttaagtaagctagacctaagtaacttttgcagaagtaacctcgggcccaggagttcaacgttatggtgcttgtgtgttctaatctatcttttctcctttcaaattgtgcttcaaatcactttcccttgaaatatataagaaaaccacagtggccttgctgttccaagcaaacctggccatctattctttgtcttctacaatct

SEQ ID NO: 93895 - DNA, 1051 bp, Homo sapiens
cttacagtattcatttagcaagtttgtgagttaatagtttttatctgctcaaagtaaaatgaaggttagtcttgtaaagggagaaactgataattgtttggaggagtagttgtagtaagacccacgctatcaggccgggtacggtggctcacgtctgtaattccaggactttgggaggccgaggtgggtgaatcacaaggtcaggagttcgagaccagcctggccaatgtggtgaaaccccatctctactgaaaatataaaaaactcgctgggcgtggtggcacgtgcctgtagcccgagctactgaagaggctgagaaaggagaatctcttgaacccggaggtggaggtttcagtgagccgagatggcaccactgcactgcagcctgggcaacagagcaagacttggtgtcaaaaacaaaacaaaacaaaaaaacccctacactatcaggaagtcctgtgtttttggtgtaaaccttggcaatattaatttatcctatttacttctctctgagttccaagttaaaatctggtcagcttttctcaccatttgcgctaaacagtctgatctctgcttttagactagttgctctgctttaagctttctgtatttttctagttgtcttactaattgttgagcctgaatttgatctggacccttaatgaaatgacctctgctaagcacagtaggagaatttgttttatgggcttttgatctttgattcttcttaatgatgtagaggagtggtccccaacctttttggcaccaaggaccagttttgtggaagacagtttttccatggactgggggtggaaggaggtttcaggatgattcaggtgcattacgtttattgtgcacttcatttctattatgattacattgtcatatataataattatacgactcaccataatggagaatcagtgagacctctgagcttgtttttctgcaactagacagtcccatctgggggtaatgggagatagtgatagatcattaggcattagattctcataagaagtacgctacctagatccctcgcatgcacagt

SEQ ID NO: 93896 - DNA, 1072 bp, Homo sapiens
gacggggcagacctcagggggcagtgggagtaatggggagtggctgtaaatacagatgaagcttcgctcgcttgtccattcaacacctgctgtgcagcccagttcctaaccagtccatgacctgggggttggggacccctgagtatcctatgtatattttttattattaaaaatttttttttcctcagctttactgaggtataattgacaagtagaaaatacatattttcaaggtatacaatatgatgatttgatatacatatacattgtgaaatgattaccacaattaacacattcatcacctcacttacttaccccatgcagtggggtaaataccaggtcatcttgtctaactatagtatgtactttgttttgtctttgtgtttatggacttactgtctttagttaaacttatagttcctttgaaatggtgaaatttccatttgagattttcataaatagctttctatgaagtcatcctttattttaaattatgaaaatagaatctttatagaccattacgtatttgatgtgagccaatagcctgccttttatgttgctgcatctttactgaattgtttgacacaaagttattacttaccaatatgggctgataaattaaatcccagacatagtaattaaaactgttagtgtcactgataatttgttcttctggcaaaacttcactcatacttaaattgttacatgccatgatttaaatttgtaggatgcgcagctgaaaatttaaagtgcattggtatttagcttcagatggtcagaataacaatagagcagtgttattaatataacagttattaaaataatagagctacagctacatagaaattgcaaagaatgaaacctaacaaatcaaatctacactgtgaggctcaatgaaaattcaaaaaagataaataaaacctgcagatctgataaaggagtaggagttgagaaacactaaagtgaaaatacttttccctgcaccaaatgtaatacctcattctgtgctctggtggtatttactgagtacctgtaacatgccaggcttgcaaaaaggcactaggcatgcaac

SEQ ID NO: 93897 - DNA, 1632 bp, Homo sapiens
tgtctctactaaaaatacaaaaaattagctgggcatggtggcatgtgcttctaatcccagctgcttgggaggctaggcagaagaattgcctgaacccaggaagcggaggttgctgtgagctgacatcgcgccactgcacttcagcctgggcaacaaagtgacagtctatctcaaaaaaaaaaaaaaaaaaaaaaaaaaagaaagtggtggtttttaaggaaagtactttctatagtagcttattttcatctcattttattatatgttaacatagatgataggttgatttttttttttttcagcttccttggaaatcattgactagcatcattgaatattattacatgtggaaaactactgacagatatgtgcaacaggtaatttttttcatattgctaccaatatggttgcatttaagtgaactttctgtttatattttaatattttttggcgatgtactacttttaaatttgtttaccttactttttccagactactttaaactacatgatttcatatctttaggatattatttaagattttaatcttaatatttccttgacttcgcatgaattatgataaatattttggagagataccactagagaggcattattttccttgcatttgactgatccttcatctctttgtagttcatggcaatgatcaaagatgtgatgctaacacaaacctcttgaacaagttatttttatgaagaattgagtatttagaccaatgtcatcagccatataatttgatatgtttttaaagatcttctgaaacctctttacatgacatttgtgtggctatacccccgaaatccttgaccttaaatgtagtagtcttactagtatggtgtttttgtactgtacataagctttttcttaaatgtaatttttgagtccttctcaaatatcctaaattcaggtaactctcaattacttattttttgaataatattacctctggggaaaggcacattttcctgaaatgacatcggtcaatacttgtgttatgtttgtataggcacatattagaactgataaaaaggcaaatatatttaacacagacattatttttcctatatatgtaggttatacagtggcaagtattagatgctataaaaaaattttatgaatcactttttaaagtatcatagtgagctgggtatggtggtgtgcacctatattcccagcattttgggaggccgaggcaggaggattgctcagcccaggagttcatgtccagcctgggcaacataacaagaccctgtctctaaaaataaataaaaattgaaaacaaaaagtaccatggtgaattgctgaggtcacaaatagtgaatagatactcatggcttgttgaaaaatttccagtgtcaatattaatataattcaaaaagtgcttattataaacaacttaggtatagatcaagaccatgtagtctgggaacctattttattaaaaaagagtctctaaagatggagatgatggtatcaaggatggttgaaaagtagataatattctttccaaaaacttcaaccctgttctaaaagtttcaagttgtccccctaagtatttctgttttctcctcattgggaaaatagaagatagccttatattctggtttgtctt

SEQ ID NO: 93898 - DNA, 1066 bp, Homo sapiens
tttttaaaggtcctgtttattcagtcatagaggaatggaaaatggagttgctcattgctttatttttttaaacctatgcctaaaattgtattaatacttaaagttgtgtaccacagaatctagtgacttttcttagacattattgcagtttaagaatatgcatatgaaagaaaagcttaagatggtaatttttgaattacactttaatacgtattttcttgtgaatttttaagacaatgaacagtagtaataattaggcattgcatgtaaaatgttttattcatcttttgaattagaaacgtctaaaagcagcagaagctgagagtaaactgaaacaagtatatatcccaacctagtaagtaattgaaatcttttaaaatatttgttttggtcttaattttatcattgcagaatatgtcattttgttcagtttcagcaaaatttgaacttttgtgtatctttcttcttctacaaagcatgagacttactattataccactacaataaaaaggagccagtgagagaaacctcaaatagactaacctgaagactagaggaagaaatgtactatgtactatacttttattaaatcaaagctgcagggaaagcgtcagaaaacctatgaaatgctgtattatttgaagcaaatgtgtttcagaaagctagcagcttttcaaactatagattttgtttgggtaatgcatactgctctttggaggtttgttgtttatttggttgaggattttacattgttttcttggttccaatggcaattagaaccatatttggtaaatgtgtgataaataatggagaggttttgattattttgtttgtctagtgttctatcattattatcctttgaattcagaaatcattgtcatctcaaaatgaatgccaattttttttttttttccatttgctttgttttaaatgaggctgagcatggtagttcacgcctataatcccagcactttggggaacctcgtttctgcaaaaaatttaaaagaaatataaggtactatatccttttgttgagattttcagagtttgcttattcatttgttca

SEQ ID NO: 93899 - DNA, 1035 bp, Homo sapiens
ttttctccctcttcaacctatttacagttgtttaataactagccttttgtttctggaattttgatattttgtataatacatgtttttatatacatagaggaggcctcatagacaatgagttctgatctttcatattgatcttttaccacaagacagataactctggtttaattttaagaacatgtaatttttacagagtctgtaatttttattaagaactgtaatagcccatctgcagagtggtttctaattccttctaaattatatgttttatatgatgaatttataaaagagccacttctcaaataaaatactgttgcaactcatgtgtcttagattttcaaaagcaagcataccagctttcttatacttcaaagtgctgccaccatgaaataatacatttggctagttttgaccaagtaacccagataattgtttccatttggctttacgctgactttggagtcaatgtaatctaagtcagggatcaacaaactatagtcgcaagccaaatctgacctactgcttgttttgtgaataaaattttgcttgatttttgtttttgttttgtgagatgaggtcttgctctgtcaccgtggtttaagtgcagtggtgcagtcatggctcactgcagcctcaacctcctgggctcaagcgatcctcccacctcagccccccaggtagctgggactataggcacgcaccaccacacccgactaatttattttttatagagacagtgtctccctatgttacccaggagttctcatgaacagtggaagttgattttaaacaatgaagagtcatggtcagattagcactttaagatcacctgctatatgttgggaaatggtttgagaaagaggactaagagtagatgcagagggaccagttatgaagttcttggagaggaaagataacactagcttgacctagagtagtagctctggaaatggcgtgatatttggaggtgactgacttttatggcgggcgggggtgtcaagtgtgaatcctaggtttctggcacagtgaagt

SEQ ID NO: 93900 - DNA, 1178 bp, Homo sapiens
tccttttttcatagactcgttttataaagatgagtagtgtgagttcatttaacaccttggttttaccagtttatttcttcttcacacattttaaaatgtttgtttatgtttattaaatagtgacggtaaatcagtaatgatatagagctttttgccttattgtacaaatcattttatcaccttattttaatttcattgaaagcagcaaaccaaatcccaaccaaatatccactagtaatgggaagcctggtgctgtgaatggagctgtggggaccacgttccagcctcagaatcctctcttagggagagcctgtgagagctgctatggtaagttttctctagcaggtcagttaagcatcgggaactgttctggctcatggggtgtgagcgtctgggaagtgcctgaggtcagtacggtgcaccttggaaggcacaagcatgtctcctctaaatgagtagatgcccctccttaccttctgcctggaacagagggactgtttattgaatccttattacgtaccacacactcaagttaggcattggatttcccttgatgtactcttgtggtttgttgattatttcatagcagtgtttgctgagttgtgtttagagtcatattagctttgcagaaactgtgttcccatgatgcataccaaattcccctttggagtttctcagtatactttgacaaattaaagctccaagtaattctgtaggaaaggcctctgtgtggataagctgctgtatataatcctcagaccatgttccctcagtgcaccagtttgggaaatgctcttctatgatacttgcttttggcctcaggatcccactgtatttatctatggtggcagtattttatttgcccagggtgttaaatggggtcggtgaagtgaaccgttaggtagttgatagactttgtgtgtttattttaaatctcaagcaaggatacaatatcttaatggggcattggtgatattatcatctatgtttccttccagttaaggtagcctgggatgggagagggaaggaaacgaatgtttattgaaaacctacttggtgccccattttgggttcttagtagctctttgagagtacatgtagcctactgccttcaggaaggatataggaatgagggacggctgtgagtacgattacgtcgattgatcccaaggaaggtg

SEQ ID NO: 93901 - DNA, 1054 bp, Homo sapiens
tcaccaccacacctggctgacagatacctgtttttattagattcctgactttatcaatgagacctccctgagtaccttaaataatccttggagtggtgtctgaaccctgggtttggaaacgtggatttagattttttttttttttcttttgagatggagcctcactctgtcgcccaggctggagtgcagtggcgtgatctcagctcactgtaacctctgcctcccacattcaagcaattctactgcctcagcctaccgagtagctaggactacaggtgcgtgccaccatgcctggctaattttttttgtgtgttttcagtagagacggggtttcaccgtgttagccaggatggtcttgatctcctgacctcatggtccgcctgcctcaacctcccaaagtgctgggattacaggcgtgagccaccatgtccggccccagattttttaaatactaccatctttttgagaacctatttccagaaacatacacaatagagtatttttaatcaacaaaacaaaaactccctcagcagcacaatgcataatacaggatgcttcactgaatagctttaacagggccacaagcactttatataataatggaaataagttggtttaatgaattctgagtattaaaaaaacaaatatactattatgtttggcttgtaagctgggaacaataacattgtaaactaagcatgacaagtatttttaaaatgtttgattattttgtgttgatgttacaaattaaatagcatttttcgttttttcttatttttcttctgctttagctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggtacagtagtctttttagtgttgaaaaatggcatgtttttaaatgggttgattattccttggaaacagaagtacagtataggataattaaaaaatgaagaaagctaccttt

SEQ ID NO: 93902 - DNA, 1048 bp, Homo sapiens
gttgttttctgattttgcaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatgtaagatgcttttaaattcttaaccttatatgttgtgcttctgaccattttctcttttcctctctttccttttttttttgtttgtttgtttgcaataaacataagttcttgtgtacagccttttatttggtttattttttaacattgtttttgtgtgctgccatttgtatcatgccaacctggaaaaaaaaaatcaaaacattgaaacttctgtactctttaccagagagtagtgcttagcaaaagattggtgggaggtgatcctattccatggggttttgtgatggaattgcctgcagagcccttattgaagcacttttaccttttaggtagtgccacaatgtaacccctaaggatgctgttataatgagactccataatcgagacagtacagtccagtcttacatggattcattaggtttaaataaaatttgccaatttacactaattagagactgtatgtctttgtaaacctctcgtttttctcatgaaccttttacaattgtcatacaacattatggaaattcacccttgattcataacaaatactatatttattagaaggtctagcaaattacaagtaaattttaaactcatttttgggtgagttttctgaaattacacattgcattttcataagctagcatctaaacatatggttgagcagcctgtttgtccagtttggtttccatttcatgatcatgtatcatatatatcaccacataacatttacatgacttactactcttattttcaacacatttggtcttgcttatcttttttatttttatttttgttagcacag

SEQ ID NO: 93903 - DNA, 2081 bp, Homo sapiens
aacataccgtgccactgtattgaaaactgcctcctttttgtgtcagctgcataatctattttgttgtaccataactagtttcctattaaaagcttttaagttattttcagtcattttctatcataaataatgttgcaacaaatatccttatgcagatatcatttcatactgatgtataaaatgggaatgttccttacaagatagatccctaaaagttaaagttggggccaaggagcatacattttgaattttggtgtagttttattgcccgtagaaaaactgcaattcacagtcccactcacaacatctagacaattcctatttctctagaactttgctggcagtgttacccatctttgaaacccgtgactaattgacagatgacaagttatattagcttgcatttctcattttgaatgagatagaaatctttgcctatatttgaaaaccatttatctccttttctgtcaactgtttttgcccgtggcctgttttctattggcagtcttactgacttgtgggaactttttatattttaacaaagttatctcttaatctgtgatatgtgatacaaatagttcccccgttttctctttgactttatggtgtatttgccaagcagatttttttttaaaaaaagacatattaatagttgaatttataaaaaaaaaatcatgagttttgtggcttctttaaaaatacctttccagttctagaagcaaactctactgatagttttatcttgacagggttcttgaatgcacatgtgggatgtttttgtgaattctgtgtgtatattgcagggtttccatctcactgcccccagtatttccaaaacactgtagaaaaataaccatgagtttcaacaaaagtaatagtgtatttctaggttaaccccaaggaaatatagatcatcctctaggacagtggtccccaacctttttggtaccagggacaggtttcatggaagacaattttttcatgaactgggtggtgtgggccgtgatggttttgggatgaaactgttccacctcagatcatcaggcattagttagaggctcataaggagcaggcaatctagatccctcgcatagcggttcacaatagggttagcgctcctatgagaatctaatgctgccactgacctgacaggaggcggagctcaggcggtaatgctcacctgctgtccggcccagttcctaacttgctaccactagtactggtctgaggcctggggcttggggacccctgctctaggaaactaaagacatgttccttgtgaccagtcaagtgacttgagtgagatatagatgttctctctggacaggttttgattccttctgggttctttggggatttctcagattgctttcattatctgtgacttcaaatgcatatctccctgttgaagtggagttaggtgagtaatttgggagcaaggactgtctgacaagtggcagcattgttggcctggcattgagtgcagcccagcattccttctaaccaactcaagtgtgggccagacaatcccacctatggctatttcctcagggccaactgtatttttcctactgaatggcaacaacttttcttatgttaaagagtgactaaggcagtcctagaatcttttcactctaattttttcacagttgagacataattcttgccaccaactacttttttttttttttttttttttttgagacagggtcttgctctgtcacccagcctggagtgcagtagcgtgatcatggctcactatagcctctaactcaagggatcctccctcctcctcctcctgagtagctggaactttctataaaatattatgaggattagtgaaatatgcttctttctaaaaagctttgatctcccattcagaggtactctgtaatgcaaattgtcacttagaacatcatataattaatcctcctatttttaatgagaaattagaagcaaatatagtttaaaatgaagtatctttgggtattgtgttggtgacctctttgatggatttgttgatgatagccatcaatgtctatcaattgctgccatattggcagttttcctttgggtcatct

SEQ ID NO: 93904 - DNA, 1276 bp, Homo sapiens
gcctcccaaagtactgggattacggatgtgagccactgcacctggccaatgagggaattttttctaatgagcgttagggcagcctacctgaagaaagtaatagttaatttcagccttaaaagatatttaggattcgaataggtagaaaaataggaaaagcgtattctcttccctcataaggccaagacaaccagatgaacaaaggcttcagtgagtccaaggacttgaaagcagcttgtttggtctagatggagcatagactgtggaggttaaatgaaatgcaaggctggcaaacttgtcatgtcatgttggagaaaaaaaaatcacttttttcggtggtagtatttaagccatttctaaattttggcaagtgtgggactttgaccagagctgtagtaattctaacaattccaatggcttttcctaaattccagtaaataagggtgatatctcagcccttaccttcagtgaaagggtgagaaggcagggtggcttgtgtgtagttggccagctgcatgatgactctgagaatcagtgagctgctaagctttagaaaaaggctgcccagctttagtagtaaactgaagttcttaaatccagttcctacagtgttacagtttctgtccatctacaataagagcacgtagttctgggctgtatggctaacaacaatatacctttgttaaacatgcatataccacaggcacattatggttttgtgatatatccttggataaagcatttcatctacctcttgactattgtatttggactttggtttcaggtttcatctatatcaaaatgttctaggctgcgagtaattgatcctggtcccatactctgtctggttgcagagccagaggaggaatcccgtttttcagaaagttcgcatacgtgacatggtgcctggtttgacagagcacagaagtgttttacccccctcaccccaaggctacctctccagatagccttttgatgtctaatatcttgaggagtcagatgccttattcccttagtaaatcacatgttgtatgtgaccttctgaagtggctttttgttttgtttttgcttgtattcacaacccgaggctcagagctccagccagcagggaaaaaaccagcttacttgataagcaaagccatggcaacaacacttgaagctgactcattatgcaagtccttggctggctcaggaggaactgactctcagctcattaagaaataagatgtgtgcctattagccaatgtaaatgcacacagatttttaatatcatgtt

SEQ ID NO: 93905 - DNA, 1069 bp, Homo sapiens
tttcagccttttcttgcccacaacctttggattcaggcttgaatgtaatctagaatctctcttttccattataccacctccctggcctttctaggcatataatattgctgtagaaggtataaagtaagtcctgaaaaacacacacacacacacacacacacacacacacacacacacacacacacacacacgtatatattcttttcggtaaaaagactgtcgttgtgggccaggtccagtggcttatgcttgtaatcccaacactttgggaggctgaagcaggaggatcacttgagcgcaggaattcgagaccagcctgggcaacacagagagaccctgtctctacaaaaagtttacaaattatctagtggcgcatgtctgtagtcccagctactcaggaggctgaggtgggaggatcgattgagcccaggaggtcgaggctgcagtgagctctgatcatgccactgcactccagcgaggatgacagagaccccatcacacacacacacacacacacgactgttactgtgactgatgttagcatagcagctttctggtatcttctttcactcacaccctgtggtcattctggatcccagtcctggcctgcaatacctcttctgttgctctttcctcagtatcacaggtacctgtttttctggaatttatttaaaatgtcaccttgtagtgttccctctctagggctgtttgtttcatttccctctgaatgaatgctgccacacggtcattgcttctctgctctgaacagaaggaatggacggggcacacaatgaatccttggttttctgtagacagagaccttcagcctttttgggggaaagacccatcttattttctgaagagacttagctgctgaaacacttccttctttaagacccatttgtgtttgctctgctgtcatgggatggagaggaaggctgatgacatgtgctcggcacttgtgctaactcctttactgagttctctcatttaattcacatgacaggaggttctgggaggtcagggaatttgttttgcatatcattgtatctctgtgcttagcacagta

SEQ ID NO: 93906 - DNA, 1008 bp, Homo sapiens
acaggaaacagccaccattctcagggttgggagagcacaaggaagaagctgggcttatcacaacccagaagctcaaggagggcctcagagccagaacgcaacccagaggagagggcactgccctgccggtgcaggcacctctcaggaggtgtgatgaggctggttctggtacaagcttctgcacctacctggggggacactgacagggacaggaccgagcagttcctacctccctgctccagcactgcagaatccttctagcgccctgctggtgtgacacagagccagacagcaaaggggaagtgtgcttgtagagtcccacccacccccagcatcatggagctgagaaacaagagtgtaatggaggcacacatgttagaaagtgcccacattcttgtgttacgaatggaccttttcattgggataatgggcctgtttcctatgtccacagggtataggatcctgattaaccagagtttccaagatgaactcaaagtactggaaaaaatgttctgttaatacttttcatgagctagttattaccatcatatactgaaatagatacaaactcatgggaaagccttgttctgtgtgatccaataataaaatcaattagcactgctacttaattatcagcatgtcagacagatgagcataccaaacagagtgttgatgggcagaagaaactgaattggaaacaacacccggggctgctgagatgtttaggcctcttagctttagggcagcctgcccccttcagtggcttgcctcctccactcaccctctacctttgcattgcaggttctttttttttttttaattttattattattgtacttcaagttttagggtacatgtgcacaatgtgcaggttagttacatatgtatacatgtgccatgctggtgtgctgcacccattaactcgtcatttagcattaggtatacctcctaatgctatccctccccactccccccaacccacaacagtccccagagtgtgatgttccc

SEQ ID NO: 93907 - DNA, 1064 bp, Homo sapiens
attcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgc

SEQ ID NO: 93908 - DNA, 1037 bp, Homo sapiens
agagtgagatggggtggacacgggccagggccagggccagggcaggatgggggcatggggaagtggtatccctaagcaaggggcttagaggccctgtgtggggctggcccacggcaggtgggagggatttttaggtaggctcaggtgcagatggagacattacgccgtggccccacaggtggttaatatttaatctcctccttaatcattaactccctggctggctggggaggaacagggctgttgtcaaatcagtaaccacaggcccaggaacaatgtccacagatctcatggcctctcccattgctggccgagtggggtaacccctggccctgggggccaggtgcatctccctcccacggtgaccttgggccatggagagggcttgaagaggccaatcctctccgagcccctggatcgccctttaccctccaccctctacttactggtggggagtggtgggaggtggtgtccattcacgcatgagggttctagtccctacccactccttccaggctgtgtgaccttgggcaactcacgtagcctccctgaacctcagtttcctcatctgtgcaatgaggataattattcgtgtcttggaggattgtcatgagatttgaatgagaggagggtatacaaggaagtactttctaagctgacgattgagttagcaaacaagttagagaaagtacagatgggaagagacagagagcaaagggtaaagaggaaagaaaacagcttgagagctcttgtttccatccacccaaatgcagttcctttccttggagtttgttttaattcattcaaggagtgttgattgataaggctgtgtctccctaagtggggctttaggggtaatttaaaaaggagtcaacctcaccctcagggagcaagagtgaccaggctccagggctgaacccagcagtgtctgggatgaaggtcagcaggtcagtgggatgggctggagggtcagagcaggccttaaggctgaagcagggcggggagaggatcctgagggatgattaggagttgcgtgt

SEQ ID NO: 93909 - DNA, 1126 bp, Homo sapiens
cctgtaatcccagctacacgggaggctgaggcaggagaacggcttgaacccaggaggagaatggcttgaacccgagaggcagagggtgacagagtgagactccatctcgaaagagagaaagaaagaaagaaagaaagaaagaaggaaggaaggaaggaaggaaggaaggaaggaaggaaggaaggaaggaaggaaggaaagaaagaaagaaagaaagaaagaaagaaagaaagaaagaaagaaagaaagaaagaaagaaagaaagaaagaaaagcaagcaagccacacatggttgggaactgtggctgaaaagaagctgagcttggggcctagacagctgtggcaagaacggtgttaggtccttttcagttttgtatggcttttgcaccaggcaggccagcttctgccatttcctgtctgtttgagcgtggccaagtcctttaatttcacccagcctcagtttcgccatctgtaaaatggggatgacattgcctgtcactaggcctgcagtgtcaatgcagttcactgacatgcagagagagcagtgcaggcccaggctacggtggggcttacgtaccatagtaacttacccacacagtcatctggggcttccccacaaacaggaatgagagcatatcaatagagttattatttgaataaataattccatttttctatatttatagaaaaagacgcaggtgaaccctgtgtcatactgcctgtggttcctgctgtggggagggtgaccatggcttcacccaggggcaggccctaggcttaggtgagatagagcagtccccgcccccagcgctcggaggctgtgcacttaaacttcaaaggaccttccaacagatgcagctggtttcctgcagccgtgcagcagccaatgccagcctgaatcaccccggcctaagggaagctggggagcagaggcccgcagagaccttagcccaggttaatatgagaggcttcctggaggcagaacacacccagattctaactgctagaagaaagaagagaatggcgtgttggggagttgctgtagcccagggtgttggggcctgggatgtgtagattcagaggggtctttaggaggaacgacttgggagataagagcgataagagc

SEQ ID NO: 93910 - DNA, 1082 bp, Homo sapiens
ctgccaaagtgctgggattataggcgttagccactgcgcctggcccatcatgcattaaatgcttgaagcctgccctcgtagtaacatgttgcactaagtataatacctcggaggccgcgtccctccctgtctgtccctccccactgcctgttctgagtttctggagtccacatctcaggggctccagcctggactctggtctttctccgactccctgccctgttctcaagtccccctgttgtcgtccactgcctaggctggcaccacagtctgaggctgccacctgggagacccaggcgaggcctggagcagtcccagtgggctcagggctcctggggcctgaggaaccagaggcactgaagccacgtcggggaggccctgcctgtgtgatgggtggtgggagcaaaagaaatcctttctgaaatgacagcattgggatgacagcgtgtgtgggaaggggtgtgtgtgtgtgagtgcgtgaggctgtggtgtggctctgtgagtgtgtgtgagtgtgggggggtgagccggcatgacagcatgtgtggtgctatgtgggagttgccatgcgtgtgttttagggcagttatgtcaggcgttatgtaagggaggcgctccctggggccaacaaaccgcagtggtgtaaccgccaggccagcagggaaggagggaaaatgtaaacaccattccgtgcctttccctgccctgccacaggccctgcggtcctgccttcccgccacctgaggccccgtgggctggctggggggtgatgatgggggcgtgagggctgaggctcccaagagctccataggcgtgcacatctgcagctcttgatactggcccaagggatagcaccaaaggagagcccagccagggcctaactgggcttcttctggtcagttgcaggccatgcatcccccacgtgtgaggcgtgcaggcttccctaccccacagcgctcctgtgtcccagaggcctctccctggcataggagccccttgccctgcaaagaatcagcatggggttcacggctcacctgttcacacctgtacggtggcctcagggccagctgtctctgtctctc

SEQ ID NO: 93911 - DNA, 3422 bp, Homo sapiens
tgtagttcttggactttgcctctgtccccaggttctgggggacgcccctcccgccctgcctttcaggtcgggaaagtcccggggtttgcaaaagagtgtccgagcgccctggaggcggggagggcggcaaggagggcgccggtgtcgcggttgagtttctccactgccgaccgcggccacgctgcccggggcttcccggacaggcttcgcgccgcccacctcggcagccggggcggaggatcacgtgtcgaaacccagcgcggcccacggtgggcgtcctcccctctcccgctccgtccagcaagatcttgctggttttgcgcgtgtataggtggagggtggaggccgagtcgggatccgccaagagtgggggaaaaaaaggaaaagaatcaggctgggagttcctctgcggctcgccccgagtctgtcttccccttccgtttttcatcccttccccgctcccctccctttggcagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagttgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtggggggggagtctcacagtgcctttggaagggcccgaacttgccttaaatcttcctcaaccaaataagtattttattagtgcttgagagaatctgaatgtaggatgggttcaactg

SEQ ID NO: 93912 - DNA, 1090 bp, Homo sapiens
tggtaagtgtctgacaaaaggaccttgagaatcacagtgttatagaaacaggacacagcctagtgtcctgtgtttggagattccttcctctctggcctgctgcagagatgacctttcctccctcctctccaatttccagctgcaccttaaactctagagcccactcccttgttgaagtccccttttcagcatccatcccccaaagtatcttgactttgaaccacaaacacatctttatccaaggtcatgttaagtctggggaaaaaattcctctctggtggagaaatacagtgagtgaaaatagaaggtgaccttcaaggctgcaagtggtgtgtgtacatggatgttgacaggcaagagtgcaccctctgtcaggtgggggaagggaaacccctcttgcatctggcagggtactgcttggtctggactggggcttgtcaccattccctgtaagactgactttcggctttttcatctgatttaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttgaagaaaatctgggggattgggatgggggtatgtgtggatttttcctccactaaatctgcaggaaacatgttgaacataaattcaaaaattttatcccattcatgcctcccctacttctgtgagtccagtcgtctgtcactccttacagagaaacttttcttcagttcactcattcagggcagcctattttattgctgctactgtaggaagt

SEQ ID NO: 93913 - DNA, 1406 bp, Homo sapiens
cctgtaatcccagcactttgggaggccgaggcgggtggatcacgaggtcaggagttcaagaccagcctggccaagatggtgaaaccccgtctctactaaaaatataaaaagtttagccaggcacagcggcaggcacctgtaatcccagctactcagggaggctgaggcaggagaattgcttgaacctgggcagcagaggttgcagtgagctgagattgcgccactgcactccagcctgggtgacagacagactccatctcagaaaaaaaaaaaaaaaaaatcaaatgagttttctagtttttgctcttacatttaggtgttcggtacattttaatttttgtatattgtgtgaggtaggggtccaacgtcattctttcgcaggtgtgtatccagttgtcccaggattactggttgaaaagaccgttttttccccattattttggtacccttgtcaaaaatcatttgaccataaatgtgagggtgtgtttctggactctcagtctgttgatttgtgtaatctgcccttgctgttctgttgatctatatgtctatccttatgccagtaccacgctgtctttattccctggtttttttttttttttttttgagacagagtcttgctccatcacccaggctggtgtgcagtggcgcgatctcggctcactgcaagctccgcctcccgggttcacgccattctcctgcctcagcctcccgagtagctgggactacaggcgcccaccaccatgcctggctaatttttttttttttttttgtatttttagtagagacggggtttcactatgttagccaggatggtctcgatatcctgacctcatgatccacccgcctcggccttccaaagtgctgggattacaggcgtgagccaccgtgcccggcccacgctgtctttattcctatagctttgtagtaagttttgaaatcaggaagtgtgagtcctccaattttgttttctttttcaagattgttttggatacacagcagattctttattttttgtagcaacacggtcttgtctcaagtgatccttccaccttagcctcccaaaattaggggattacaggtgtgagccactgagcccagcctctcagcagattcttaaaacacacttgttgcttggctgcttgctttcttgtttccttgatggactggccagcctgtaagagcctagctggcctgcatgcttaagtgacaaattcctctccctactccagcctcccttcataaggcatttggccagtagagatctaggcagttctggctgagctgtcttagtccagggcaaggtagtaagagaccgaatttggcaggttgcagctggtccctcaagcaggagatctaaatccaactcatccttccccccgcatccccaaaacatctcagcattc

SEQ ID NO: 93914 - DNA, 1027 bp, Homo sapiens
acgaccatggagaagactagaaataatgaggttatctggaaacggcctcatgaaacctgaatgtatttttgctcagaaaaaaagaaagtgcagtaacactcactccgtcagacgctgcctttgctgcccaggccaccccagcctgcctggcctcgcctccagtcctccctttagtgggcagcttgtctccctgcggcccaagcttgggctcctcactgcctctcggttgtgtgtgtcctctcacccaccctgcttagcctgtctgtgaagccacctcctccttccacatttgtttttcctttctgtcttttgattacccctactcatgatataatttgtctgtgtcacacaccgtcttcgactgtttcgtcacacttcgtgtgggtcagcttgcctctggcaactcttctctctcttagagtggttttctgggtggttttcctcatgtttcacacagcgtcctccacacacaggtgatcaataaatacttgtgggtagataaaatatcagattgatgggtgaatgggtgagtgggtggatgggtggtgagttggttggatggcagggccacccaacaccttggccagtcccctaaagctgagggatttttcagatgcctgaaggaggattctccagagctaggggcagggagaattcaacccattgccatttgcacagcatttactatgctgattgccctctcttgagaaggactagaaggcagacttgaccaatggccttagtctagaagtcatctcccccataatactttaaaatcagaccatgggctttttaatccgtggtctgaaatagttttcaaggttggcacctggaagacatccactttgacatctttctttcattcagtagttgaaagcaacctcaaagtctgtgacttacctgtctacctgcctagaaattaataatcacttcccctagtggggggaatcagaggctgagatttgtagtggaggcaacacactgtgtgaggcctgggtcttcacctccagccctgttggggggcggg

SEQ ID NO: 93915 - DNA, 1038 bp, Homo sapiens
ttggatttttccccaatgggaaaatgcaagtcacaagtaaattgcatagtataagaccacagtcaagtgctaagcgggtggtatctgggcagtacccagtgttggttttatagacagtcctgggaaaggaaagacacagggttcagccatgaagtgcccccctcagcatctgtgaacaccttgagcactgtgcagatacagtggagaaaaagtccccagtgggctgagaaacaccacaggatctgcgttgcgtcctgagggacaggccggcaggctaagtgaaaaggaggaagaagggaccccagagcagggaatggtgagtgaatcaaagccaagagagttggagggagggggaaggcccagatagcagtgtggggagaccactgagatgaggtttggttgagggactcagtgttctctcctgtaaaagtaaggggagggcctggggccagctgccttcttcagtaccatttcacaggggtcaccaactcacatgtccacagagaccactcaagtgagcacgcacgtgaaaggcgcgcgatgggaggcagtagggcggtcccaggctggaagcatccgccttctgtaggcgtggccaccgctctgctccagcagctgctgccgtcttctaatgcaggcctagagacaccacagtctgattttcctaattttcaaaagatgctagaaatttggatctttatgagaattgccctgatttttttttaaatccatgtgagctgtactaaatagtccctttgcacccctgtccagacactgctggtaagtccagacaggggtgcaaagggactgtttagtacagtttagctgacacaactcagcttagaacccaagttgtgtgtgtttggattctgcctccgcatatactttcttttaaatagtaggctctaagacttaaaacaaaaaggatgccaggcaaagtggctcacaccagtaatcctagcaccttgggaggcctaggtgtgtggatcacttgagcccaggagtttaagaccaacctgggccacgtggcaaaacccg

SEQ ID NO: 93916 - DNA, 1080 bp, Homo sapiens
agggtatttctggtttcataataggtcaccaggaaacatgtttacatcaggcagtcataggttttaggcatgtaacacttctgtggagtttgtattctttgggaactggacctgcaggtattctggggaacccaggccatttgttccatttgaaaatagctaaagcatgaagaaaaggcaaattcttagaattttaaagggttttctctcaagtagttttaaaatttcaaatgatggtgttgtatcccttcccttcagacctggaatcacattttcccctcaagacagaaagggctctgcggcaggttgtgcctgggaaggggctgcttctcatttgtggccacctctctgcccaggagctggtgaggaagggtgaactaggggatgcctttcagaacaaaggaggtgaggagatgagcccctccacatctgccccaaatagagaccggcgtactagactgagcactcacagagacgttcacgaagggactgtttgcggttgtgtgagattggaggcaggcctacagcagggcttctcatcgttggcactgtggacattaattggggtggtagggctatcgtgaacactgtagaatgttgagtagcatctctagcccctacctactaaatgccagtagcaccaccaactctgactctgacaaccaaaaatgtctccagacacgggcagatgtaccctaggagcagtgtgccctctggctgagaaccatgggtgaagggaagcagtcatgatgttgaggcacctacagacaagaacagtaggaagcccttcccacccctctggctgaaagggagaccccaggaatagtggaagtcagggaggaggagctgcccagcaggtgccctagccatgagggatgcagccactgctagaatcttcgcaactttctggggagggtgcaagaaagaaataccgccaactcctctcacttctaccctccagtataccagtgctcccttcacattaggagaagtcagctagaagcccggtggcaaggacacctgggtaaggcagtctattgaaatcagcatcttggggcactgggcagggtggaggagggg

SEQ ID NO: 93917 - DNA, 1018 bp, Homo sapiens
acaaaaattagccaggcgtggtggtatgtgcctgtagtcccagctactagggaggctgaggcaggagaatcgctggaacccacaaggcagaggttgcagtgagccgagatcacaccactgcactccagcctgggcgacagagcaagactccgtctcaaaaaaaaaaaaaaaaaagaagaagaaagaaagaagctccagtagtgaaataagctgaagaaaactgaagtgacttcaaggaaaggaaaaagagaagtttcaagatccaggctggtcagtgaggaatgtggaatgtgtcctcagagctggtgaactctgcccaggcagaggagaggaggctgatggaaggcagacctcaggttgcccagcacttgccagtctgtggaagcctccgtcactggctcatgacacaggggtagggaggaaagaagagggctgggtgctgccatgtccaggaggagtgctctggggtgagtggccatgcagataggaatgaagtgcaaggcacttaccacctggtcagagttggaggcgatcgaaccctctgggaggctctgcagagtgaaatcatcaaggagcaggcatagggagggactcatctgctgtggagggactggctttgcacttttcacaggaaaggcctgacacagttcaggccccaaaggaatcgtcaccaaatgcaagaatgccaaatgcaggccaaaatggctggacagggcccactgcttgctctgctgtcccttcacacaccagggccccaaggactggcctttattacctgctccagaacagccatgaagcccacatgaacagcccatgggtgccgtaccctttcctgctgagctccagagattgccacaggaaacaggagtgaggtgcacacaaaactgggtataatggaagcacccggaagggctggaggctgtgacagctccaggttgtaagccccctggagaaccacgtctttttcacagatggtattttctgagagcaatatttgtttgaatccattccttatttg

SEQ ID NO: 93918 - DNA, 1098 bp, Homo sapiens
ggggagtatttgaattgaagaggttgaaaaatggtgaaagcaaatactgggagggacatctttatggatgtggaagtcccagatggggtggccatggcgcagtcattgaagaaggccaggtctgtagccagcaagaatggggagatggttagtatggacttcaaaagagagattgtggggaatggcagggggattatctaggagtggcagaaggagtttgctattccgtccaagtcagagactcagggacagaaggaacagccccgaatggaaaatcaggagaatggtagcttctgccgggaggaggaagaaacacggaaaagatgacacatatggagaatttgctcacaatatgacagattttaattgaggggaactattttttcataagagcttttgagaaaaactattccctgaacatggggacacatctgaaaaaggcatgaggataggggaggaggtaggaggttttggagtagatttctgagaaagccaacagagggaggccctgtttcctcaccatgattgtaaggtgcatgacatgagacaagctggctcaggcctgtgggctggtgctaggcatgccccagctggacacagctccctgtggccctgccacatctcccactcgggagtacacagtcccacagtaccttagattgctgtatttcccagaccggtgtttcgcacgctgacagagacaggaagcagaccaggtgagctgggattgggggcttctgcttttagagagcagagagcaacaaatgggtttaaaggagaggaaacaggacaccagcaggcttcagggctgccttctcttccaagagtgctgctctgtaatgtaattgtatttggacattttttccacatgatgtcagggtatagcctcccttaaaagccttcatgaaaaagcacaactataaaacagactcaggcagtgaaatggaaaccagacgagtggttctgtgtaatttaggtaaagagatttctctttgcagctttgtgatctgatctgatctctgctctctgcataaaactgtgtttcacaggatccacttacatttgagtcttaccatgcaggtgatttcagatgtgaaa

SEQ ID NO: 93919 - DNA, 1089 bp, Homo sapiens
tttgcttttattgataggtggccttaaattcatttttagccatgtgaatcactgaccttcaccttgagctgagagaaaggccttccatatctggaatgaactcatgcacatcttcctagaacagatgccaacggaggaagtggggaatgggatagactgaggtggtcgagtgaagggagacatcactaggttgacctattcaagagagaaggagactcggaagcctcctgtgctgccccgaagcccagccttttggaattgggccccgctggcccgggagaagcctcctctctcctctttatgattgattgcctgactcctatgcagtgagaagcagcctgtcatagggaggcgcagggtttggggttagagacaagcgccccaggggccttgtgccttccctctctgcctctcccagtgggagcagacacttgaaggaaactccactctgtcccctcccaaaacaggtagtctggacaactttctgacgtccccctgtgttagaagcttctggttgctagttgctaccttcaaggactctgatgtctgttttctctcccattctctctgtctgcctttgtttttccatcccccctctccacccaccaacagagggacctctacctgtctaccagatgggaggcgttttcccatctgggaagaaaactttgaaggacagttgccatcttggagagagaatactgatctgggaatcagggagtcctctctatcctgagctatttggctctactctcttggcttcagtttctgtataaaatgaaggtgattttgtttgtattaaaatatgaataaaaacgaatgttggccaggtgtagtggctcgcacctataatcccagcattttgggaggctgaggtagaaggatcacttgagcccaggaggtcatgaccagcctaggcaacgtagtgagatttcatctgtacaaaaaataagaaaattaggggggcttgatggtacacacctgtggtcccagctactcaagagtctgagggaggaggatcacttgaccctgggaggttgagaccagcctgggcaacataacatactctgtctctaccaaaaaaaaaaa

SEQ ID NO: 93920 - DNA, 1044 bp, Homo sapiens
ccacaggcaagcttctggccaaatattttaaattcgactctgagaaactagcaggaatcttgttctggtggcttcccaagcacacactcagggatcagaacctgcagaagcagaattcccagtttcagataaaatgttcattcatctccaatatgcagtgctggtccccatcgcccttccatccatgctgaaagtgtgtgcagcacggtacttagggaaaaacagtgccagcaaagtgggttcatttgtttctgtcaccaccatttgctggaaatggttgtcatgttcacggtactgtagaactcagagatgggtgcaagaaatcttccaaagcgctgaccttcctgtgttcttctccagctagttctaaccctgccctctatcctcttgccctcttttttcccccaggctcctcccttcccttcttttctcccaatccagagtagatctaggaatctgaaatttccaccttggctacaaacagcactgagtctctttgaacagccttgtccataaatcttagattgtttttcatctttgaaaaagttacttctggcccagcacggtggctcatgcctgtaatcccagcactttgggaggcagaggtgggcggatcacctgaggtcaggagttcgagaccagcttgaccaacatggagaaaccccgtctctactaaaaatacaaaattagccaggcgtggtagtgcatgcctgtaatcccagctactcgggaggctgaggcaggagaatcacttgaacccgagaggcggaggtttcggtgaactgagatggcgccattgccctttagcccgggcaacaagagcaaaacaccgtctcaaaaaaaaaaaaaagaaaagaaaaagagaaagctacttctatcagcaagtcattattcacatgtaggggcagggaaaagttcactacattcagacttcagtttcttttcactctatttcacaacatccactcccctgaaaccatgggctttaaaaaaaaaaatcagtccccaataggcaaggtgccccgtgacatagccagctagaac

SEQ ID NO: 93921 - DNA, 1084 bp, Homo sapiens
ccccatgccctcctttcccacaaagcctttccagtctttgtgtctctccttgagtcagacccacactgtttagctcttacattgctcattctttaggagactcctcctttcacccacactaagctttttaagggctgaggcctccatcacagcagagtggatcatgttgttttttgttttttgtttttgagagggagtctcactttgtcgcccaggctggagtgcagtggcgctatcttggcttactgcaagctctgcctcccaggttcacaccattctcctgcctcagcctcccgagtagctgcaactacaggtgccagccaccacgcccggctaactttttatttttgtttttttgtttttagcagagacggggtttcaccgtgttagccaggatggtctggatctcctgaccttgtgatccgcccgcctcggcctcccaaagtgctgggatcacaggcgtgagccaccatgcccagcccggagcatgttacattctagagtggctcatgacaggcagacctattgtttctgtagcacagcctggttttggagttgaaagtggacatggggtttgagatgggcagcttcccttcagtcagtcccctgctcagcctcccggcaagctcactggccccagcgatgagcctgtagggtcaggttacactgggacaggttggtaagggctccccaggcaacccagtcccatcacaccagaaaatgaaattcccctcttttaaaagccactcatagaacatagtggtggttgtggtggttctgcttcagaccctcaagagtctgtgtgtgtgtgtgtgtgtgtgtgtgtgtgtgtgtgtgtgtgtgtgtgtgtgtgtgtgtgtttcaaaagtaaaaaaaaatcggattatcatcctcgcccccttaatctgttccaaatgagaacgcttaggaagaaaactcccaagaacccactctgttaagaaaattggtttctgctgtggagtgggtcagggtggggaatggagttaggaaaatatatggaaactgacagaagagattcggtttgtgtttggaaaaggattcgggttgttttcaagttttgagt

SEQ ID NO: 93922 - DNA, 1682 bp, Homo sapiens
actggccacggtggcgacccctccctcaccatcctgctgttatccaaggaggcgtaaagggtgacatcagagacctgggaagccctcatcctacccaccaaactccaattctgttctcaaatctcccagaagatgcttggtggattgtgaaagcctgggcttccttgtttttgctgctctattttgactacagcagtccccatggcaagacctctcatgggcagaagagcagaatggagagtggctctggtggtggcgggccagtacagggagggtttttctctgcacacgtggggcagggtgtgtacattgagatagaatggcatgttgggaatctgtgcacctttcagagtgtctgtttgtaaagagtacacagccccagtttggatgtgaatgtctgtatgagcgttaggaggagaatgggattcaagagatgtgctctgacctgttcactgatgcatcatgatgagctaaaagtaagaaatccctccctgaatgtcaaaatggccaggaaatcgttgctgtatttcagtaattgggtttgtcagaagtgaatttcttgtgaggctgatctacaggagcagaggcagagaacagcaggtgggaatcaaaaacaaagaattggccttgacggcaacttgtcttctccctctctgcctcctcttcccttgttcctttccccctctcctgcttcctcacctccagctgaagtactgaagttactggagtacaaccagggctgtcagcttggggtgtatcttgaaatggactttctgaagtattttctggggtttcaagcatgaaacagctggtgttttagtcggggtatagatttggcatctgtaagagaagttaatagtggcttaaacaagtcagtagcttattttttcctcacacagagcactcagtagactagtgtgatggtccgtatgattaggggcgcacaccttctttcttggtgctctgacattttcaagacacaccatccctcacatggccccagatggcagtgccagctcccactgccatgtccacaatctggtgagccggaaggcaggagggaagggccagcctggaagtcacatgcaccacttccatggatcttatcagccaggccctcgtcatctgccacagatctcagccaaagaggctcagaaatcgtgtgttgagctaaatggacacacgcttagctaaaaagcccatttctgtgtaagggggaaagactgggttttgggagataggaacttcacttctcgcaatctgccatcttcttatttttaccaggtcctaatcactgaggttctggcaagtgccagctgcatgggcactaacatctggggacacagggatgaattagatagagcatctgcttctaaactgttgggagtccaccctctcaggtggtaggccacctaaaatcaacagaccttcctttacatgtatccaaatcattttttctgttagcaacttacatggctaattttataagaaaaggaagtaaccattaataataagaattttgttctaaacattctcactaacttggtaagtttgtttgctgatccctgtatcatctcttaggaccacacacatcacccaaaatgcagacacttcattaggaagcaagcccacaagctttgcagttgcattacccagagcaagaatttactagaaagatagct

SEQ ID NO: 93923 - DNA, 1049 bp, Homo sapiens
tcttgatgctcctgtttcattttatcccctttgatcctcacaacactgtgagatactttattatttcctccattttatttatatttttatgtttttaaaggtggggtctcatggcatcactctggctggagtactggtggctgttcacaggcacacttgtagctcactgcagtcttgaactcctgggctcaagggatcctcccacctcagcctcctgagtagctgggattatagggacctactatacttcctccattttaaatgtgaatatgcagaagttcagagagttgaaggaatgggcccaacgtcccaaggcagataagtgtcagagccagagttggagctccggcccctgtggtgacagaggccttgcactctcagatcctctctgagacagggaaaggagtccaaacctggcatctagtttagaacccaggagttaagagaaaggggtgcattgaaggtcttctaaactcactgttgtgtttgaaagaagacactggagtcagagtgtaagaaaatgggttggggaccagagctgagataccagagtgtgccctggggaaagggaatagagggcagatgcagcaagaggcggcaggtggtcctctgtcaaggctgctgctgttcctgttctccagtgcccctcctaaagggagggaatcccaggactcgagggttttagagcctctgacttacagatgtggaaactgaagcccaagaaaggtaaatgatttccccagtgtcacataatgagtagaaaaacgaggtctacaacacccactcctgaggcccaggacagtacctctctactgtcccccaagccttgatttatacagaggaaatgacagaaatgtagggatgccccctgagaataatccagactcgggtagagaggagctggcaggggtgagatggggtggtgtggggtaagggcagagaagatggaacactgccttgagaagagggcttggaggaactccagcaacactggggtgggaagaactaagtgttctgtgaaaccagccatctctcagcagtcagcaatc

SEQ ID NO: 93924 - DNA, 1046 bp, Homo sapiens
cccctctgcaggccagcttagatgttgatgatgcttaaatggtaaaatctgtgagaaatgttcaacaatgccctgtatttgtactgcctaaaacatgaataatacatatgtgacatgaataaataggtcagtgatttttatgacatattaatttcctttacctaagttcctgggaaatatagctgaacagttacagagaatgaaaacaaacactggcatcttacaaacacctgctttgattatttagtctaattaggttaaatttaactatttccattttaacaaattgaaaacaattcttatctgttcctcggtcatgcactttatcagtgttggatgcagatgtgtttaatatgacacagttggtgctgttttctcagctctgggtgggaaataaaaaggaattgagaacatatttttagagtcttctggggactttgtatttctgggcctatagctatgaaattttaaggaggaggaaaaaaaaaaaaaaaaaacaggctttgttgtcaataaattagttggttttccccaaaacactggaactgtcatctgaactgctgcttgtgccaaaattatctttcccagggaacagtgagcttctaaaataacagatgtttcctagctgtctttcagaagtcagaataatatagggtatgttattagattgctaggttaacgtggtgtttactctgttaattccaaaccttgcgctgagtacagaggcccacaattctttagaaatttagtttagagatcatagcaatttaagtgacttacccaaggttacacagctggttagtgaaaagggtgagctttcctgactccttattcaccgtccatttctgtgaccaaagttaaaggcctcatataatgtgagagttgtgtctgtggcagaaccgtgtcatgaaaccttctacccacattttcatcccaggagtgaaataccgttctagtcaacaactagggtctcagaacatctgtgatttcttttttttttttttttgcagctttgtcacccaggctggagtgcagtggcacagtca

SEQ ID NO: 93925 - DNA, 1055 bp, Homo sapiens
ggaatagatttttagaaataaccaaataccaaataaaatggcaattaagatggaaagcactgtttgggataaaaataaactgtgcttaatgtagtgaagtctattcttgtgtgttttataaattgttccccaaaacaggttgagcaatagataaatatatcaccaaataaggtgatcacttacttggatgtgtagatttcaatatgctttcaaaataatgtgatgatattatagttttagcatataagctccttgaaagaatggaccatgtcttagattctttgtcgtctaagcacatagtaggccctcattaaatggatttattaactgtttgatgaaatgcagttctcctcagtttttagaatagtaacagctgttatcaaaatacagattttatttaaactcatgtatcaaatagatgtgaattcattttctgaattcaagcaaggtgtttatgtgtgtatgtaaatatatatctgcctccattattagctcacaaagtccagagtaggaagtataccacatagactgaagccaaacctctgggtttgaatcctagatctgccatttactaactttgtgaccttaggcaagttatttagctgctttgagacacgttgtttccattgtaaaaggggacagtaagatctatatcttagagtggttgtcagcttatacatgtgaagctgtctgtgaagaatgtgctttgcatggcacagaataaatgctcaataatattaactattattaatatttttttgttgacatggagtttcactcttgttgcacaagctggagtacaatggcacaatctcggcttaccaaaacttccgtgtcccgggttcaagcaactcttctgcctcagcctcccgagtagctgggattacaggcatgtgccaccacgcctggctaattttgtattcttagtggagacggggtttctccttgttcgtcaggctggtctcgaactcccaacctcaggtgatccacccgcctcggcctccctaagtgctgggattacagatgtgagccaccgtgcccagcctattatcatt

SEQ ID NO: 93926 - DNA, 1168 bp, Homo sapiens
ctgcctgccttgtgcctctcccaacttccaggagagagggcaggagatttaaagaagttcagagatttcccaaggcaaaaacatattaatcaagttcttaagtggatatttaaaaggacaaatggtaaaaaagagtggaagaaaacaggattcttaacagggccttcgtttcatcttctgtatgtcaacttcgtccgcatagtgctggattccttctcctccttcgaaagccactagtaatgctgcttttcagtgcatctgctacatgctgatcacttctgattttttttgagcactataaatcttcattatgctgtgctccatgccaggatttttccatttgggggtagaaaaattccccaagcccaccaaaaccctgtggcttagtttcctgtccagctggcgtgctgctcttcgggattttgttcccatcatcaaagtggcttgacagactgagaacaaacctctggctcaccctgaacttacagtgcaccatttccaagtcagaacaaacaccaagtaatagcaagagaaaaagaatgaaaaaaattattttcctgacttagaagccagttcagagtgaagcccaactctgtgactccagacagggatgttataaggccttggctgtcctcaagggtggagtcatgaacagtgggctccgggctggaatttcactcagagtcatctcaaaggagaagccatggatggactcctttgtggccccaaatcttctgtttcctggaatccaaagcagcagcatttgagggagcctcccatgatcttgttgactacatcacacttggccccaagcctcacagttgtgggagcagtcagtgattcctgaagtgtcccaggaggccagtaaggtcaccagcctgtaccgggtctagggaagatgcagaacacttcagcctggcagaaggctctaaagatcgtcaacctttcctctgttcattttgaaatttttaaaaatatgctaacttagctgaaaatctcatggaaaccaggctcctcatcagacttgaaagtcaaaccggtttctcaacaacttctctttatggttctgtatggctccacagaaaaccagaaaaacatttggggcaagaagctatgactctgtgaggccacatgggagcaggcagtcaattattacactaaggaacac

SEQ ID NO: 93927 - DNA, 1118 bp, Homo sapiens
cctgactcacccagacaaacagttactctgttaatccctccttttggggcacccatcatactctagcatgactggttgtgtgttttcccaactacactagtggctttcaagtgtttttttttttttttttttgacagacattgacaacaagaaacagcttttacatatgacctaatgcatatgtttgtgtgtatatactgtgcacacacacatgaaatcatgcacagtcggaaattttagtagctgcgtaagatataaattgccaaaaatgcaacagagagggaatttgctcaagatagagcatatttaatttcaggaatgtgtgctttcaagatatccactgccattttggatacaaagcataaccctattgatgccattcagtataatgtagggtagcttattacctggaaaagaaaaagaaaaaagctagaccagtcaattattttacttaaacttgttgcattttaatggttatttaaatcttaaagataacttattaaaaattattcttagcaaggacttaatggaaagctgatacataacaaaaaccttagtgaaacaatcccttgggaaatctctgaacttctttaaatctcctgccctctgtccttactacactactttgatacactctgattatattttcctcctttctccctctgtcttcctcctagctccttttctcccttcttcttctgcccccatctctctcctcttcccttcctccctccttcccttccttcctttcttcttccttctttctttccttcctttattgctggtcactacccactagttgatttcataacctaacatacatttggaaaaacactattcaggactctaagttccttgagggcagtgactgtgtcactgaatcacttcatcttcctatttccaaacccaccactattcctggctctcagtagcctcttaataaatgtttcctgaatgaataggcctcagttaaaaacaaaacaaaaccaaaaaaaaaaacctgcagccactgggattccggaagggacaggaaaagtgaataatttatcacagacttccccaagacttctgctgtcctctagacactggggcttttgtggacgtgtctgggaagccct

SEQ ID NO: 93928 - DNA, 1028 bp, Homo sapiens
acgggaactatctattgtcaaataacgaagtctctatcaacataatcgccacgttgaaaatgtgcctttatgctggtcctcacagaaacagctgcacttggagccttgcttttcaccagactggctaccaggatataacaccagtctacgtggtttctaattgcttggcccaatgtctcacttttcacctgattgtgtttgggacacatagatacaatttgttttctagaaaaccttgattctattcttggtttctgcccttgtcttggctaggtcacttgagctactttgttgatttataaaaatgggaatgataatttctatttttcttccttcttaagaattttataaagataaaataagaatactttttaaagagaaaacttttaatataataagatgttgatattgttattatcattcgtactatttttaccagggctaatttccaagtgtgtgccttgccaaattcacatgaccacggtcctattgacggtgctgttagaaattctccccttgtgatttacatagctcaggcagcatccagaagatttcatccacctcacctatttatccttttttatgcttttagggagaaagtaaggtttgaaaagaaaggggacttgtgttaacattctatataagatttgaagctatatatcttccaagccccaaactgtacaataaaagttttcttggatactacttttctcccataattcctagcacatagtttattaagttattaaccagcaattactctggcagcatattaaactttacttttaaacaagtcacagagggagggaaacacgcatctctcgtaaaaggaataaaaaacatacaccctctaaaacagtttccccaggctttgaacaaatcccaagccccacaccaaggtctctttttcatcattctccgcacatagcttgagtgttagtacagtaatgagaacaagatgcctaatagaaagatggaaaaatatgaggattctggaggctccctgggggctctctggaaaggcaggt

SEQ ID NO: 93929 - DNA, 1007 bp, Homo sapiens
gagatggtttcaatatggtctaaactggggtgggggcccggagacccacctgcatggcttccttcctgttggtagccccagaagggactaagagaagcaccctaactccctatttcaaaacagtgatctaatctaagctgatatttgtagaagaggtaatagacacgggggcaggcgacttcttcctacttgaaagatatggctgtctcagaagatggctcaaattagggatgtaaatagcaagtttgttttttgcctcttgacctgctttcttcctctcccgaggcctgatcatccttgtggaaaattctacaactccatgtccttgggctgccaagggccctctcttaggagctgccttccatggatagggcttcatgctccagaccttcttgccatcaaaacttaactattctatatcccttttcctcactctcagctggctggctgtccctaaattttaatatgtaaataagtttgttctcccgggtcacacagctgttttccagtagtgacctggtagagacagcacctttaactgaagtccgtaactgacgcaggctttacggcagtgcgctggcctggcaggagcacatctgccctcatattaagctgctcagccctgatacatttgtcccgtgtggctggggtttcggccacctccacaagggctgtgggcagcatgagctggtcttacatgaatgggccaagggagcatcttggagagaggccctcctaagtctcactagcctttccttcccctcagctgccagtgatgatcaggcttcctcagcaattagactggcctgggtgcctctgggaataacaccttcccacgcaagctcaggggctcactctaggactccccaagccagacgggtcctcaccagtccgcaggctctgcgttcctgggtaaccacaaggagagtcacatctagaggcacttggtgaatggaaagcctctagccagaaaacacagtgcagtgccattgaggagaggcagagaa

SEQ ID NO: 93930 - DNA, 2154 bp, Homo sapiens
agcctggccaacatggtgaaacccatctctactaaaaatacaaaaaattagccaggtgtggttgcgcacacctgtagtcccagctacttgggaggctgaagcaggagaatcgcttgaacctgggagatggaagttgcagtgagccgagatcgtgccactgcactccagcctgggcaacagagggagactctgtctcaaaaaaaaaaaaaaaaaaaagttctggtgatttgttacacaacaatatggatgtgcttaacactagcaaactgtacactcaaaaatggataagatggtaaagtttatattatgtatatttcatcacaatttaaaacattttaatggaaaatatttaaaagaaaatataccccatcattcatctgaagttatcattgtcttgacattttatgataattatttctttgcttttcttcctagttttaccacctgtgcatctctaaaaataaaatacttttgcctatttttcaattaagaaaaaaaaactttgaaaacatcatttttgaaggtagcatatttttgtcacctgaataattactcattaaatttacctaaccattgctggcatacagtttgtttcccatttgtttagtgtcgtagatgatgtttcagaaaaatctttgtacatgagtgtggtgtgtgtgtgtgtgtgtgtgtgtgtatgagtgtgtgtgattgtgggttattgccttaggtttgatttccagaagtggaataaattggtcaaggggaaatggaaaaagtcttggtatacactgccagattgttttctaaaaaagtccatctgcctaccaacagtgcgtgagagacctccaccaaaattttaactaagatataaaaaattcagttgaggaaacttttacgttttgaatgcttactctgtgccaagcttcgtatgaggagatttgtaaatattatttcattaactcttctcaaaactgccttaatataaaaaaatcttttctacagtgaaaacaactggggagacacaccacatgcctcacagccattttagttaacatttcagcttggcatgagttaacagataagtcaaacgggtacagattgttcttcagtttttactttctatattaccaaacagagatggccctgcgttagcattttgttttgtcttctttaaaaggggtcttcccctggaccctccctggggtgctgctcaggcccaggcctgctgtgcagtgtcagccagagggctcaaactgacagtgcattcgggtcagattggccatagttgtgttttgtttgacttgtggaggatttacatttctttttttaaataatttgctgacattttaaactgaggaaatttcatagtaaatcaagatctacagcttcttttgaaaaactggaagatctggcaccaccaggctcaaattcccacgtggccacaatgggccagagctaagtcccagccatcctcccttgatgagtatactctgtgcttctgcacggcccccgcccagccgcgtctctcattaggttacctgagctcccatggaaacaggagtttgtatcccttgctattggcatttattaagtagcagattggctgatgctagttcttaatgttcatggctgcgtttttagaatcatctggagaggttttaaaacctgtgatgccaggccttaccctcagagtttctgattcagatatttcaagttatctcactggccctcagaagtaccatttaaacctgatactgtggtgtggttagtggttgattgttgtggaggcttatggcacttcaaaaaaaaaaaattggggacgagtgcagtggctcatacttgttaccccagcactttgggaggctgaggcaggtgggtcaccggaggtcaggagttcaagaccagcctggccaacatggcgaaaccccatctctactaaaaatacaaaaattagccaggcatggtggcatgcacctgtagtcccagctactcgggaggctgaggcaggagaatcacttgaacctgggaggcggagtttacggtgagccgagatcgcgccactgcactccagcctgagcgacagagtgagactctgtctcaaaaacaaacaaaaaaaaatggtttttttgagagacatggtttcattctgtcacccagcctggaatgcagtgg

SEQ ID NO: 93931 - DNA, 1020 bp, Homo sapiens
gtttactgcccagcagaggaaagtcagaataaccagcgttatattcttttggcctacagatttttcagtttcctaaaattgtgaccttgtatttagaaaaagaaaacatttacaaaattttcctctgtgtaaaattattttgaagtgcatgctagcttcactttaacgctactcttttggaaagaattttgtgtaaggtgcattcatcttagatgtcatccagtaattgaaaagctaagaagctacaatgatgaagtataaatcagacagggaccccaagtatacttatcattttaaaattaagaagaatagagagaaaatactgtgttatattatacttacttcattcctacttggtatacagtttgtgatcttgcagtgtttattgctccattgatagtttcattgacaaactggattatgtggtggctagaggatgatataatagaaagaagttttggatccaggcagacagtcctggacttgatattctctttccccattttctagatacttgctagggcaagtcacttaaactctgaactgaagcttacccatctgcaaaataataacgcataattggcaacgatgctgtaaggaatagagatgttacatgtacaaattcccagtatagtggctggcatgatatagtttcttaataaatggtaactatcatttgcatagtttttctggttttttttttctttttggtccacgaccatttattagaaaataaatcttacctccccagactgaaagctgtctttgtcatacactgagtttcagtatatagttgctcttattttccagatttttggtcttttcctttgaacaatttgtttattcatacaccagttgctcatagtagctttacaatatgtgttttacaatttggtgtagactaattccccttcagtattattttttcaatattttatgaactttaaatcaatttgtatagtcgcctaccttttattgtcatttttaaaattaggatcacactaaactaatatgttaact

SEQ ID NO: 93932 - DNA, 1214 bp, Homo sapiens
tatttattcattcgacaactgctaattgaacaccagctacgtgccaggcactgttctgggtgcttggactatatcagagaacagaagagacacatccttgccctccaagattactgctctcagtgtacttatattccagcagcagggagacagtaagaaatgttcaagaaataaacattcaataaaacatatcagaacttattatagtaaatataataggtaaattagatagtttgttagaaggtaatcgttgctgcggacaaaggaacaagtagagtaggctaaggggaatcaggaatagataggagaggagggcagttggcatgtcagaatagtcgtcattggaaacgtttgagcaaaattctatcacaagacatgggaaaactttcttattttttgaataaaggtaaagggtagacatattttcttctgaaactgtgctggctgcagacatttgtaagcaggtataccaactgcatgtttgagactatctttacccataggaaagtgccaacagagtgggcagtagtggataaacaaggccaggaaggatgccattactttagaaacttaagagctccctaaagcgaggtggtcatactatagatgccaggactgctggggactctgaaacccttttcttctggaatcaccgtgaataccgtcagtctgtcatggttctgatgagcttaggcaaagagcaaagtatccatcatattacttcctctgctttctggtatgacctttaccttaaccctctggacctgggccttagagatgtagagtaaatgtggagaatgtttattcttctgcttagcaaatatttattgagaagttaagtacatactatgtcaggtactgtggaggatacaaagaaaatttatagcatattctctgctctcaagaagcttatgagctacctggaaaataaaccattgacactgcagacaattacacagaaatacgtggctacatgttatgtgcaccaagcatgtggccgagatcacacatctgagaggcaagaccaggatggactggagacatgagagaaggcttcaggggaacattgggccttgggataaaccttgaaactagctttctgtttttgaggcaagggacatggtatgagcccaggcatggaggagggcatcagaaagtgtttgcaggaggcagtgagtaaaccagcctgttgtgtcaaggagagaggatgtgtg

SEQ ID NO: 93933 - DNA, 1029 bp, Homo sapiens
agtcaaagggatgtggaaagtctttctggcatgtccatttgggtgtcacacctgtgttgtcctagttctgtccatcctgtggttctttatggggaaagcataaagggttaagttgggaagggctctttctttttcctttctacagcttatagattcctctccacataaagctacctttgaaatcattaaaaagcctgcacctggaaaagaggtgttagggattgaaaggaatggtcatctccatgggacctccagagccagctaaataaatataaagttgttatttttttcaaaagcaggaaatcatttcataatcagaaaacaaattctttcacagaacattttcttgaattatacattttgactgctttgaaaatgtttacataaatatatcaaatctcagagtatttctatagtataccttgaaaacaagaaatatgctgatctctgaattttctgggactatggaagaaagactcaaattatagcacatgcaaaaaagaacatgtgggattcatttcttaatcgttttaaaaaccagaggttcataattgctgtgttgagatggttataagtaacacacattagaaaaggtgaggttatgcggcagattcatgagagccaggggtaaatgacattaaatctcaataaaggctagataagagccatggacattacctcatttgggaacatcactagcagggctgctctgtcttttaagtagatttaaccttctgtttttgttgccagaactcttcatgttggggacttaacattattactaggttacttatcactctcaagaaatcatattggagttcagaaaatcttatattgaggaggagcttggccaccaatcatgaggaagggtttattctgattcttgggtacttaactcacattttgggtgattcataagaaaatgtataccatttgaaataagagtttgaattttcagttttttcatttcttgtctattttgggtcttttgttgttgttgttgttgttatgtacaaataaaaggtgatc

SEQ ID NO: 93934 - DNA, 1931 bp, Homo sapiens
ctctgaaccagataaaactttgtcttttccatcaagtatgcctgcaaaacattctgggctactacctattccgagtgaaactgaaagcattccttgagagaggttagcctgagaggcacaggaagagctgtacacatcagggagagtttgccctgtggcacagcaccttagtacgtggaagtattgaacctttcctgttttctctgtgctaccaaaaaaaacttattactttgaataaatgtacaagtttattgtttttaacctaacatttcttctagaaaagaataacatacaaaaaataaatgagaaagagactttttactgaaactgccctatttcaaccctaacttgaggacaggtagtattggtgaggtctcctgttcaaatggctgctatagtgctcatataggcatgcggttaggggtggaaaataaatgtcaggtcatgttcctggtttatgaacagagttgagagatggccttgagatctcaatacatgttataagcctgagatcgacactgctgacatggcaggcagtgtgtggagtgattaacaaggtgaaactctggagccagactgcctgggtgtgaatctcagatctaccccgcattacttatacatccatgtcttcatttttgaaataaggataatagtagcatatacctcatagggactttgtgaaccctaaggaaattaatacatacaacatgcttagaatagtgccgggtacaccacaagatatatagacagtcattattgttattattatcattaattttaataaacctatactataatgaaaactaattatttcataactaattccccctaggtaataagaatgcaagatagaactatctttttcttttttctttcttctttttttttgagacagggtcttacactgtttcccaggcaggagtgcagtggtgcagtctcggctcactgcaaactccgcctcctgcgttcaagccattctcgtgcctcagcctcccgagaagctgggattacaagcagcctgcacccccctgtccccacagtcactaatttttgtatttttagtagagatggggtttcatcatgttggccaagctggtctcgaactcctgacctcaagtgatccgcccacctcagcctcccaaagtgctgggattatggacatgagtcactgtgcctggccgttccttggttgttttctatattcaacaaatgcctactacatttcactgtgtcacagtcgcaatagcagctaagtcagtttttgccttgaaggagccaaggacaaaaaaggaccagaaaataggcagtcatgatgtagtgtgctaagtgctggctgaacacatagcagggccaccagacttgtctaggaaatcggggaaaatgtcccagaggaagtgacctctaagcagagactgaagaagttagccaagtaaagaaagggaaggagtctcccatgcaaagagagcaacataaaggctcccagtgggtagcccccaagtgggaactgctggtttgggtgggactgaagttctaggttggcagttttcaaatttgtctcaggacctctttacactcttaaaaggggttgcggctcccagagagttttgtctatcaatattcagttagaaagtaaacttgagacaggctggtgtgggggctcatgcctataatcccagcactttgggaggctgagctggacagatcacttgaggccaggagttcaagaccagcctggccaacatggcgaaactccatctccactaaaattacataaattaactgtgtgtggtggtgcacgcctgtagtcccagctactcaacttggaaggctgaggcacgagaattgcttgaaccccagaggcagaggttgcagtgagccaagatcatgccactgccctccagcctgggcagcagagtgagactctgtctcaa

SEQ ID NO: 93935 - DNA, 3224 bp, Homo sapiens
catcattttgtatgtctgatgcagttcatcatttaaaagtaagattcgaaatagcctggaccagcctgggcaacataaggagaacctgtctctacaaaaaattttaaaaattagccagacttggtgatttgcgcctgtagtcccagctacttgggaggctgcggtgggaggattgcttgagcccaggaggtcaaggcagctcaagtgagctgtgattgggccactgcactgcagcctaggtgacagagcgagaccctgtcccccaaaaaagccttgaaagactggattgatgggatgagactatcaagataacatttaatagagatatatatcattctgattttttaaagaaaagtcaaaattatatacatacaaaatgagggctatctggcttcatagcagtttttgtgggggaaaaaatatcttggtgaatgagatatcctggtgaaccatgagaaagcagcatgacactgttgctgcttccagatagtggaggctgtagtccccctgaactctgttggttagcctaaacccacattattctccttattattctgttctgggctccccattttaggaaggtcactgaagaactagtatctgtcgaggggaggtgaccaagatgaggaggaaaccaaacatctggaaacagttagactggagaagacttagtggcaacatgataatggtctttatatacttgagagactgccatatggtagaaggcgcataatttctcttttttgctcccaatgggaaaatggaagatagatttcagcttttaatttaaagaagaattttgtgaaaattagtattctctatcaaggaaaagaacatatttccataatactgagtttgcccatcagcaaaagtgttaagttttcaaggaaaactgatcacatgttgagcatatatctgcagcgcacctgaggttggactggatatcatcaaggtatctgtttggcatgccttatttcagaataggtgaacaactcagctgtggattctgaatgttcagtgaatgaaatgatcaacctgcctctaatcctgtgacaatatttgtacatttttgtttatgggtccttcgatctctcaaagaaaagaagttgggatgccattcttggcatggcccaaaaagtcacagtggtttgctcttaaatggcaccctccaggaattaatctactaaaatttagcatttaagtaacttctgtaactgtgttctggatagttctgaaaacatatttttggcctatgagatgttatgtctgaaaagcattctttattaatttaattacctttttttgtggttcctgtatttttctccattccagatgttggcttaagccacattttctgacaagcaaaagaacatctgagtctttgagaagtcagagatgcttttctaaagagtggttatagtagataactctttattgtcccaatttcccaaagtatcttgaacagagttgcctggagagagagtacaggggtctccaagccttgctcattacaagtagaaacacctgagaaatagggctttgccagtactgttgacatagaacttcctgccctggccagcactctacctggtctgtggttactactaaattccatgaggttcagagaagggaattataggaaaggagtatgcccccacccttcccccgctgcccagccatcctaatctgctaacagttgttgggtgaaaaaagggttctgctatcccataattctgtggaaaccctggccccttggtttcactatgtgactgtctgataccaggtcaggcttgggaccagattgttgaggcacaggtgttcagtgctgctcagttttcttctttgcttataggccaaacttgcaaaacatgtaaatgcccccagtgttatcttccatggggtatttgtatattacagatacatacattttgaaataaagcagtaaaactctaatggtggtgttttaggccttatatagggaggatctagaagcagagattggaaggttgtttcctattgctggggaaatcacattgtttgggcagctacttactctgcctcctttttactgtgcctagcactttatttggagggctgtactcatggccctctgaatttctgaattctacccagggtagctgaggttcagcatgtagtatgaaattatgttttgcattatgtgtctttttttgcaaatagttctggcataaaaagataccttgttatctgtcaccaatttttatctgttagttcctagataggggcctggccaacttcatttctggtgccagatctctttaagaccattttctaaatatgtttttgagcagaaggaatgaggagttcacctcttatggaatgcattgacaaagcaaactagaaaaacagaacttgtagggaccagcttttcttcagtgttatctgttatcccaacaggccagtttaggtcatgttagaacaagtgatttgatctgcacacagtcccattcttaggtgaaatttctgacaatgatgataatctatggcctattgctgccattcatactagaagttagaatctaatcagttaattgagtaaccaagtatttgttaaacattcattgtgtacctagctagtgttaggtcttgggtaagatgcaaagtaaagaaaaatgtctttatgcttaaagaacttaccgtctagctaataaggtaaaatacatgcttgtgaacctgataccgtgtatattaaccacttaattatatgacatatacactaaggactgaggcctacaaagaaggggaagagcatcagtgggttggagaagtccgggaggctttcccaaatagcaaggcaggaagaaatgtgggagttcagtctgccatctcagggacttttagaaatcacccatggtgattaacaagtcatgtgagaggagtgaaaagtcagggggatccaacaaggggaagattgtgatggagagttttatgattcataacttggaaggcatcataaagagctttgcttccacttgaaccaagggcgacccaggaaattcacaaaataaatggtttgctatttaacaggagaaaccattgatggtgcacctttggtaactttaataaagaacagtatttgtcctgagtgttgcatttaagtcttgtggaagtaatgaattgtagtgggaaaaaaaatttaaatttagtaatacttaacattttaaagtatcttaacagtgtttttc

SEQ ID NO: 93936 - DNA, 1878 bp, Homo sapiens
ttgtttgtttgtttgttttttgagacggagtctcgctctgtcgcctgggttggagtgcagtggcgcgatctcggctcactgcaagctccccctcccaggttcacgccattcttctgcctcagcctccggagtagctggggctacaggcacccgccaccacgcctggataattttttgtatttttagtagagatggggtttcactgtgttagccagaatggtctcgatctcctgaccttgtgatccgcccacctcattctcccaaagtgctgggattacaggcatgagccaccgcgcccggccatattatatatttttttatatatgtaaacctattgtatatattaaaaactattatatatataactattatatatattatatgtaaaacttttgtatataactattgtgtgtgtgcgtgtatatatatataacttgtatacacacacacacacacacacacacacacacacaaactttgggaggggtcttgtgaaagcagaggcctgggttttcctgccattgcccccagtgtttcagagtaaggtgcttatattgtgggtacaggatctcattagaacctgtgtaagtaatgttttctttgagccctgtctgctccaaggcaggtggatggtgttgataggagatactccttttgaaagacatagccccatgtttgcgttattcctgtgttgagcctggctagcacggagcaggcttggttctggtatgtatcttctgtccacgggttcgagaggatgtcaggacatctgcctcttcactctggaagagtctgcgagccggtgcaatgggtggcatgtaaatggtaatgccatgtggcatgaattcccactcgtcttctcttttacgtttgtagtacctgaaaaaagccatgaatatagagtattcatgaaataatataacagggttctcttcttttagagcctattaccacttcttgtgttacatcttttcaggcatttgccgtcttctgattactttgttcattttggatcaaaggcctaaatatgtaggcctccaagaagtattaaaattttctcatgaaacctttcagaagcctatcatattagttagctattacctttctgcttagctcttgacaaaacagtaccttcatttttgtgtttctaccaaaaattgaagtggatttggagcagaagggtaagaaaccaaactcaagagagtatttcttatgtatgtagtgtcctaggtttcacttccttgtttcacagagctgacttatgcattttaatgtgagaaaaccattaaacatgaggttctggcatgcgcttgcagagctatttgtttgcgccaagccttggctgtggctgtgttatctttgatcacagagatgactcaggcagactggtttttgtttcctgatatacaaagttaccagtctccttcatctggcatttggtgattcattttaggaatttgggtggtaaattttactttcaggggccttaaaaattgttctttcatgaataagtggaaagaactaagaaatgttttcagaaagttgatgcaaggaggaaaggcatgtgcacagaattgcagtttacattagaaacagagatttgctttagaacctgtgctctgtcttaagaacattgaatttgtggaagctttttactactcagtctgttgttcattgcatcctagaaataataaattactacattgaaagtacctttcagtggtacctgaaagtacctttccaaaatgttgcttagtttacatataatcagaatgctgatactactcattatattcaaagtatccattatataaaacaaagattgcattaatatagaaaatttaaatattgctttgaagccagtgtacttagggcatc

SEQ ID NO: 93937 - DNA, 1038 bp, Homo sapiens
tgcaacttaccattgtgaaactatagcgattagctgactaatatgatcacttgtgttcagaaatggttcttgtctacctgagcagaaatggccagtgttcttggaaacacagagcaaagccattacgagggctttccagtcttatagttcaccattgtcttaaaaatcacattctggctggtgtggtggctcacacctgtaatcccagcactttgggaggccaaggcaggtggatcacctgaggtcaggagttcaagaccagcttggccagcatggcgaaaccctgtctctattaaaaatacaaatattagccaggctggtggtgcgcacctgtgatcccagctacttgggaggctgaggtaggagaatcacttgaacccaggaggcagaggttgcagtgagctgagatcttgccactgcactccagcttgggtgacagaaaaatactccgtctcaaaaaaagaaaaaaaaaacacacacacattctgaagctggtagtggaatttttagtatggacatcataaagcatgtcttttgtatttttcctataattttgcacttggtatgaatgtacactaattgtttataattagaaaataaaagtaatgaattttacttctggttatgatgcatttgctcacattagtagtttatgctaatgtgcttttctggcctttagtgactattcatgctttcttaaatacatttggatgttgaaagtttcacatttcatactgtggaacaggcacgtctctactgtaggaacagttctaatcaaaatagcgtactctaattatgtaaatgataagctttgagaagaggatcctgtacgaaagcccatttccctgttttgctagtagttttttcttatgatgcacatttgggagataagaagtgaacgtagaaaaaaaaaagaaaaaaggaaaactatccccttgattgtggagtctcacttcatatacataattttgtttttgaaatggagtctcactgtgtcacccaggctggagtgcagtggcgtgatcttggctcactgca

SEQ ID NO: 93938 - DNA, 1013 bp, Homo sapiens
aagtccaaaaatcctatggctacctacagaggatcggcagggaaacaaggatactggttggagccctgatcagtcagtgtgctcaaaacagaggccccgaggaggatgctttccttcaaacatggtctgcctgaaagggcttcctggtagatccatcgctatgaatacacagacttcctgagtgtgagattctgaccacgggactcctgacatctcttttctgatcactcattgttttgttaactactctagggagaaaagctagtgtcagcccagtctgaggtagggattggattccaagaacagaatctgagaggattccaagagcagaatcagagatgggcttcctgatgggatttcaaactgagatttctttttattagttgtttctattttattagtttgcatttgatcatatcctttgaaacgcatgtgcatgctttgtcttctttgtacgtttgtttcctttgcgggggatggggggattatttttcttaagatgaggttgctgtttttatcagcaatcactgtggtgaggagacacaggccgttagatgatttctctcttgtggggtggttttataggccagaatctagggaatagctccgttttaatagtttattggcttcccgattgaaatactaactgaaaacccccaggctttggccttcagcatttgttttcatccagtgaccagatttatggtgtttgctccatggcctgtgaataagtcctgtttttaaaaactggacacaacccacacctttactactgtttcctatgcagttccttactcctacatggtggctttgcttgcctttgctagcttttctttttatacctctgtacattactctgttgatccctattcctgagatgatcgagaatgatatgggatgtgtgtataagaaatgggtgtgtgtggatacctccccccccacctttttttcaacacgtttcaccagatgcctttttcactgcacaatagttttcactggtatactttttgttc

SEQ ID NO: 93939 - DNA, 1053 bp, Homo sapiens
gaagcagagctagtgttcaaatttgcactacatgaaaggttttttttcttgttaaataatatacagtatttcttaaagtaacaaagttctgccaagcagcatccccgtggtgtttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcctggctaattttttgtatttttagtagagacggggtttcaccgtgttagccaggatggtctcgatctcctgacctcgtgatccgcccgcctcggcctcccaaagtgctgggattacaggcgtgagccaccgtgcccggccccccgtggtgtttaatcacatcctctttctttagaagtagaataaaattactcacatttatcctgctgaagataagaaaataaggtcatattggaggaataatgaaacatatttatgctttctgcctcagttgcctcatgtcttgaatggggaaaatatctcttagggtttttgtgcaattgagtgagttcatacgtgcctgcagattaggagagtacttggcacagagtaaatgcacaatacaattagctcttgtaagcattcatttactcagtagggtatattgacctgctgctatgtgccaggtaatatgctgggcattaggaggtaaataagtcaaagtctttgcccacaaagatctcagaatcaagtagagtagacataccccaaactgtgtgctagcagcgtgaatattctcatatagaggtatgcaaggaggtatggacacacagagtagggatgagtagggactgttaggcaaaacttcctgtaagagtcagggcctgagcttgaaggatgagtagaagttaaccaagtgaagaaaactgtaggggcaaagggagccaggaggacagatgatggtagtgaaaggttggtgtgaacatgttttttcaattcagaatttcttgaagaca

SEQ ID NO: 93940 - DNA, 1032 bp, Homo sapiens
ctttgagcaatttattttagtcccccgggcctcagtttcttcatctcagggtcaatcataaaatggggatggtaatagtatctgcttctagagttgtgaggaataaatgtggtaatggtcatcccagcacttggtcttcctttccttaggacccttcctgatgtgccccagattctgtatgccatctctttcttgcggtggtattgtttcttgtgaattgttatatgccctcagataccaaattcttaagttggtgggggattgtattttaaattttttgcccatcctaaagcgctgtgtaaatgctgattgagtataattgagtagctttggtagcagtgagtataattgggtagctttggtagcagtgaaaatgagggcaatgcagtgaggaggacctcattttcagtcttttactaaaagctttactgaccctttattggagaactttctcttagggcctttaaaaaatatttaattttgttgcttattcagccaaatggagttagttattcagtagaaaatggtaaaaagatccaaataacaccaccggatttcacttttccatatagtgtttcaaagcgttgtattcattaatatttgtgcaaaaacctatggttaataccacaagaagtcataaactaaaccagatttttcccctttttaactttcacatgacttggattaacaacagcgttactccctaatttacaccaagcattctcaaaaagctgaaacaatgattcatgtttagtcaccgtgtgactggctattttcatttatttaaaatataaacaacaaaaaatatcctggataaagatctccacatattttaactagtgacagatgctatgatcagtatttttacttaagtcaggcattttttacttacacctcaagccttgcaattaagctttaggcctttccaagcataacagttaaccaataaaccaaaatatcagcctggtctggcttagctcagcggtcttttgatttcttccagtctgtttgatgtggaggcttattgagatt

SEQ ID NO: 93941 - DNA, 1098 bp, Homo sapiens
tttaatgtgtagggttatttcctacagatagattctcctaggtgtaatttatgtgtcaaaggttataactggcctcagactctatttacatattgtcagatttcttttcttttccttctttctttttttttttttttttttgagacaaggtctcaccgtgtcacccagagtgaagtgcagtggggcgatctcagcccactgctgcctcgacctcctgggttcaagcaattctcttgcctcagcccccaagtagttggggctacaggtgtgccaccccacctggctaatttttgtgttatttttagagatggggttttgtcatgttgcccatgctggcctcaaactcctgagctcaagtgatctgcctgcctcagccttccatagtgctaagattgcaggcatgagccacacccggcccttgtcggatttcttgaaaaacattttttcccatgtcaccttcctactcaggaatttttattagctttctgttgcctacagtctaaagtcatacccatctaattggtccttttcgtttttaaaacactttctaagaaactttttttgttttaaccacctacttatcattgagcattacattccatctgattttccacataataaaaagtgatgcagggaatattctcttatgcagagagaggcatgtttttttggattttttgaggggataaatgatcagcagcgaaaatgctgggttaaagaatataaacattcaatgaaactaataaccaagccttttaaaaaataagattatatcagtttacaaatttaccagttatgtatagtcttcctagtagtgagaataataattttttttaatgttcatttaagggaatgtgagggggaaatttccgtgtttttttcagtttgcattgtttttattactagtgagatttcaggtttgtccacattatttgttggttaattgtattttcttcggcttagctttcaaggccctctgtaagttggacctgcccttttcaccttatctgctgttattcaaacccacaaatatttattaagcccctgctggctaacttctcccaccccaacaaataaacacactctaatcaagccaat

SEQ ID NO: 93942 - DNA, 1211 bp, Homo sapiens
gctcttttcctttctgtttattgctgcgtgactgacttggcctgacagaatgaagaactgattttatgtaaaatcagaaccagcaaagctctgcaacctgtgcaatatgcatgttttctaaaatagcctccatctccatgtgagtgagctcagcttcatagctcctcatttcttacaggacaggagctaaactaatatggcgcttagctctaggtctttccttttagcccctgtgtgtattaactttcagctgtgagtcccagctaaatgatacatgtcaatatgtagcaatcagaaaaggtttatttttgacttcttggagtgtgctttgccaaagcttcatgcaggttcttaatgtatagcattgtctagcttttgcacactctccaccttaaatcagtgagccaatgagaatttgaaagcacttatcatgaactcagtattaacataataggggagtacatgaagaatataaaacttggatcttactcaaggagtttacagttcagttaggaagacaaaaattgttacatgtgagtcagatacaaataggagacaccatataaaaatcacctgtacaatgtgatgtgagtgatgaacacattagaaatttataaatggtagaattgagtggagtatatgttggggggaagtagtattttttacaaggcattgggaaatgagtagatttggggtacatggaaacaggtagattgaaagaggaacaaaataatagttttgtttactgtgttaagtacaatctctattctgtcttattaaagagagctcatattcaaattaatagcttaggataatttagtacaatttaagaagaaaatgtgtttctaaaatcatgggatgatccaagtaaaattgtttctagtgactatgttgggagatgttaaattgtatttattttattttccagggtataagtgatagagaattattttagttatttttcttagcattttagtggtgtaggtctggaaggatccttcaaggggcatctaatccagtccagcatcgtgcttatagagagattttgaagcaatttccagacagactggcttctctcctgttcttcatgttttctaggaaaagagattccacaagtttctgtggttacccacgctattgtttgggaaagaattgaattctcaaaactaaaattgaaagctgcagggcaattgggttttcatattttagag

SEQ ID NO: 93943 - DNA, 2924 bp, Homo sapiens
acaagaatttttggagttaaaagggcaaaggatgaacattccaaaacaaataggtaagctccatttaaggctaactttactttttttaaaaaatacaatattgtcctggccaaaaacaaattttgaaattgtgcctactgttatagattcatctagagcataaaactataaaaatactgtaatgaattaacctatgctgccaagttataaacccttgggcaaaaatatcaactgtttaataagtggacctttcaaagcaacaaaaatttagcaaggtagcaaggggtgaaatgtagagcttgtttctccatgcaaaagctagtgttttttttgtttttttttttttaattgcatcttctttaagtagtcctgaaatgtcttaactttacttgtatatattatcctagcttgtataatatctttaattttataggtggaagtttaaatgtttatgatcctctcattagaacatctctcacattacctttgcattaaactcttgtactaagaggagcacctatatgtgttaaccacaagaaataaacagtgctttttacttttggtctttagttttatgtttaacctctaatttgtttttgtctttaaaaaacagcttttttgttatgcctgaaaagaaacctgtggaaccattttgattttgggtagtttttagataaaaatgcacaagatctgtttgtttttaaagaagaaaagctttgaatagttgttttttagcacttaagaggatttaatggtaatctaattgacttgcagttgttaacactagatgtcactgttgctgcacatttaattacttccttaactttatttaggatccagtttggcccagtggtctttctcttgaggatctagagttatattcaaagccctattcccttcttccctaaaaaagtcattatgcttcatatttaagttttaagctaatgtttattgaaatgcatttttgtgtgatggaactaaatcttaggaattaaaaaaatatgaaatcattttgtgatgtactagtgataattctaatgaaacctactatggtatttccgaattatcatttaaattgcttcttgtcaccctgtaacattcaccagatatttaaaaggaaggtaactggctgtaagtataaatcccttgagcatgttcaggcaataccagagagctttttaattttttttttaactgagtattttttaaataaataaaacattactcttgtggagggatgattataatttttattttttagcctgttcttaaagaaattcttcctgtcactaacttgaaatcactaatatttgtttctccttagctttgtctattttgttaataattctccagtgtgctacagtttaaaacagttgggtcatgttataaggccttgataaatactggtataaatgaaatatgatattaagtcatcaaacaagtaaaattaatgtttaaaactgaacttgaagaaaatttttttttgttttttatgaagtgattcttgaatatatatataaatatatatacattttactatgtataggagaaaatgatcagaaaatgagaaaacctcatttaggttgtatctgagggaggaagaatagggcagtgatactatacaattttaattttttgccaaagttacaatgatggaaacctccattataaatttattcctcttggataggaaagattacaaaatatataagatttctagaaaaaaggaaataggaatgagaagtttttaactgtgaagaatgtgagagcttttaattttagtaatctgaagatcggtatggaccattatgtgtacaaggcttctgttccctgtttaacccatgaagatatatttcttggcagctcccattaggtttgctttgcaaaacctttagtgtcttaaatttgcagttgcttgtgatggttcttttagttttagtttgtttaattatgtcactttttgtttaaatgtttatatgcctgttccttccaatattaactttctgaaggaaggacctttttcatctgttctgggtacgtaatgggcactttaagaaggctagtaataatgatatcttggttggttacttatccaccggataactaacctcagccggtgacacacctcacaagtcagttgtttcctttcacaaccacagattgtcctgctcgcaatttggaaatgtgtgttcttggtcagagggaactggacataaaaagaacatctgctttttccatctaatgggaaataaaggtctgacttggagtaaacaaacctggtttctaggcattttgctgccactggagatgaccttaataggcccccttatccactttgcacttcagtttctccatctatataccaggaataataagatctgtgctgtctactcctagggctattgtgaggataaaacaaactattagaagttcattttctttaacatattggaagtcctaggcaattagagatatagtttggtttttctttctgttaccacttctgtgattgtactcatctgattgtcttgctcttaagaccgtgctttttgaggacaaggtcagtatcttaaccattcttgggtacctagagtctagcatagtatctggcatatagaaggcatataggaataattgcctaatgaataagtaaattttgttactagaggagaaataagaaatctggtttctactcctgcgtttgttacaatataaccactataatcaactgagacaaaatagccaacctctctgggctttggttttcttctctgtaaaataaggtttggaatattcctgaggtcttttctttttttaaaatactaaagtaaggctttacataatgttactggaattgtaagtttggtaaaatgatgtattcccagtgccgtagaacagtccctgtcgcatagtacagacaagaa

SEQ ID NO: 93944 - DNA, 1083 bp, Homo sapiens
gcatttagttccttttagtcactacctacatatatgaagttaaagcactcctcatagctccacttcaccactagggagtaaatattaataactatcaagtactgcttgtacgttatagtctggacttcctcagttaatgcttcatagtaggacactcctttttggtttgtttgttttttgagacagagtctcactctgttgctcatgctggagtgcagtggtgcgatcgtggctcactgcaacctccgcctcctgggttcaagcgattcccatgcctcagcctcctcagtagctggaattacaggcatgggccgccatgcctggcaaatcagctgaggtcaggagtttgagaccaggcccaatcacctgttggccaggttggtctcgaactcctgacctcagggatctgcctgccttggccttccaaagtgctaggattacaggtgtgagccaccatgcccagcctatagtaggacactcctacccaactgtaaagggccatgctaggtcagggaacagattgagagctgaagtttacaatcaagtacgataagtacatatgattttatttcagaacctgtgggaggtgttaaagagagcccacaggccagaatgaggactgtggaaaagaaaggggattttatgtttattggatattggcaaagtgttagataaagggagcccatgggccagaatgtggactgtgggaaagaatccccattcttttccacagtcatatggaacatagtcatatggcacatagtggccagtacccatagatatgaaatgtctttatttctttaaaaaattgactgaaatgttgttaatcaccattcaaaaatgatcacttcaagacatttttcagtgaaatgtgaaaaaaatgtaattggttctattttcctagactatcacttttaaaaagtacatgttgagtatcttttatctgaaatgctggggaccagaagtgtttcagagttcagtttttttttttattattttggcatatttgcattatactgaacaggtcagcatctctaatctgaaaatctaaaatgctccaattagcatttccttagaatgtca

SEQ ID NO: 93945 - DNA, 1563 bp, Homo sapiens
aaaatcccaatgttcctaagagatctaattctcactgtaaattggaaatcagttatctttctgcaacttttcttcctcaacttaaaaaagagtgtttttcctttggactttatctgtaaattttcatatattaatttcagttaaaaccaggtactaccttgctaagataattgtgtctacctaccactgaatttggtattccttgggcaatgttatacagtctagtagggcatacatttaaaaattttataaaaattaaatgtacttgagcactctaagatagcgcttaatgtaataatgcagaagctcactgatgtaatgttcaaatcgcctcaaaatgtttatgcctcttcccagataaattgctttaattctccagaggatctggttgaaaattttgtggtaggcctcattttgagagagatgaaaatgattactaaaatacagtttaaaatgtgttttctttgaatatgtgtaatccctataaacatagaacataaattatagtaaactataaacttatattctctttgttggaaatcttgagttgtatagtatgaaatatctgtgagaccatgatcaaccttttcctgaatattttgagtgtggatgcaaacccatgtatcaaaatttattttgcagacaagacacatgctttaaacactgcagttgttagaaatgaaatctttagatcttaagacccataataaagaggaaagtaggtgaaaagtatgagacatgttttagtttcacccccactcaatataaggatatttattatttactaacagtgtaaatgtgcatcaatagtttgtacttttaactttgatacctaattccgaatatttgattatatatgccttttaggtgcccaaatgtgagtctgcaaaagctgccagaacagtggctatggagtgttttagaggaaattaaatgcagtgatccttcatctaaactctgtgctacaaggcgcagtgctggaattcctttctacatacaggtatttatctgtaggaccctagctgtttgtttatatttgtcttttgatgatagtgtatcctaacctgtttgacgtgtgagtgagcgtattacacataaaggacatttctgtcttttcagcaccatagcatttgtggctttgttttaatgtggggatggtgtgttcctgtgacaagatctgttcttggaacaaaccctctaaaaggtcaatcttgtaatataaacagagggtggtataaatttctgtctgtgtattaagtaggcagacatcactgtggcacagtcattgctcacttccaggaagtgcacatgttaccccaccaccccactgtatttttttttaaaaatagtcttcctttcatctcaagaccttcaatactctctgtaggcaaccagtgttaacattttcttttcaattctcctataaaacgtccatccataaaataatcatgatcataatagtagctgacatttattagtggttatttcacctcattaactccttccctgtaccctattatcatccatatattctagatgaagagactggggtttaggtacgtt

SEQ ID NO: 93946 - DNA, 1102 bp, Homo sapiens
gctgtctgcttatttagtggaaaggcattcactaacaaaagcaggattttggaattccccatagctgtggttggtgactacatagagttggctcaaagaaccaaggactgtttcactcgagaacctttctttttatatccttgctaggccctggattgtgtgatgaagaaccaaaacaaacaactagggtttgctgtattgttcttgggaaccttgcatggtttcatttttacctctcaattccttcattatcataaacaccagcaaccctggagttttgaaatcacttccttataaagaaatctttccttgctggggagcagacagaaggttcattgaatagtcagaactctattctgctttttataggcacagtgacctcactattgagaagacttagggttccagctccctgctttttatacctggtttgtcaattttatgcctacctgcaggcacagctaatgtgcgccagctggcaccagcactagttgctccttaattattcaacaaaagatttcttaaacatctactgtgtgccagatgctgtgtttgactgagctctctttgaccattgagaatatgatatggtaggccacagttactgtgaacctagacataattaccagagtctaaataggaaacatataactgtggaagtaagagagggatgtgaggacttgaataagggactaaggattgtatgggaccatgatgaggagttttggggacattctcatcaggaactacttatgtattttagagtcattatcttctctatataacccagggaatgttcattgaattttcaaagcatttttattttattttcattctaaagcactgagaatcaagtgatttatctatagctacacatgtagttggtgattgagccagcactagaatctaaatgtttttctggaatttcatagcatttcagaggttagcagtttaacaaaagtttattgattattgctttctataaggaattgtgatagctaggataaaaatattgataaaacatgggccttgtttttagaggaactttcaacctagcattttaatctttgggattagataagtaagtcacataatttacaag

SEQ ID NO: 93947 - DNA, 1050 bp, Homo sapiens
tggggtttcgccatgttgcttaggctggtctcgaactcctgggctcaagcagtatcccacctcagccttccaaagtgctgggattacggacatgagccaccgcgcccagcctaaacttttatttacatttcatttgggaaatgtgtctaaataagacactatttctcactgagtgtcctattaattttatttgaaatatgaataattaaataaagaataactaagagatgagccaccttggggagccatattcttttttttgttttgttttgttgagatggagtctcgctgtgttgcccaggctggactgcagtggcgcgatcttgcctggggagccatattctttatagagagaaaaatccttttaatttcccttttctattgtggattaaaagaatttggagaaaactagaatgtcttgatgtatacattctaagtgtttgttaatgattcctgcatttttattttcatttttaagcctactgtaatagttgagtcagatattactgtttttcctcgatatttgaacactcatttaaaaagttttcataataacactttgtcatttagacaatagcagagggactttgttctcagtgagtaacctctatgccagctttttaagtaaagttttagaatttttttaatattaatttttctccttgatcttagggaatgattatattaaataattgagagaaccagctatctggtacatcttccaatgacttcttttaatccactgtatcttgtccttctccccatggccctctgattggtaattcaatttagatttggtcattgtattattgcctgtgcctgcagctaagtcttcaaaatagccccctaatgttttagcctgcagtaagcctcaataatgtatgatagtggtgagggaggttaagatggcttctcttgatatgtagctttctaacaggatttcatttgggcaaatcatttttcaggcttaaagtttcctggtgcttcagggttgtgttcctatttaaaatatacatgcaaacaaccttcctgcacacatctattagtgtt

SEQ ID NO: 93948 - DNA, 1528 bp, Homo sapiens
ttgtatctcaacaatttgggcagggctcagctgggtgattcttccttagggtatttactgagttcagttggtggcattcagctggcagatgaactggtcacaagggacctaagacaacttcactcgcatttatggcaccttggtgggactagctagaaggctgggcctagttgggactacatgtagcctctcaccccagcatggtagtcttggggttgaaattcttatatggcagcttgcttcccccagagagagtattccaagagaatcagccagaagctgtatgctcttttctgacccagccttggaagtctcattgcattgctttagtcacattcctttgattttaagtgcatcttaggaccagcctggattcagtctaccttttgacagcaaagtggcaagatcatattgtagaagtatacgcagataggagatgttgtggtagccatctttgaaaaacgccatctgccacatgaaccaactgaatgtgaatagtagaggttactagggagttcatggttgcttctgtgattctaagtcttggtcaccagacaaatggggttgatgttaacaaaacaaaggaagttgaaagagggaatggtttgataaagatgagtaagtttttttgttttttatgtgttgagtatgagataatgatggcataccctggtggaaatacttaagtcagatgttagagataggggattagtttgggtgatataacaaaaacagagatgtagatctgtgagttttctccaaaaatatcatagtaagattgcagtctttggtggagagcatgaaaggaaaaaagaacagaggtctaaggacagaggcttttgaataactgtggttgaatggtacagttgaaggcattccgaataaatggagcggggagactagggaatgcccaatgcctggtatcttagcccctcctaatctagtttaaagattttctcatggctgttactgttggcttttaaccaacctgttaggagttctcagctgttgctttcaaaccaagtagttcttgatccctttagagacatttcaaatctgctgaacagaatgttttgcagagaacatctttacagtgtgtgtggcttccttttgtttggtttttatttttaaaagaaaatttgtttcttttggagcccttttgagagcgttttataagcccttaagttatgaaaaagttgtttaggcatacaacatttaaaaagtttgcaaaaagaaatctgggcattcatgaaaatccacagaaatggaggccaactgctggccacctcttgaactacagctgtgttaaggaaggaagcacttaaagagattaatggataaataactgaagagttaaacatgacccacattgtttgaattggtttttaataggattatgcaaaatgtcttcaaatataaactgacttcactattaaacaatcatctaagaataaatagggatggagacattgttactttttctgggaatgttttgaaagcaacacttgcaacacacataacacaaata

SEQ ID NO: 93949 - DNA, 1974 bp, Homo sapiens
aattaaaaaattaggtgggtttggtgacatacacttacagtcctagctgctcaggaggctaaggtgggagtattactgtaacctcaaactccttgagcctaggagttcgaggttacagtgagctatgattgtgccactgcactccagcctgggtgataaagcaagaccagaccctgtttttttttttttaaaaaaagtcatatttgttatttgtctaatcttgtgtggagaaagacagcatgtaggaaagccactgggtgacattctggcaaattccatggttctgtcttgaagtgaagcctagtagtttttcaggaggtcctttgcaccacatcttgcattgtcattaacaattttatgtctctaaaaggtaatacgggttattttttaatgggtatggagtttccatttgggaagatgaaaagttctctaaatgcatgatggtgatggttgtacaaaagtatgaatgtacttatgccacttaattgtacatttaaaaagggttacaatgataaatattatgtatattttaccacaataaaaaagaaaaaaaattttaaaagaaggaaaaaaggtaattatttcacctagacctatgtgtgtgagtgttgtcgctttgtgtgattttctgttggagttgaataacatgagctataacagaaaacatactgaggtttgtgaatgtgacataggaaggcagttctagtgtagcagttaaagatggtcaactctggagccagactgcttggcttcatgttctggttccattgctttcttgctgtctgaccttggataagtttcttagcctttcttggcctcagttttccaattgtgaagtagagataatgatcgtacttatttcatggaattactgtgaggattagatgagctattgttaaaaaaaaatacttaaaatggctgggcacagtggctcacgcatgtaatcccagcactttgggagaccaaggtgggcagatcacctgaggtcaggagttagagaccagcctggccaacatggtgaaacccatctctactaaaaatacaaaaattagccaggcgtggtggcaggtgcctgtaatcccagctacttgggaggctgaggcaggagaatcacttgaacccaggaggtggaggttgcagtgagctgagactgtgccactgcactccagcctggacaacagagcaaaaatccatctcaaaaaaaaaaaaaaaaaaaaaagcttaaaacatgttctgtcatatggtaagcgctaaatgaatggacccctagacctgggttctaaacagtgttactgatataaatacacttgcgaatgtaaacataaatcggacatttgtttttgctttttttttaaaggtaaaagaaataggagattactttaaacaacaccttttgcagtccaggcacagaggagcatttgaattggcttatactggttttgtgaaactcactgaagtactaaacaggtaaaacaaatatccttttgtgtacgttttaaaaagactaaatatacaaagcatatgcttggagtagaatttagttgtgtcttttgaagtttaaaagaataagacctggttgactacaaaactcttggaagaaattgttttcttaggtttcattgtatgatttactgcagataactgattgaaacgtccaaactgagttattattctgtcattgaaaggtgatttgaagcaaactcaaagattttgctaaaaatagctttgaaattactgttttttttttattgaatgaaataaatgttttgtctgtttgaaaattacttggtgtttggaataaaacaggccttgcaatttttggggtttgtattacagaagcacttaaggattttggtttttttcttcataattttatcgtatagaaaagtttaaaagaacagtaagtagactgaaaagtagaaaatatttttttccttttacctggaaaactacttagatagatttcatatattt

SEQ ID NO: 93950 - DNA, 1954 bp, Homo sapiens
tattttaaaacattcttttttagtttagtttttttttttttttttgagtctgggtcccattctggcgcccaagctagagtgctgtggttccattttgactcacttcagcctcaacctcctgggcttaagcctcccaaatatttgggactataggtgtgtgctaccactcctggctaatttttgtagagacgggatctcaccatgttgccaggctggttttgaattcctggactaaagcgatcctcccacctcagcctcccaaagggctaagattacaggcatgagctaccatgcccggtctaaaaattgtatgttagattctgttgtaacttttatgatgcccagagttaactacattgatgtattccctcagtagtgtcttttgttattactttagattttctgtaatgaactacaaatgggatatatgtttattcacaagtcttaaattgctttttgtattttcttttgccaaagtttattttttagaaattacaaataatttcattgaattgcactcaatgcaagttcccatttttaagctttgaaatgaagttgtgcatgtaaccacatcctatttattgactgccttactacaaggatatcgtgggaaaataaagaagtacatagtatgtggttctgtgacgtcaaagggcttagaaatacaatagaggataccagacagaaattcattttaaaaagtcagactacagggcaacagttaatattgcccatggttaagaatttgctagaaagcaaagaataaacattctggtaagatgatatctgagtggtagaaaattattacctttgttgttttgtaggagaacagtgtttgagctttgaagaaatcccaaaagttagtaacaaatcactgtaggagagaaggtacagtttaaaacattaactgttttactggagtgtaaacttttgtaaaacatcccgtttaaccaaagtgaaattagaagtggctgtgtcttaaagtcagaattcaaattaaggcttagggattaaggctcactactttatagtataaaataaaaataaaatggacatttactgtttgctactctttgccaggtactctgataaacacttaaatgcataatcttattatttatttctcacaataatcctgtgaagtaggttctagtgttagctccatttcacaagtaaaagaactgtgtttaattactttgcgttagtagtacatttcagaatttaccttctctagataaagggtagatttaaaatatatttatattttttttaatgggttttatgctttagatgagcatttagatcccctaattagtctgttggtgaattatacctgcctggaaacatggcatgtagcttcttcccctgtggaaatttataccctgtgagtccataaaacatgttaatttccctatagagatactttttatgaaaagttaagagcaggatatgctaattttaaaaagacaagtgattagaatttaaatttctgttctttaaattttaagaacagaaatcactgtatttttctttcactttgatcttaatttcctttataaaaatcctgagatgtatgttattaaaaattattttgctggaggtaacatactaccagacttcaaaatatactacaaacctgtagcaacaaaaaagtgtggtactggtgtacaaacagacacatagaccagtggaacagaatagagaacccagaaattaatgtatctaccgccaactgattttcgataaaggctccacgaactctcattgggtaaaggactgtccaataaacggtgctgggaaaactgagtatgctttcttcatatgcagaaggatgaaactagacccacctctcactctatacaaaaatcaactcaaaatgaataggctgggcacggtgggtcatgcctgtaatcccagcactttgggaggctgaggcgggcggatcaagaggtca

SEQ ID NO: 93951 - DNA, 1020 bp, Homo sapiens
gaagtgtattttgcttttactgtaactaagacgtgaaagcttcctatgaacattattttgccttgacacttttcacatagcacccaaatcttatgtatttaatttgtgtgcgacagccgtgttaaaattgggaattaatgtaaaataagagatgtttgttaaaaaaaaaaacaattatcacaaaaagacaggttcttataaaccaaagaattcttccagtgactgcttaaataaaaaataagatcctgactgtttttctgtaaaacattagtttccgttgtaatgaggtccagtcatttttctatgttgccattcacatggtaacctcacatacataggcgtgagaagaaactgatgactgaatgagcgatgaactgtatatgtaatagcagtgttctaacactggaaccccgtcccctatgaaaaacttgattcttcgtattgctgactttagctaaagaaatgtctcagtttaggagtcaataaaaatccaaagtcatcaagaaattagtgttatttacattactggagaattcctgcttttaaacataaccttttgccccatgaacttcctttaaattaataataattaaatatacttacatgtgcttaaaacctttaagagttaaaaatataaatgacagagaagaacatcatttacattggaatggctgggccacacctgaggtacacccttccaagagcatagttgccctggcaaagctagatctgtgcctagtggtaaaactatgagtttaagagtcaagccttaggtgaatgtgactgccgtctgaatacacggaggcagtgaagtgacttgcaggcagaatgcaaccctagttagaggggagaatgtggaacttgcatttcttattcttcagagtagtaactgtgatctacttttctctcaatggatgaagaaagccattccatacagtctaaaatacaattctattctattttgaaatttgatgacttgaatgtagatgacagtccgtttaaaatcatcctgattttaca

SEQ ID NO: 93952 - DNA, 1030 bp, Homo sapiens
tgaaataaagtttgtaaatgtattttagagtgcaaagagaggcttgtattagaaaaactgactgtatcataaacactcactgaaccatatgctgaaataccttgggctgataattaaggtaatgtggagttatgtgttttgcacagagaatattaggttttgttctttcctaaaaatgagttagaagattggtgatggttcacgatagtaagacacatttatttagcctgttgttagtctaaataccaaattattttatttaattaatttttttttggtagagatgggatcttcctgtgttgtgcaggctgctcttgtcaagcaatccttctgccttggcctcttaaagcattgggattacaggccttagccactgtgctggccttaaatactaaattttgtcgctttagattttctacttgagcagtgcataagaataaggaacatgcaatcttatagctaatatttgggtcagcaaagtacccatatattctggatgagaaatcttgaatatttctgttacctactgtgggtagatcctacagaggatgctaacattatctttattagtgaagagttttaaggtatcagttggtctcaaaaactgtctttgccccacagacttttccttcattctgcctgtctttttacctctggttgtcttcatttttgctgcttcttccctgtgttatctgccatacattctgaattgcatgaggaaagtctcccctgaaagctgtaaaattgaatggataggattcttaaaaatttattctctgatcttttcttggtctttgcgtggtttcttttggggtcattgttagtttttcatggctgttgaaatttatttttgacaaaattccaggaaggaacataagatgttgattgaatcatcatgatagtaatttgcgtgtttgtatttcccatagtacctaaatataagtcaaaataatagatgtacaataaataccggttcttcgatttgttaattgatttcagatgattaccaatggctagttttgaaaatctg

SEQ ID NO: 93953 - DNA, 3118 bp, Homo sapiens
cagtcaaggtagtgaatatttccatcatcccccaaatttccctatgtcccttcctggactattattatttttgagacaaagtctcgctttgtcacccaggctggagtgtagtggcatgagcacagctcattgcagtctcactcctgagctcaagcaatcctcccacctcagcttcccaagtagctgggactgtaggtgtgtgtcaccacacccagctaaatttttaaattttttatagagatggggtttcactatattgcctaggctgatcttgaactgctttctggattattttttacaaggtaaaaagaatcatatacaaatttgagatctgttttggctttacttgtagttttttgttcttgtaaatttaataattgaaatttgtggtcattctgtgtatttaatatttttaaagtctaaattgttataaaatgaaatttcttttactaatcagtttacaataatggctcatggctcatttttcttcaggattaaagagccaacgctggaaatgtttctgtctagaatcttagcatcctggactaattcagccatacaagtccttgaatcaagttccccgagcctaacggacagcctgaatgggaattcaagtatagttgggagacttttggaatatgtctatacccattgggaacatccattggatgctctgagacaccaaaccaaaatcatgttcaaaaaccttctccaaatgcaccggctcactgtggaaggtgcagatttcgtccctgatcctttctttgtggaattgactgagagtcttttacgattggaatggcatattaaaggaaagtacacgtgccttggttgtttggtagagtgcataggagttgaacatattttggctatagataaaactattccatctcaaatcttagaggtgatgggagaccagtcattggtaccttatgcaagtgacctcttggaaaccatgtttagaaatcataagagtcatttgaaatcccagactgctgagagttcttggattgaccagtggcatgagacttgggtttctcctctcctttttatattgtgtgaaggaaacttggatcaaaaatcttacgtgattgattattacttgccaaaattattaagttacagccctgaaagcttacagtacatggtaaagattcttcagacttctattgatgctaaaactggtaagaaaaatgcatttttgttttagtagtttctaattatgatgcttaaatgtaggtagctatgcagatactaatcatattcaaatttaaatatcacttctataaatagtaaaggaagagattaatgatagatgtttcagtttgaaacgaatgttcctatatatagctgaatggagttttttggctgaagtcatttctacaagctaaagaataattccacttaaaatgataaactttcctgtattacaaggttttaattcattttttcaagttctgaatttattttattgtatcactgaaataaaagtttgtgtgtcttatataatgtgcttattcaagtcattgagacaataattaaaaattgtgttaggcaaggttaaagacaggtaacttggcagtagcaagtttttttctctggggaagtgacaaaattcagaggcatgatctcaagaaatagccatctatagttatttagaataggggtaaacatcccattgaaactcacaaaccctacaggaatcactgcattcaagcataattcaggatgtgtaaagtgatgatcatgacacatcatataaatcttaaaattattacattctgtttaacaaagcaagaatgtagtatcgtacagcataattttaagaaatattttcaactaaaattgttaaaaacgttcagtacttcaaagagtaaccatgaggtagcaggaaaatttgattcctgtatgcaaaaataagccattatttgtaatttttgacaacacttgttcttgagtttttgaaaagccatctgaaattcaggattcaagaatctgttctgaagtaaggttgtctttatttttatatcaagctgccctgtcttcttggtaatggctgacgtcctagcctctgaaaccagcaggctctttgtgttccttttttaatctttactagtgagaaacagccactctaaaatatgcagagaggttcagtgtttacttttagagaagtaatagtctgtagccactgatgtgcttatttctccacctgattttatttcctgatttgctgcctgattccctttctaggtgttagggaaaaagcaaaaatgttagcaggtaaataatgatttgtttatgttaacgataagagaattatgcttacttgaaatgattgacaaaagggcaaatcatattaaataatgattattttagaataggaactttaatttgtgttagaaatgagtttaaaatgtgatttttatttattgaaataaaatgttaattggaaacatgaaaattagcagctgataattatagtagtcattgcataatacagtaatggtctttgttattgtgctttcaggacaagagcaatctttcccatccttagggtcttgtaatagcaggggggctctgggagctttgatggcatgtctgcgaatagctagagctcatggacatcttcagtctgcaactgatacctgggagaacctcgtgtctgatgcaagaataaagcaaggcttaattcatcagcattgccaagtaagtaaagaaaattacctggatttgtacatgcagtagatccctttcatgtagcagttcaatatagaggcccctacattgtatcctgaactgttttagggagttcataaagagaatgagtagaaaccctagtctcccaactaaactttcagtaggccctttcttcaagctactgaaagtttagttgaggatgtaagaaaacttacataaaacaactggaaactcttagaactgacaatacagatacaagcatgccatcatgtgcccttaaatacataaggactcgcttggaaggctcagaagagactgatcagagcaggtggtgcttgattaggaaagtgatagatatgattagaaaagaggaagccttggagcagcatacaaaatggagggacccaaatgagcaaggtct

SEQ ID NO: 93954 - DNA, 1085 bp, Homo sapiens
tttgataatttaggccacaatccttgtattttttactagtagatttctttttttgcttgctatattgtatggaaacttattttatctttttacctgaccttagaaaaatatattatgagatcacacaaagtaattatctttggataagtcgaagatgtttatttctcaaatcacctctaaaagcatttgtttaaaaaaaaaatacataccaaaaaaaaaaagcagttgttaagcttatccacctgcaggtggcgatgtgttgtgctctgccagtacattccaaccagcaaaatcattctcgtacttgatgtaatttttttcctttaatactaatacaataatcatgacatttgtgggtattttatctttggatttagtcatttttcctaggatttttcaggggaaagagatgtttgggtttgtattttgaaatatctctgaaaagttttaaaagctttatgtgtgttagctctgctatatttttccagattagcagtgtgctgcttcgttcagtggactgcaccagtgtccccgagtggtttatgagcagctgcaggagcctctgttgtggtgacatctctcagtcagctgtcttattcctctgtcaggggacacttgccatgttggactggcagaacggaagcatgggtcggagtggggaggccctgctcttggatactgcacatgttttgttcaccttgagttcacagtgagttttgatgctatcgtctcatattttgtttcacttgtaagacatttagaagatgcagtccaaaagctggagtggcttgtgcctctaatcccagctaccctcccagtaggctgaggcaagaggatcacttgaggccaggagttcaaaaccagccttggtgacatagtgagactgtgtctgtacaaaacttttaaaacttagctgggtgtggtggcatgcgcctgtagtctcagctacgtgggaggctgaggtgagaacattgcttgagcccaggaggccgaggatgcagtgagatatgattgtgccactgcactcaagcctgggcgacagagtgagatcctgtcttaaaaaaataaataaataaaattattgc

SEQ ID NO: 93955 - DNA, 1060 bp, Homo sapiens
ctgtcagttatcactcatccatctgctttgcagcttctgaaatactattgttattgtcttgttgcatattggttgcctttaagaatttatctttttacgttttcaatcccatggctgttggtttgaggaggttctgggagagaggagaaataatacctgtacatcttctttcactcagggtagcctttttccacagcaggagctctttgtctctttttctcctttttggctcttctttttatgctcatcgtgtaaaggtgggttctgtcctttttattttgttcgtttgaactgcttaataatgtccactttggtgtcagccaccacctatgtactcaggattcccaaatttattactccaagttagatctctttcctgagtggtagactgatggacatcagttgacagttaacttgtggacatctcagcttggatgttttacaggtacctcaaattcagggcgtccaaaagaaaggaaaatttatttttttaaaaaagtcttttcctgtagccccaggtaacctctattctacttcctgtctttttgaatttgcctattctaggtgattcttatgaatcatgtaggatttgtccttttgtgtcaggcttatttcatttatttttccttttttttttttttttttttttaattgagacaagctctggctctgtcacccaagctggagtgcaggattttggctcactgcaatctctgcctcccaagcccaagtgatccttccacctcagcctctggagtagctgggcccacagacgtccgccactatgccctgttttttatatttttggtagaaatatggttttaccgtgttgccctggctggtttcaaactcttaagcgcaagcagtccccctgccccagtcccccaaagtgctgggattacaggcgtgttttcgagggtcttccacgtttgtagcatatatcagaatttcattcctttttgtggccgaataatatcccattgtatgtttagaccacatgttaatcaatctgtcgatggacaatttgatctgtttctacctttaggctattgtgaataat

SEQ ID NO: 93956 - DNA, 1007 bp, Homo sapiens
gccaccatgcctggctaatttttgtatttttttgtagagacagggtttcaccatgttgcccgagcttgtctcgaactctcctgggctcaagcgatctgcccacctcagcctcccaaagtgttgggattacaggggtgagccactgtacccagcaattgagacttcaaagagtatctgtaaccatgttactttgctatatttgatattataaaaattacttcaatgttttgtattatagattgtgcctctgctggagaaagcagataaaaatggcatgtgtgatcccactattcaaagttgtttggatatcttagcaggcatttatctttctttgagtctaaagaatcccttgaagaaagtattggcaaggtaagaaaaaaaggaagggaagttgggtgttataaatgttgaatttgaccaaaagtaactgaagttccttccttggtttgataaaactgaactgatacagatcacaaaaagttcattcatatggtttgttctctgtttcattgattagttacaactattttttttttttttttttttttgagacggagtctagctctgtcgcccaggctggagtgcagtggtgcgatcttggctcactgtcagctctgcctcccgggttcacgccattctcctgcctcagccaccacacccggctaattttttgtgtttttagtagagatgtggtttcaccatgatagccaggatggtcttgatctcctgaccttgtgatccgccttctcagcctcccaaagtgatgggattacaggtgtgagccactgcgcccagcctagttacaactttttaaaagtataaaaagccttcttaggtcacatgcttaataaacaggctgtgggctgtagtttgcttactcctgcctcaatccatttacatttattggttatgtttaaatgtcatcttgctgttttttcctctttttgtcctatctgttcttggtttaaatatatatttacacagataacacaggaatataggcttgg

SEQ ID NO: 93957 - DNA, 1098 bp, Homo sapiens
ttagtagagatagggtttcactatcttggccaagctggtctcgaactcctgaccttgtgatccacccgcctcggcctcccaaagtgctgagattataggcgtgagccaccgcgcccggccctcaaatttcaaatttagcctctcttggttatatttctatccctttgtttctttctgtgataagttccctgataacatgtaacttagcatttttcctattatgaatgttatgcttttaagttacagataaaagattcctaggctgaacaaatagcaaaggacagaaatcaagacaaatgcttttcagctaagatttttgtgtctttttttttgtatttgggactctgattttcatatagttctgtataactatacactgtgtgcgtctggcatataaattctatagcacctgtggttcaactaaaagggcattagggaatcagaacatgaagactgaaatcccagccatgaacaaggcatattcactctgaacatcaatttcctaatctctgtaatgggaataacaattcctgtctcatagcatagctgtgaaataatgtatttgaaagttcctggttcctaaacactaatttgaatttttaaaaagttatcttctgttccctgaattatctttctttcttctaggattattttcctgtttttatgtttgtaattacttttcaggttgcaaacttttctcaaatgtctgatgatttttagtggtctatttatatttaagaataggacacctgcaaagtaaactgacaattatgtataaatggtcagttgctggttagcagtcaatcttttctttagtgtgagagggtgggagagtatctgctgggcggtgaggtcatagatgccatagctgttggactagtgcactccaattcacttattcaattttgtaagagaataacttttcaattttttagcaggaagtaaatgcttagttgctagacatttggcagatgggtttaagagagaaggtttcaatgaattagttgactctaagggccacagattttacattaatacctactgttttcagtctttcatgtcactccgcctctaggtctttacagggctctgcagggc

SEQ ID NO: 93958 - DNA, 1051 bp, Homo sapiens
acttccaaatcacactttgatctgcacaggtctcagagttatcgagaagtctgttaagtcttttcatcaactctctgcttaagacaatccctccttccacagtcacgtattcgaggtctccaaatataacagtgtggcccagatagaagggctgggatgcatcccttgtaaacaaaaggtactttaaattttcaatgacagcaaacgtagtgggaagtgcaaggaagaaccagttgtagttgtcaccatacttttcaaagacgtatttgtaagcggtcctcatctgtacccacctgtcattactttctatattgaacaaattatcatttttagtatcgtagagctctgctttgtcacagtgtttggtccaggtctctttcagtacagcccagtaactctcatcttcggattctccaaagatgatacagaaaacacgaatacttttactgagctccaagagtatcacttttgaagtgtttaagaaatcgttcctgttaggtggacgaaggtgatggtgctcgtggtcttgagtttgacctctgtgtcgaatgtgaatttggccaaacatagttatcaaaacccaggaaatgctcccaagcaacatacccttaaaaaatgatgtcccactagcggaaaccattttccaggcgttaggacagtgtgccagggtcaaaggcagcctgggaccgggtcctggggtcccgcgccttccggagctggcggctgcgctcccggttgggccactctagctgcgggaggtcgcttctcggtggcgtagagaagggggcggggcaggagcgggacgcggcggccactgcgggtggggtccgggctgctgcgggtgagaggtataccaggagttctgcacgcctggccttccaaccagcaataaagttgaaaatgagcagagatgagtcacagacggctctaaagtgagccagacatcagcactgagccaaaaagaataaaattgagttttacctcacgatttgtgtattcagcccctggtacaacacatcccgtatgttgattagcatggggtccttcttaa

SEQ ID NO: 93959 - DNA, 1100 bp, Homo sapiens
ttaggcagcaagaaattgaaattttgcctatcttatgatgttgagattttcagagatttaggttaggcttttaagttcgttttatttggcaacccattctactacttttttttttttttttttttttccattctgtcttctcttactcttttgaagctattcggtcctgaaaaagtagtattgcttttcaaaagccttccagcagactggccaagtctgagattttatttctgtgtttattaggtattttcaggtttcaaggaaaagagatgtattctaattgcctcaataaatatgagtttattttaaaaatttctaagagcttattttaaggcatagcctatccttattgaactggaataccatgcaaattacaatagtcactctagagggacaacatgtgatagtcagcagtacctccgatagaaacaagtgacatccattgcccctgctcccagtggctcagcttgtcctcccaggcctccagtcccctctctctaattctactactaaccactttcccccagtctcctagggcttcagactgcctcccgtctcctgcttactgcccttattgttatatgtctttctgttgctgtttgtgtgtgggtgtatctcacactcaaagaaactacatctgattcactcagccaggcactattcaatcgaaaatgtccctgatagtcggagaactcatgccagttgcctctcaagccactggctgtcttgaagaggatggccttagttgcccactgtgtcctggacagtcaactgtgtccaagttagacccattattaaattcaggacatgttgctctatgcattaggaaccacctgtggtcccttttctcaagggagcagggctagtaacctgtccagtacctgtttcagagatttttcagaagagaagagaaaacaaaataatctacttttggaacaagataatataaattccattgcaattctcatattcatttcttgtttgactttaggtatctcttctacttgagtgaaatgtacattgacataggaaggcgatagcatttaatgctactgtatctatgacttctgacttcaggtttttccattctttgtttaacc

SEQ ID NO: 93960 - DNA, 1107 bp, Homo sapiens
cttttttgatgttgagctgatgatcttgatgttgatgtagatttctacataattgacatgtccctctccacaacagttcctggattatcttgatttcacagtggttttaagccaaaggggattgaatggtgtgtattattttataactgaggacttcagtttgtggtcacttgaactatcataggtcttaaataatgtaataacctaagtgaatggtatcaatattattctaaagtcctttaaatgtagccatatttgtcattttcttctccttcaaagtgagtgatgccgaatgagggatgtagagaagtgagggagatggtagattctgaatgtggcttcttactgaaagtagttaagtgttcatttgccgtgggataaagggatccagccgtccctgagtggctgttttggtgaaaagagtaagataggttgtctttatctctgattaatatatttttttctttatgtcagtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgtgagtatttcttaattaaggggaaaaaatacctctgcagatttatgtgcacttcataacaatgtgtaagaaaataagttgaagacttaattacatgaggattagatctctgtgaagagccctcaggggatggcttgagggactgagcagcatgccttggctgcggcagtcggagaacatagctctctggggccacagtttaaaatacaaggtctgtctcagaccttcagctataggcatggatttaccaaatgtccttggggcagttctctcatttcaacttgaaataggatttaatggcctgtagttcaacagccaagcatattatgtcagtggtaattacttgttcatttacataagttggtttttatttcttcgtctaggaaattttgcctttttttttttttttttttttttttgagatggagtctcgctgtgttgcccaggctggagtgcaatggcacggtctcggctcactgcaacctccgcc

SEQ ID NO: 93961 - DNA, 1851 bp, Homo sapiens
ctgattttttccttcaacttgtggatgcaggcaaggtggatgatgccagagctctcctacaggtaatgaccctccactcatggagcagtggggctcgaggcttgcaagaagtaaattgagaaattactagacataggcgtgtggtggaatactagaaattcagtgtggtgtgcagctagcttgtttacattcagtgtgaatcacggttgcaggacaaggactggatggtagattttaggttactggttttaaagatgccagatcaaactagaaatgtctttagaattgaggtagcggggagcggcgggtggtgcgggggtaggtatggggcagcgagtttcgctgaaatgattaaagacaaatctttctgtgcagatagataatgcaaaacaacaattcctttgattttctactttaatttctcaaatgcgctagatactgtgcgtcaccatggcaacacagtttgcaaacaaaaagtaggaaatgtttgcttttcaagtacagcttctcacttgaatactcaaacattctcagtgccttattcaaggtttattaagagttgaatatgctttctattcacttgtgtgtcacagacacattaaatgacaaatgcaggtctctgtggcccgcactctcagttaaattagcaaccttcagggaaggagacaactgcattcatgccattttaacagcactaaatataaagctatgccaagtgccgacagaacagtgggtgatcctagctgccactggcaatgtacacaaacaggcaccgccggggagccccttcccagcaggtggcagtcaaacagtcaccgtgatcccgccaacggctgtgtttgtgtagactccctgtgtcaaattgaggcgtgggaccaatttctgatcgtaaatagtattatattcccttacatttttaccagctgtgaaagatcttaagtagtagatagggaaggtaaaactacccatgtgcttgacctccagtttttattcttcaagttcatctagtttgacagtagaatccaatccatttttaaaaggaatacctgaaaaactgtatctctgttaacagttttataaagggtgaattagcactgcttctcagactcttacttttgttgctggagaagggaaattccggttcactgggaattttcttgttttgctttgcttgtttactttttttcctttgtttttttttttttttttaattttaaggaaaaggcagtttatgatagggatttcaggacttttaaaattgttttatcttgctatcttacgtggtgaaaaaaaaaagaaggaagatactcatgctttatcttcatatgtacatgtctaagtacctactaggggtataataagcatatacatatctaattatacacatgatggtatgcaatcagttttaacacatccttttgatagttctttagaaagtggcacttggtacttcatctactagcttgttctctgccataatcaaggtttttctggaagagcacaattgacagccgcctgggtgggtggcagcagggatggcgcctgctccctcagaaagaactgcgttatctgcagtgacctcactgaagggctcttggtggtagctgagtgttgatgcaacagcagagtcttttcatttaccatctcatcactagactggggtttcagatgataaacccttcacccatcctttacctgcttgtcaaacagtaaaagattattcttgccgtagcgaagaatactttattcacagatgtcaaaaacatcagtgcgtaatgtaaatgttctgtgtggccccaaaaagttctttttataccattcgttttagtattgacagtgttttaaagcttt

SEQ ID NO: 93962 - DNA, 1913 bp, Homo sapiens
attgttttgatgtactgtgggaagagcctccctagctgacaatattcttggttaataagactattattataattatctgtgtatgaccacccattagcaaaattttatcaagcttattataaatatttttaaatagtataaaaacattttttgtttcctatatgtgcatgtgtatttttaaatttttattgactatgctttttaacctgtttttcttttttctcatttgagaatgagtggtttaagattgtagatttcaaataatcataaattctttattcattaatgaacactaaattcatcatgtctttccactgtattttgagtacacttcaattaatacactttccccatttttctgtaaaactaagctgttcttagttggaaagctgtttggagagtcttagttttgtctaagttacattgctttagttgctataaagctattaagttttcttcgataatggtaggggtgattgttaggctactcctcagtctaccactttatttcatatcatgattttgctacagttttatgagtcagttagctagaaggctattccatagttatttataatcaagtacttgaaagtgtgatacttcaaaaaaacatacaaacaaaactccattgattatactgatgctcctcaacttaccgatggggctaagtcgggataaagttgaaaatgcattaactaccccataaacccatcgtaagtcagggactgtctgtatttgtggaaatcagtaggcattattttttaatttagtgcaggaaaataatcacaaggcatctaatcataaaataaatttgttggtgttaaagttcaatgtttcagtttggaacattgatcctagaggatcaatgtttttagtgtttttgagaaagaattgttgggatattaagttttgatgatcatttaatcttcgagttaaaatctggacaagtatgaacatggatagaagtcacacatttttggaaactctagaaaatctttcttatttgtattcatttgaacttaccaactttagtcactgaatgttatccctaaatggaactcatattgtcggtaacatttgtattttctctgtgacttaaagaagaaattcctcgggcctctaatatcttatatagtcaagtaaataatttttgggggtatctcatgaagtattaataattttctgtaatctaaaattaattattcatagctttttgtttatggccatttggtgctcatatttaaaagctggttttcaaaatgcattaaagtcagcacaggtcatataagaaaagccatctcctgctcttgtattttagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaagtgagtatttgcaagccttcttttccttcattggtcactagaatgggcattgcctcagataccaccttttaaaaacttttttagacatgtggaaaccttatcaactgcagaggaaatgttgatgctagttgctgattagggaataattatatgttgaaaaatatgttttttctttaccttaaatcttagaataaacagcatttaccaaattcataaatcttgctccacagttgataacctttctcattcctgtgtatatatgccaggcctcttgttgtcgaaacactttgttcagaagtgaaaaatgatctcatttgtttgtcagtaatatttgatagggacactagtagaatattgtgaagcagaaggccccgcaagcttattaaaaat

SEQ ID NO: 93963 - DNA, 1093 bp, Homo sapiens
tccatttagcaaattacctgcttatcaagagccttttgtggtagctgagagacataaattactgtacatgcatttataatacagcttgaatatgaatgtacttgtcatttgaccacttagtccagtttccattccatttaacacaagatgggttttcttaagatgaatcacagctcttcagacatgcaaaatttgtgttccagaacgagagaaagtacaggctttcaagtgcgttaaaattcacagcacaagtcattttgctttggaaattaacatactttagagcatctgaaacaattcccagcagttgtttcttgcatattgtgttggttgtgtgtgagataccaaatcagttaaattgagtgttaaatgtgtgggattgtgcaccaaatgattataatattgatttttaaaacttaatctaatacttttttaatagttcataataccaacagcaataaaatacagtgtttgtttgaagtttggagttttcaaattaatgttaagagaatgacacctgaaagatgtggacatgactttggggaggattgggattggggtgggggccactggtttgatagaggctgtttatgagttttgaaggggatgaattgggatgtggaggtcttatgaatgatctcccaaggggcactatgacgaatctcttaaatttagctaagtagctttccactttaagatttacatttgaatttgagtgaatacagtgatactgcagttttgccagtacaacaaaacccacttaggagatcttcaagaaaggttgaaaaagctctggaaatgtaaccttattgcttcctatctctgtaataatggtattattcctcactgcatgttctggttttgttttgggtttttttttgttttgttttttttttttgtttttgttttttttgagatagggtctcattctgttgcccaggctagagtacagtggtgggatcgcggctcactgcaacctccgcctcctgggttcaagcgattctcccacctcagcctcctgagtagctgggattacaggcgcccgccaccacgcccagctaatttttgtattttcagtagagacagggtttca

SEQ ID NO: 93964 - DNA, 1293 bp, Homo sapiens
ttttccagaaggaaagatcaaaattaggtgtgaaaagttaatgtcttttattatattgtataaatgattccaatataaagatctctacccgcaactttttaaaattttttccttttgccactttggaatctgttttggttgtaattggtcagtttctacatatgtaggatatattattatagaatagatctggggtttcttcttcctgatatttatctccactttcatatttgtaatgagcaggcagcttgagagaggaagagattattgaaaaagaatgttacaggctttgaggtttttgaaaggtttgtagttcatacttagtgtcaaagacaagttttgttgccttgtggttttaatgaattgtaggtgaatatttttaaattaatatggtataatacatgtaataatattagaagtgagcttttaatagtgtctcatttttatttaatcatgtgaaagattgagaaagtaaatcctttgtgcaattcttagtctcatgcatgagttgttgacttaagttgttgacagatgggacaaagggagaaaagtcaaactgagcaatgggtactttggtgggataaagaggattggtcggaggaataagaaaatcctgtgtccagggactgcaggggtggaccttagaggctgaaagtgactgagagaatgggcatgtcgtagtgtctctgggggattttcttgggattgatgaaaataatttagcagtgaccccacttttgttgcaatctgcccagcttatatgtccgtgttggcagggcatgctgttgttggcaacagggtcatcactgagctcgataaggcaaatgggagcaattgcttttgctccttttgacctgtttagattttctaatccggagatgaactctgggagcattaaggatgcagaaatttcatcacaggagatgcgcaaacagtgtagcaaacagaaatctccagctaggttttggggttttctgtttgtttttgttgtttcattttgctttttttaaatcctgtaggttttattgaaaagtcaagtgattttttgctcttgagttttaaaagttggtgttttgtttcaaacttaagctagggcaagatggttgtgtgaaatttttaattttaaagtaccaatagtttgagttctgcagtatgttcagcttcagaaactgtatgaatctagatggcagaaatttgaaaattaattgaccaaatgatagagtgttagtaatctgctttagtttttatttaaaatgtacagtgctgaaaataaatcctcattttagtttctgg

SEQ ID NO: 93965 - DNA, 1052 bp, Homo sapiens
tagtgggtcatgacatctattaagtgggacagaaccaacattgtttcaatgaaatagtatagactatttcaaagtatttcctgtagtaaagatattatttcatgaaaagttgctttcagttatgcgtgtgtgtatgtatctgtggattgggttgtctatgtaaaacatcatttcttactataatcctcccatggatcttgatctaccaaggttgaaactgctgacctggaagatagttgtaagcatgaccgtctatttgccttaaatttacaacctgtgaaacataggtttatcttcttcccttcttctctagatctttatgaagccttcctgagataaaattgacatgtaaaaagatacatatttaatgtatctatctcagtgagtttggggataagtatacacccttggaaccattgcctacttcaaggccacaaacatatccttccccttccagagttttttcccaccctcaatattattattattattattattattattattattattaattgggtttttttgtgtgagagagaacacttatgatctatcctcttagcaattttcagtataaatacagtattgttagctgttagcactatgctgtatagagctccagaacttacttatgttccataactgaaactctgtactttaaccattatctcctcatttcccctcctcccagtctttggtgtctaccatcatactctgcttctgagtttgacatacaagtgagacttttcttttagctgtgttatccaccagggttatttgggagttgccttcctccgtgcgtctgtgtctacccaagagaacccaagatccaaagcctgaagtcaatctgggctttggatgcatgtcctctcccttgaaccaataaaatgttatatctaactatgtagaattgtttcatgggttaaattgttgagtacttttaaaaataatgctggactgaaaattcagaagtgaaagttcaagttacgaattatccaactaactatgttacttgagatatttcaagagatattttgtgggttcggttcctg

SEQ ID NO: 93966 - DNA, 1050 bp, Homo sapiens
tgccatatatctatctatctatatctatatatatatctctatatatagagatatctatatatagatatatatatatctatatatatatatatatctatatatatatatatttccaggatctttgcaacgctaaaggtcatagttgaattgtcacctgtttctgattttgatttcggcagtaggcactttctcagtaacattaaaaagacaaacttcttatcaacatgattggaagtgtgtaataaagtgtgatgggggcttcttgttattgctttttaataggtagggtatttttggtttgtaattcagaagtacagagaaaagttcccttctcgacttcgggtcacggtcacttttggttcctttccctaaaggcagcatttggaataatgctttcttcaacatcaaataagaaaaagttctaaatatttttgtgtattctgtttagcatatttattgattaatttctgcttaatcaaattctacagaaataaacggtgactggcaaagagctgatgcagtctggaataaaatccaagaagaaaatgttattcctcgtgaaaagacattaagattattagcagaaatccttagagagggtaaccaggaagttccgtttgacgtacctgaggtaattgtttttggcataatcgtaacagattttgttgtcagtataattaggttatagattagcctacttttatattgaaaagattaccagtttttatttaacagaataactttgttttaaagttgtggtatgaagatgaaaaacattccctgaattcttcgtcagcctcaaccacagaacctgatttccagaaagatatattgattgcctgccgattgaaccaaaaaaaaggcaagcacatacggggatgggggtgtgtgtgggggggtggtcttctttctaatagcagtgtggggtgtaagcccaaccaattagaagtgctctaggatagagataggacttaaattttacatatttcttgtccccttccatactttaacgaaaacattttggggcaattgggaaaatttaactattga

SEQ ID NO: 93967 - DNA, 1241 bp, Homo sapiens
ctatttgttaactgtaaaatacatcctttacacaaggtagatctatctcttaatcttacttttaaggttgaaactctggaaaaattagtggagctgacacagaagctatttgaatgtgatagagaccagatgtactacaatctgctaaaactgtatagtaagtgatttaactattcttcacgctttcatttattctgttgaaggcagtggcaggaaaggagtatttggttttgagggagctccagggattgtcagaaggcagttttcattcaacagaggctcaggtagaggctagattgaattttatcacagaatgttatatcgtagcactagacactgtatgtcttcataatttctgacattcttactgcaataatgagaaagtacgaaaaccttcatcagaaccacagaatttaataggactttttgaggtaagaacggtctttctgttctttttatttaaaccttcaggtaaatttattggtgacttttataaataggtaaccaccaacacattcatgtaagtagagatttttttctttttgcaaaaagatgcttatcttgcatatctatatacaaactcattgttaaacagctttttaaatgtcattatatatttttgagtcagctatatattacaaacatttttctatatttaatcacctacaaataacttatatactacatagatatactaaaatttattcagcctatcatctcctattactgggtttgtgaatagatttccattttccatttctaaaacaacactacgttattcatttttgtgccttaatcttcattcacatccttaactgttttttgaggctgaaatcttagtatttgtatttgacatttctgaaactttcgatctctcttttcaaacaatgctctagtacttttatactagtgtacacatttggagctttacagtttcttttaggatatttcggtagagaggaataacacttagaacagccagtgacctttccctatttgtttcatggatgtttatctagatttattgttcttcttttctcttggcaaatttcccttcaccaaacgaataaggggatttatttgtcttttcaaacttgtatttattaccattgaaagctttattttacatctcgatgatgtaaataaaattaaacttgcttaaaattttacattccagtttttggttgtattgaaatacatacttcacagtgtaattcttaagactttggcttgaacgatga

SEQ ID NO: 93968 - DNA, 1060 bp, Homo sapiens
ttcttttaaaaacgaaagccaatggtttattattgtgacaactgttactttgtgtaacattgataatttttgtctcctgagtctattggaataaagtgtatgtgtgtgtgttcaagagagagcgtgtaaatgagaaagagcacgtgcagtcaggtgtggtggcccatgcctgtaatcccagcactttgggacgctgaggtgggcagatcacttgaggctaggagttcgagaccagcctggccaacatggtgcaacccgtctctactaaaaatacaaaaattagccaggtgtggtggcacacacctgtaatcctaactacttgggaggctgaggcaggagaattacttgaacccatgaggcggaggttgcagtgagccaagatcatgccattgagactctgtctaaaaaaaaataaattaaaaataagagcacatgcatgtgaatgttgacacacactttttatttgacgttttctagtttatcgcttatttttgaactaaagacagtataaccattttattaattaaagatttatggaatgaactttgacgtgcagtgcagcatttggaaattatcggcgtcttctaggcagaggttaagcatagtttgtgttttatgctctcttctactcttacttaaaggtctttgataactatggggttaattatagtttgtattagttatagtataaatttagtatatagattgtatactagtatatatagtttagtatataagtttagtatatatatttggcagcaaattcataagaaaagaaactgtctttgaggaaaaaaataatattcagccgaagccttaccttgggtgctatgtgattattttattttacagactccagggattagagctcgatctgcaaggcttcagtggttttgtgacagatgtgttgcaaataatcaggtttgtatttgattcagatgtctcaatcacctaaaagtgtgagtagaaggcaagggtcctctgtatcacatgaagatttggggacttcgagagacagggcattgtggaagcagtgtttatctcgatcatttgccagata

SEQ ID NO: 93969 - DNA, 1206 bp, Homo sapiens
ctattgctaagacttccagtcaacagtaggctattagtagttcagtctttgggaaattaaaagttatatgtggatttttgactgcacagatggtcaaactctaacccctgtattgttcaagggtcagttgtacttggacggtacttgggttggggtggggatgttgttttcttttttttttaagagatggggtcacactgtgttgcccagactggagtgcattggctgttcacaggtgcaatcataacacaccgcagccttgaactcctggcctcaagcagttctcctatttcagtctcccgagtagctgggactacaggtgcataccaccttctccagcattcttgtctttgtctgtcccttctttaaagcccttgtgcacatgatttttcctcctactatgttaactaggggacatgaggctagggcgggcggtttttgttgttgctttcatttgacatctccagcagaagtggcaagaaaaatcagaacaggtgaaaatttctatttgagttaaattcaggataatcttccttgagacagagtttgaaatgcagtagaaaaactttcatttctttttacctaacaggtaataattattggatatctatttttactagtatacatagaagcttatgataagctttttatggtaaatttacatcagagtgttgtaatgaaattaaagtaatgacagttatttttgactttggattacttttttttcccctatacaagtaaacctagtagtgaattgcaactgcagaaagttgtggtttgaagcacagtagctcaggtggaaacaaacatgcaattgtttctataaaaatacttactgtatcctcactgttcattagatagattgtatgtggcaacacagaaagaactaaatatgagtttaattaacattaactgttttttcatgttatatttaacatcccaattagaattctattcttctccatgtttttattacattttctatttctgctttcaacttgcagtttttaaaattcaataagatgttaagagataagccagaaatcttgacattacagcagcctaggagatttagttaatctgacctagatgttcttttgatgattgagatttatatatgaaaacagttctcaatttcaaaatgaaacatgggaagatctgccatataaatcagctgtcctgccaaagacaggcagattaatcagc

SEQ ID NO: 93970 - DNA, 1078 bp, Homo sapiens
ccaaagtaggtaaagatgtaaattatgattattacctgtaacagtgaaagtttttctcaaaggagaaagggcgcaaatgaactccagtttgtttatgaaatggaatgatgtggccattaaaaataatgcttacaagattttggattttcgaatttgggatgttcaaccagtaaataatacagatattccaaaagtcagaaaaatctgaaatctggaacgcttctggtcccaagcgttttggataagggatactcaacgtatagtagttacggaatttgaaaccaggccctgagtttctgttttctattggttcctctgtaccatcctacgtccatgatctcatgacccctcaatatctgaactgtcgaaaataacttaccctttctccggaattcctctttcttgacttttccctctctccctatctgctgttttgcctttccatcacggtgcagccggagtacattttgatctcttctcagtgggggaaaaactctcttttgatggcttttgatttaagaccaaaagcttggattccagtgatctcccagtctttgttactcttccttttgttcttttccagatctgattcaggaatttttatcccatttgccttccttaataagccagcgtggatcgtatacacagacagtggattttagagctagggtttgtttgtttgtttgtttgtttgtttgtttgtttttgttttgtcctccaaaatttcaggatatgtcagttctcatgtaaatatatacccccttttgtgagttagtttagtatctcctataacacctggtcaagtggataattttttagttcatgatagtttgttaattggacttgctcagccatattttcctccttattatacatggtcttcaagtctatcttggaaaattttagagaaaaggacaaatgctaaaagacttaatagtaccatgagaccttttttgctcccttgttctgtgctagctatggggataaatatagttgatccttgaacaacataggtttggattgtgtaggtccacttacatgtaggtttttcttcagtaaatatactggaaaagttttt

SEQ ID NO: 93971 - DNA, 1201 bp, Homo sapiens
ctctttccattttatgactcaatctgcccacttgtcagcagacagtggggcatgctatcgtgctatcttggacaggtgcttctgtagcttaagtggttcatttacattttctagaaaatggtataatttttcttccacattcgcttctgaaagtacagtgaatccaaatgtgagaagagctgtctggctattgagttctgctcctctgtaggtacagtgtcagtattagcaggtcactgatcagagcggaaatgaagctcagctctgagaggttctgcaggaggaatgcatgtgcctgtctttgtgtagtaaggtgtaatagagccagaggcagaagagtgatttcttgttttgccatctacctgcttatgtgataatggacaagttattaaacctttctaagcttcctcatgtataaaagagaacataatatctgtctttaagattcaatcacataatgtatgtaaagcagcttgcatgtttcctggattatggtaagtgatcaataatattaattccctttgccccttaaaggtagggattgtgttgtcttctttacctcacataattcaaaatatgatgttcagcataaggtacatgtttgccacatgaataggcaagagaagactgcctcttaattacttagagctttgccacagtacaaccacatttaggaatggctgtctgctgatgacagaattttcgtagtaggtgtgtacaaaattttttaaagggtgaagaatagctttacagaaagaatactacaagtcatgagcaacatttttatcattcccaaaaaaagcaatagtgtcttatcattgggtagattcactatggttgaatttacagagctgctgtgtatttgaagcgttgtggaaataattagataaaccagtcataagctcattaaatgaagaaagatataggcaaggttcaatgtgtaaatatcacctgtttttttgtttgtttgtttttaagatgaattggcatacatgtatcatgtgttatatgtagtatatttgacagtctccagtcttttttttttttttttttttttttttttttgagacagggtcttgctttgttagccaggctgtagtacagtggtggcttagcttactgcagccttgatctcctgggcacaagcaatcctcagaaagacctagtctgaaaaaagtcctttctacaacacttcatctta

SEQ ID NO: 93972 - DNA, 1244 bp, Homo sapiens
tacttatatataaagattgtttctttttttcccccattttagctttgtggttttctaccttaagtaaagctcagttgtttacatattaactggtcattaaacatctctctaaagtattactaagagactaagctgaattcgatttattttattcattgctaatttttttgtttctaaggggcgacctatctactgctcttgaggtcgccattgactgctatgaaaagtataaagtattaccaaggattcatgatgtcttgtgtaaactggtagagaaaggcgagactgatctaattcagaaaggtgagtcactttctagtatcttaatgtagtttttttttcccttcttgctgatttaatcttagtgtattgttaagagaaaccagcagaaggccagcacattcagataaactttctttatacttgtgaaatctaaaagaaaaatatcaggtagatttccaatattatacatgttcttgattttagtaactgttcattttgaaaaaatgtctgttatttttgtgttctaattcttggtgatctgcctttatgaagattttttttacccttatcctcactagttctctttgtagctactctgttaggtacttaattagtcgatatagctatattctttaagttattcttaatatttgtttttaaaataaatttttcttgtatttgtctggaacttcatatgatactgtttttctgggtttttttttctcctaatatatatatttttttctctcctacctagcaatggactttgtgagccaagaacaaggtgaaatggtgatgctctatgatctcttctttgccttcctacaaacaggaaattacaaagaggccaagaagatcattgaggtgtgattttaactacagtgttctaattgtagagctatttagactcttaattagaatacatttaaaaattttaacctttaattacacttgttctgattcatgttaatagaattcaatcccagtaatgttgggggagggggatctcggccagcttctttattgtatataattacagttcagaaaaggcagtctggttgtatattaaatttgtttcctcactttgttaaattcactattatatatcaaaatgatatttgcatattaaatcttggattgtggaacaattaaattaaactggcattcctgggtgtaaagttgctaatcctctttgccaaagaattctttgttcttaaaagcagtggaatttaatttgctgc

SEQ ID NO: 93973 - DNA, 3411 bp, Homo sapiens
taacaatgtataagtttaaagtactttattccaaataaaaaaaatcaatatttgtcatctttcgttttttgttgttgttgttgtttttatttttatttttatttttatttttttgagacggagtcttgctgtctcccaggctggagtgcagtggcacgatcttggctcactgcaagctccgcctcctgggttgatgccattctcctgcctcagcctcccgagtagctgggactacaggtgctcaccgccacgccagctatttttttttttttttttgtatttttagtggagacggggtttcaccatgttagccaggatggtctcgatctcctgaccgcgtgatccacccacctcagcctcccaaagtgctgggattacaggcgtgagccaccgcgcccggccatctttcttttgttgtttaagtatactctctgggattagaaagttacttagtataaattacgagacttaagtttaaagctactaatagataaatagatagttgtcactcgtggttgttttaacaattccagattgtatgaaatacatttatgatttttacaggtatatgtattgaggaatgtatatgagttttaggagtacatgtttcttggtatctcaaagtagatagttttatgattggtggatgtcccatagaaatgtctgtccagcaaacttacatgctacatggtgtttgtttttctgtcagtgacgttatagcatacttcagtttcagaatgaggactcaaatgagtggtactatcagatttgccatcggagcttcaagcttatttatcgggatgttcttccgtgtaataatgaaaaaattgtagtttgtagtagctctttgtagtcatgttcccttaagaagtgaattctagattctagaatgaattttgatgcaggccaagtgagtctattcaagttaatgaatttaactctattttaagtttccaaatttcttgctggacccagcctatctcatatatatgttcttaaaatttaaaattacagaatcttttcctcaattttacctttatttcatagacttacagaattttggtaaagcttatatttttaatttgcaccaaacaaaatactgctttttaaaatgattgcttactttttattagtgtacgtagttttatgcatgaaaattatgtagtctattgaaattttgaggggggtgtcttgatttttttttttataaagggtaatagtatgctacagagttgattttcttttagtgtcatttgtgaaagcattgactaaatttttattaggagtgagcctttaaatatttgtatgtgaagctttaggaattatgcatatatgctgatacaagcatgggctcaaagttttgaatgcaaaattaatgtgtcaacattaatttcttcagaggattattgttatttcttagcaggatttaaatcatttctagtgctcaaagaaattcacagatcactttgggtcacagaagctagaagtagactgattggtaatgtgttgtcccacattttggttgtaaagcaatttttacctttctccttttgatattgtgcttcccttactgatttcatcctgcctaataaaagtggtattttcacctgatgattttctctgcttgtgcaaaacactttagatgaacctaataagcacagagtcatagaacctgttagaactaggagggaacccaaatgtccttgagttcagctgttgtgataatttgcttttcatcaccacttctagaaatgtatcacgttgctacagctgagtagcataagtactcttatcagttgggatggaaatccaaagtcctatgactacatagctatcttcatagcaatgcaaattttaggtgcttttaaacatatttttcatttccgtcatcacctaagttttcaagctttattatgaaagattaatagtgacataaattatgtggggaatgtaaatttttgtcttttaaaatgacatgatccaaccacaagtccgaattagataatagggactgaagaactgactagtcatttactttgtttttatctccagtacactttgtatgaggtatttcattataaatttctaattcattttgttggcatcctaagagcagtaacattggttcttaaaattactgacaaatatatgaattatttccattttgccattcttgttttttctgttgttgttctgaacatgtataatcttcagaagcatatatttggagaccaaagactattaacgtgtcgctttgattgacagaacaattattcattcatttattgatagctttgacctaatgtagggggaaatacaattgagacaatactattctagtttgggaattgatctggaaaagcaaatcatgccacttaaaaaaaaatcgtatgtgtgttagctttgctcttaaaaaatgttttagtagtttttcgttaagcagagttatagaaaggcaataaccgaacctgtgtctgaagtaagggaaaatactgattatataaagctttatatcatatgtggtagctactgtaccatttctcttctatgacagtaatccagcctgcaacatctacttgcagtttgaaattaacctgtaatttagtcttcaccccaaatgacaaaaattcaaatgactctgtggggtgccagaagatgcactgtaaacagggcttagtaaggggataaggtaagagttccatcaggataggctcgttttcactgtgtcactattattgcaataaaactaacatttcttcgttgtcttttacttttttagtacagcttaaaatcagatcttgataaaatagtaattcaacttagggcaatgtaacatttgtataataggcaaaaatgtgaaggctttaacaggaagtataaaaggactttctggttttgaaaactgttatgtgtatgagaaatttatattctctacaaagattttcactaattgtcactagttgtacttggagccatgtctctaaccatgcctctttttaaaatacctttcatactctcttttcataaatcgttaatttcttattccaaattgcaccactttattacattattcaaataccagtgcttttaataaagcataatgtgtaattagatgtactgaactgacaatgggaagtccagcgacttgcttacctagtaccttcctctgtttacctggtagccttagtcaaatcagccagtctctagatgccccagtttcattatttctttgaaagtaaaagggggtggcaagtagaattggatcatataatctctatagttcttccaagggatttcttttttttttttgaaacagagtttcacttttgttgcccaggctggagtgcaatggcacgatctcagctcactgcaacctccacctcccgggttcaagggattctccctcctcag

SEQ ID NO: 93974 - DNA, 1039 bp, Homo sapiens
aaaagctttatgggtatagaaaaaatacactgtttttattcatttgccaagggaaatccaaaacaataacagatttagaaaattataaagaagttggtaagctaacctgcttttgtattatcaaaatgaaaatacttgcattgaatggaaaaaaatttgcagttgaacaaaatttttatgtttcatttacattacattacagtctctaagccacgtattttacatgtagtccaaatgagtattatttcaaacattttcttttgtaagtattttatcttattaaaatcatgcctgattcatggagatgacagcaatccgtcacattaaggaagaaagaaatgctttaaaataggttaaaagagttttttattagtcttcatgttatggtcaaggaaatgaaattaataaagtctgggccatcagatattaaagcataaaaatttgtatgatgcagtttcaggttcacttgttttatacctgatccattttggtttcattgcatgcattaaaaaataactgaagctgtttaactggattatgttggtgcaagtgatcaaagcagctttaatttctgctttccattaaggattttttttgtgctggtttgtgttataatctgtatatgtacatatgcatttcatttaagtgtgtcatgaacttcatatatactatcctcccagaattcttgctgaattaatcttgagttcataaaggtcacaatttctctaagatgaacttgtaacaatgtttttggaactcactgtaacactttaatatgttacataaatgggaaataggctttttaaaatgttgatgattctgttacacatgctccccttcaattttagcatcttcatttgtactggatactttcattatttatgggaatgcttgccttctagagtaaaactccttatgtgctgaaaggaaattaaggaggtttggctcttttactccattattgcaattaagaatttagcatcatcagtgccaaaggacaaaaagtggttcatttgccctagggggacaggacagtgat

SEQ ID NO: 93975 - DNA, 6317 bp, Homo sapiens
ttgattaataaagtatgaagagaatgtctaaaattttggaaagatgaaaagtagtaatatgaggtgagacttacaaatttgcttttgatgtttgctgatgtatttttacgtgtgttttctaattctgggctaatttaaatttcaattttaggatgctcacttgttggttgagagtaagaatttagactttcaaaaagtaagtaggattttgactagattctacatgctataatacccatatttaatgagtattctggattgtgtacttataaaaccagtgattcctcacatttttatcatcttgtatacctctaagaagttggtaaaacctgttccccacctcagaaaaatcaacatatctaagaaatttgcatataatctcagaaggtttgtaaatccctggagtccatccatggattccccaattaatatccctgatagcatttatgacatttaggaaggtagaaaggaaagtcagtttaaagggaagagtgacaaaaggcatactatatttcctttttcaggaaatttttcttttcttttttcttttctgtagactgtgcaacttacatcatctgaattggagtccacacttgaaacactaaaagctgaaaatcaacctataagagatgtcctaaagcaactcatattagtgctttgttcagaagaggtaacatttgttttaatatttaaatattattaaggcaaaaaattcttggtaacaataagaaaaaccaaatataatatttatgatttttacaattgatcgttatatgtcaggcttgtaaagaatgcaattaaatgaaaggttaactaatttcagctacaccttgaatggcatgttttctggttgctgtagtttgtttacgataatctgcaaagtgaatgatagtaacagctgtgataggtttatcatacatgccaaatgtcctttcaagccatggctccggtctcttatatctagattgtcaagcaactgatacacgcagtagtcatttgcaagtcaaatattactaggttgttaatgcagggattgaaattccattttcctgctggaaaaaagctctttctgagataaagggtcccttgccttttttcagcgggcatccagctgtactttgtgttcattttagtgtatgtctgcaatttgtgggatatcactagactatttttcactttctagttcaatataattgagccataaacttgtagttttagggaaaaaatatcatgactaactttatgattataatctgctactgttaaattctaaaatatttcttcatattacttggatactaaactagactgagaaacttttcaatgatacatatttctgcatcctgaaattagactgtgattaggatttgatttgggaattacttaatctggaagtcttttttaaataataccatacacaaagcctaaaacatcaaatttggcataaataatggcctattttatattacagataacacatcttttaacccctacacgtgtaagacttgcccacttcttagaggtgaataaaaatatcaaggggcagagtcaggttgttaacatgaaaccatttatttttaaagtactattaactttttctaaactctgaacagtaaagctaaaaatgtgacatttttaccttcacactgatttcttctttttcacatctatgctgtattttagaatatgcaaaaagcccttgaattgaaagcaaaatatgaatccgacatggttactggtggctatgcagctttaataaatttatgctgtcgacatgataaagtagaagatgccttgaacttgaaagaagaattgtgagtaccctggcactgaaacaagttgtcaacatttattctgctctacagaccttgatagattatctagatggaatattactctcttatataatgtcatttttaaaaattcttttgttgtcagtgtttttgaaatttcgtattatacggctctttaattaattgtggcttatgttcagcaaggtgtctttgtttaagtatgataagacattctagtccttagaaccaaaggtttttttccattgattatatatcatcacaacagtggtgatggtggtaactgttttaagaggcttgataacatttccctttcaatattgtagtgtaaataaaattctatccatttctcaggtacctttggcttcctatcctgttagatttttcaagtaaaaatgtcaagtattcgtgatgaaggttagaatcacttaaagccaaagagtttcttcataagtatcctttgcagatggagtgatgcaatatatatgtagtgttgggcttttacttcactagtcactttgaatataatttcgtgtgaacttgtatatggcttcaaaaagaaatcctaactgaagcgtagaggccaacattagttcaggtcttctgatgagcttttgaaaagtgattaaatggatgttgctgttcttttagcagttaattgacttttaaaacaatataaatgtggctttaatttttagtgaccgcttagattcatctgctgtccttgacaccggcaagtatgtaggccttgtaagagtattggcaaagcatggcaagctccaaggtaagcctcagcacataaaggaaatatgtgatgcaagtatcttgccactggaataacatgtgaattgatattaatggatatcatgtcctgcaaagtgcttgaacactttgcatagaaatttgcatgtgaatccaaccagagctacatggacagtgtaggccattagttttaatggattggcaagcttgtcatttacatttgcacagctcagtgctttttgcatttctgcagctagtttttattagcattgctgtttggattgagtttgaagatcatgacttatggcacaatttgcttatgtgcctgcactaatggctttgtttttgcttaagaaggtctgaaggctgaacgtaaaacctataaacgtaaaacctataaacataacctaatatatgcgcctgaattttgcagtagtctttgccttactttttaataacattaacaaaatatatactttaaagtttttattttaattaaggtttttatttaatggttcatggaaaaagcatagctgattacacagctgatttgcatactcaaattttctcgttgagataatgctaagcctaataaaattaattacacttgataatacattcatactattttcttgtttcttaactttctgatttggctttattttgaaatttcctttttagccttcctcttttcctttgattttcagaaaagattgttttaattttattatagggaaaaatgtatggagaaaatcatttattagaacattgaatgttttcctaggacgcctttctaactctttctaaggattagcctatttttttaaaatcactttttgtaaagtggtcaaaacattttgtctgtgtaataattaagaacaacattataaaaatgcacttattccatatcctaaaatgtttgtttctgccttcctaatgaagcttaatgaatctaatgtattaacatgcagtcttttggaaagctttcattggctctgcttggctaattagtatcgacatagcaaacaggccctatcggtatcagaccattagtctggctgtatatacagtgtaaacacatctttattatctggcctcctgacaagccatctgctgaagaaacaatggtgtgatttagcagatgttagctctgaacgataaaagcatccatttaggaggatcttacagctatagggcagaccatacagggttatgtggtacagagtgggcacatagtccctatctataatttgtagtcaaagttgcagggaaatgataaaaccatgctattgtggatttataattgtagtctcgtttagaaatgcaagtagtaattaacttgaaatcggcattatacactagaatttacattcctgctgggcttgaaatgctgttttaatagcagtttgttttccctacatgaaattacctaagggtcttttgtgttacttcattgtagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagtaagttaattgaattttgaattttaaatgttggcattaaaagaatgagtctaataattttcggattatactttataaataccctcatgatggggaagccttggaggtcatttaccacagagtaagagggctaatatgaactaggtgacctttaaaatcactagcagccctgtggtcctgtggctttacatatcaatggaatagtccctggtgctttttttgtaggagcatgtgatcacttgaatttgaatctagtttttcctagttttgagcctgataagtgttattaataaatataagaaaaaaggatcttctggggcttttgagtatgtgtcttgacagttattcaggtaataagtgttgaagcatcttcagtgctccttttcttcacagggtattttaaatacatataccattacagttattctagctttgataaatgttgtaggagatgaattttactgatagggcaagatttactgagtttgttaatttttccatttgaaatgctcttgttggtgctcaatttaaggcattatttgcaatgtaaatcataaagtcagtctattttataatgaataaaacattttagtaagatgactaagcgtaatttatcatctttttcttttgtacttgtttttgttttctgttttgctttttaaatttcctagatcttctttgtcagctttttcatagcttaacatagtttgtaatctgcattacatggagactgcactggcaaattagtttaaacaaccctaggcaaacaaaaatagaagataataattaaaataaaataaaatggaagatatacgtatctgaaagtagtaaaacaccgaaaatgaaaagatactaatttagatttctttagttcaattaacagggagagctgaatttgactgaaacgcagaaatatctcactgtggatgtagtgtggatgttgtcctgttgatgccaggagaaaaataaaatatgtattttaacggttctcatgttttccccaaatttctggtagtttttctttatttattagagagtttaattaattgaatataataaatgatttagtgttgaattttaaatgtataataaaaaccatctcttttaactaacttaaaaaaatgtgtgaatacatgcatgcacacatgaaataattcctttgccatccaatcaaaaacaattaccgggttagatgactggtcaaatcttaacctctacagtctcagcattacatccttttaaagaaatagtgattcaaataatgactgtgttattgagttatcatattcatagccaactttatatagaaatcctataattaatatgcttcctattagaatttttttcaattgcttaaaagacccatttctgcaaattgcatgtgcaactctacagaaggatttgaaagaaatgggcccagtgcccagaaaaattaggccctcctacactaccgggcaaaaataaaataattaacaatgaaaatgaggccatcgtagaaaagtatcttacaaatagaaatactttgaagacagaggagacctgaaagctttccgaaagaggtctgcagatggggctcatgaaccaaggagagcttacccatgggaaaatggaaacggtgtggaattcaaatgttaacctagagcatcctctgtgcttctgattatatcctgaagtcagatatttctgtgtctcagtcaaatttggctctccctgctaattgagctaaggaaatctaaattagtgtcttttcattattggtgttttactactttcagatatgtatatcttctatttttattttattttaattctgtttttatttgcctagtttttttttttttttttttttagactactttgctaatgcagtctccatgatgaggtctttcagtttcatctatcataataaaaagggctattgactctttcagagtcatgagactaataaaaagataaaggaaattttatatttatgaaattacagaaaacagcagaaacattcgtagtcaggggaaatgcctggagtaaaaccctgactttgaaactctttctcaattgtgttttctccaactgatgg

SEQ ID NO: 93976 - DNA, 2952 bp, Homo sapiens
cattacaagtaacaagcaatctgtgggcagtcactttgagactcactgtgtctcccaggctggagtgcagtggcacgatctcggctcactgcaacctccgcttcccgggttcaggcaattctcctgcctcagcctcccgagtagcctggattacaggcatacaccaacactcccggctaatttttctacttctagtggagacgggatttcaccatgttggccaggctggtctcaaactcctgacctcaggtgatccacctgccttggcctcccaaagtgctgggattgcagatgtgagccaccaggcctggcctattttgaatatttgaggtgggtgagtgtcagcctttctaaattacctttgtcctgaaaattcatcctgatacagcaaacatttatttacttattaattttaatactttgatctgtacatattacaagtatgcatatacttgaaaataaacctgggtttattttcgatcctttgctgccctctgcaggtctatgaatataaatctttggagcgaggtaagtccctctaatattgcaaatcataaggtgcttttaacgttacaagccaataccataggttatgtaataatttttatcatgaaacctatatttggttttctactaaaattttgctggcagagttaatgttgaaaaataatagttatgtgtgtcttttagtgtttgtgaatccaattgataagaatccaatgggaggagggagaggatcaggaagaatagctaatggatgctgggcttaatacctgggtgatgggatgatctgtgcagccgaccaccatggcacacgtttaccgatgtaacaaacctgcacatcctgcacatgtacccctgaacttaaaataaaagttggaaattaaaaaaaaaagaatccatgagaatagacactttaatctttagaccccttttgttttagtctcattaagatgaatggaagttgttattaaatatctaaaaaatgtaagttatttagcagttcaggatattttactttatatttcagtaaaacttaatataaaatgaggaaaccagttcagtgtcaacaagaccaaaagcaatataatgaggaataatattggtcaataattcctataagctcttttctatttataacagttcattcagagtgatgtttatatatcaatttataaatcagtttagagtctttctgtgtgacatttcacaaaacattgcagttttccttcaacatggatttgtttttgtttttaaaagacaaacctattatttaaaaacaaaacaatctccttggcgggtgggggtggttttgaattactgtgaaatagaatagtaccttactggggagaggttttattatttcaagaattcaatttcagattgtgtttgttcttgtttgcttctcttgctgcaatgcacgaattttctgtcttaccagataacagaattgttgtacaaggatggacgttattgccaggagcctcgaggaccgacgggtagcgtttcaatttcgatgattgtaacttatccacaaatccatttttctgtgtaatgatgggttaggaggattacagcagtaaatactttattttttaaagtggaatttgaaaacatttggttataaatctttatattgattacaacattttgagatctaaagtgtttgattttgttacaattattttttctaaagacagggttgggaggctttttcttttcagatattggggaaatgtttcttctaacatctatggaaataggcttaaaaatcagtgattcttagtatttatgtgcttttaatgttttgcaggtgtagttaattttaaacataaaatgtagcgaaggttcttgtggatttccgcttaaatgtaatttattgccccaaatacattgttttgacatttaatgattttcatttttcatataatgaagctagactatatagttttctgtaagatggtacccctcttgaaagtttacatttctatcctaggtattactgtaacatggccctatacattttatgcttgaatgcaaaggaaaattactgttgttacaaaacatctttgttaatcttggtttttcattggctaataggcagctctccacaggattactgtatctgcttattaaaattgtttaactttctttactcaacatttaacaatcctttctaattttatgtgcttccctaaatattgtccacaaaaaaaaaacagtatagaaatgtgtacaagacatttatttattcttattacgtgtgatttggacaggaaaggggtaaggccttgggcaggaccacttctgtcacagagtggtggaaaaaaaatagattgaagtaagattcagtactgaaaagctgtcactcggtctgaaaataattaatattcctttcactcaccagttagatatgtgctcccaaaccacataatctctatgcctcagtgatcattgttgccatttcagagcctctcatcagggtgacatctcacaccaaaatgatttcttataaattaatcttgataacatgacagtctcggtaattttagtggaatgctttctcttgtttttttccacagaagctgttggctattttctttataacttgattgacagcatgagtgactcagaggtacaggccaaggaggagcatttgagacaatacttccatcagctggagaagatggtaccatttcgttttttgctatataatgcctgtcctgcctgacatgtatctattagatttgaaattgctgcttttaagtacaaccagaccacttctcaatgacatgcaagagttggagacttaaattatgtctgagataatttctgttagacaaatttcagtttggttgtctaaaactcaggttttttcccccctcccttcccttctcacagaatgtaaaaattcctgaaaatatctacagaggcattcgtaatctcctggaa

SEQ ID NO: 93977 - DNA, 1988 bp, Homo sapiens
ttaggaatgcactactggttactacatcacaggaaatgtcaggtagtagagaacagtaaatggattatcttgattaagttttggagtagtagagaacattttcccacttgtgtttgtaggcatggaaaactaatttgatcacatgaaattaaaagctgctgagaggcatgtggtggtgttccctttaaaattccttgagtgactcagtgcaggtcattttaaaagtgacttttagattttcaaacactataaaagcactgagaaacttaggctccttgttcaaggaatatagcagctgatctaaaacaattctccttatgtgtgtgggttaatttgttatttttggggagatgaacacttaaaatgggccatgacttttcccatgggatttttctttaatgaaaccaggtaccttaaccttcacttaaactgtatttattgtcttcagaatttgcttctactatgaattcctctctaatcccatcctttttgtattattcagtagccacattacatttatagtgaaaagattaactctattacttataacatggtcccattttagtacaattacagggaaaaacaaattcagggaatgcctactgtgatctcatcccttgctagtttggcaagggttatgtgaagagtcagtgtaaggtgtgattcttacacaatggcaaatcaggcttataatgtcagcattgaaacatacaaggttgtagactgttaaatgtcaaaatgagtagtagagcaaacaaatactcagaaaagtgaaagatcaatataagtcaattacataacggacgtatgacctattttattattactttaggtggttactcttgtgtgagtgcaggtcattgatcatagtggaaaatgaaatgagaaagtatgaatggttcaacagaacccaacacctctccgagaaaagaatttttcctctcatgtgctgtctttaaagaacaaaagtcttgtagggtattacagtctctctcttcatggtgccaccatgtccaacaacatacagcctcagtgtgtgtaccaggctgactctgattctgctggtatgttagtaattgccatttataggaaaggatatttataaattaattagttgtatatattcatgaaaattaaaaatacgttaaaagggtagcttatattgcagatatatattactgcattgtctaattttgtatgaaaacatttttattttttaaatacaatttccaaaatgaaaactaaaaggtattggtataaatatgttttcaatttgataatacagggtttttaaatttgtttggtctgagatttaatgatggtcattttcttttgcagtgaaatcaaatacattgcccatctcgctgcagtctataagaagtagcctactgctaggcttcaggaggtaagatgatcaacttaaatgttccttgcctgaacatggactgatttctcctgtccttttgacttattgcatgaggaaaaatacaaatattcttatctttcagtgtacattcagtttacctgaaataacctttgcttgtttaattttttcttttaagtcattgaattaaatttaggcagctttgtgtcatcttttctgagaaatgcacacaggtttggtaaagatcctgtttccaggaagaaagtcctgtttcaaaatggcaagttggagttacagaccaatttgcatatgtatgttcagcttattctttgagcatttaattgcaaggtgacttttattcagtaaagtatcattctccccttctgtgtgctcagagaatgttaatgaccttgcccttccaattttgttattttgaaaatagataaacataaaagctgaaagaatagtaaaagggaatactcccataccacccttttttatttgatttatttttttgagacggagtcttgctctgtcgcccaggctgcaatgcagtggtgtgatcctggctcactgcgacgtccgcctcctgggttcaggtgat

SEQ ID NO: 93978 - DNA, 2228 bp, Homo sapiens
acattcattctcatctcaactatgttgccttcattgctggaatttcagtagtattgagtgttttgggattgaaaacaactactctgttaagtgcttaatagaactcacagtattgatctgctttttttctttgttttttgaggcagagtcttgctctgtcgcccaggctagagtgcagtggtgcgatctggtctcattgcaacctcctctgcctaccggttcaagcgattcttctgcctcagcctcccaagtagctgggattacaggtgcccaccaccacacccagctgatttttgtatttttagtagagatgggatttcaccatgttggccaggctggtctcaaactcctaatcttaggtgatcagcctgcctaggcttcgcaaaatgctggcattgcaggtgtgagccactgcgccctacctgataatgccttttgtcttcagctgggcattaaaaagtacatttttaaattagttttcagaaattacataataaatgtttgttgataaattagagaacacaagtaagtggtagggctgtacaatctgtccatagttccttgagatagtcattgcttagcatgtatgttctttcagatgtatactaggctggagaaatctcttttagcaagaaagtatactgttcatattatcgagcaactcttattatactgttcctattatccacctaacttgacagaggctatagtttaataaaaagaaagaacattcttattttccttttaaaaacttacttctttttgccttcattactttcaaactccccctaaaagtctctgtttctggcttactagagacctgaagaaaaattacacttctctcatatttgtttcatgatgaactttttttcatttgacaccttttcataacagtatttaattccacaaaatatattttatgcttgtatgctgtttcattgtatgggtatgccataatttattttttatccttgcttattgctgattaagtggttttttaatatactataataaaatgattcaataaatgtatttgagctaaattttgactcatatatttaaattgttaaacaaatgatgttgggacaagtgatgagcctctatgagttaaattacattaaattagatcctggccaaactgtatgccccaaaatattttagattaatgcattgaatctttgttttgtcttgaatgggagaattattctagtgtcctcagtagtaaactcatcctggaagtaaggccctctaaaggcatcagaccatctgtatttgaagataagcatttaacttagaatgctgaaatgtcatctttaaatttttgctaaaattcaattactgagcttatctatttttctagaaaatcagagaatatggtgattcaaataatcaggaaaacaggatctttggcttatcaaaatattgttagctgagatgtattctcattgatatatgctttatctccaggaaaatggatgtctgtctgatagtgatatgttttctcaagctggattgagaagtgaagcagcaaatgggaacttagactttgtattatcattttgtaagtatacaacattagcggtaaacttgatagatgtttatttcagttactattgagggcatgcagggtggttcacgcaatgaaagcaaggaaggtttatatgttttgttaaagccagactgataaaacggtttatgagttgaacttgtggataatttggaagtaattttaatgttataaggacattgaatattatatgtaatatggtgttagactgaaggctggacctggagaccctgaagacgtggatattctttataatttggccaccgattatgtgatttagaagaagtcttctaacctctctgcttcacttttactaaacagggatagtactacctaacttgggggagttgtgaaaatcaaatgcggtattgtttctgaagtgttttttaaactaacatctattataaagacttctagtcttcattaacaaaaacacagcaaatgtttactaaacatttttaaacactagtgtgctttataatgctcatcacatgttaatacaattatctccattgatagatgactaaaggcatagagaagttaaatgatttgcccaaggttagtgatttgaaccagaagtaagatgttcagactttagctttgttcttttcaccatactgcactttattttattttattttatttatttttgagacacagt

SEQ ID NO: 93979 - DNA, 2667 bp, Homo sapiens
cagaggttgcagtgagccgagattacaccattgcactccagcctgggagacagagcaagactccatctcaaaaaaaaaaaagaaaaaagaaactgggcttgatctgatctgaagtaactgctctggaaaatatttttatttttgaagagtaatttactaaatgttattcttacctcgaaagttaagtctgagtcataacctacataatattaagagggtatgttatttaatgtctatgtaattattattattttttaatgggggatcagatgtttatgatctttattatttcagaaacatatatccagtttaatatacattagttcttttctgacatcataattccaaatggtacttagcattttttattttaataagcatatgttttagtttgaataactatattaaatttggcaaaagcataataatctgttttttgaattaacttgtagtgatatggagaatgcagaaaacattctcacagtgatgagagatgccggaattgagcctggtccagacacatacctcgcattattgaatgcatatgctgagaagggcgacattgaccatgttaagcaggtatgacttatgtctaaataaacatactttaaaatcatttgtaaaaatttgtgttatgttttacatgaggcaggaaagtgaagtttatacctgttttcaaagatgtttccttgcagaaagtagtatttatggagaattattatagtttagtatctcggtgctggtatgtaacagttactgttgaagtagagtatttcctgttttttaaaagaagtcgtaaacctttaggtggtatttttccctagttttttgaatctggatattttatttagctttaatacttaaataaaaacactctaactttgtcttctaatttctggaactctctatagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccaggtagttttaaaaaaatctatttacatgatttttataaaaatctgaattgctattcttacatgatggaaaggacattttctaacaatgggcattgtgggagttgaacatagaactcttaaagtcagttaaataagcccaaaaacatgagttaatgaacacatggggatgatttgatttgcaggtgttttattgttatttaggcagttatatgcttttgatgtttgcaattcttattttgtcttcagtattggaacattggttgcagtgtaaaaatattgttcagtttattaacaaaagatgtctttgttttcttcccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacggtattctgtccacttttactttgtagacaatgtaattggcagtgaaataagattctttaaagtataggaacatttataagattagaccagttgtaaacatcataacaatgttcttgtgttgcaagatttttgggtagaaagaggatgcggggtttaaaatgctcatctcagaagtggtagaatatttgcagcaggtcaaacggtggggtgtttgccaatccagctaatgtggtgacttttttcccacagcctgtggagaagctaacagactactgtaagaagttaaaggaagtccagatgcactcctttcctctgcagttcaccctccattgtgctttactcgccaataaaactggtactacattcttaaagttaaagccaagtaaggaagttttgctgaggtagctttgtgatcttttatgatatctctttcagatttggcaaaagccttaatgaaggctgtgaaggaggaaggttttcctatcagacctcactatttctggccattgctagttggacgtcggaaggaaaaaaatgttcaaggttagattttgccttttaccgatttgtaatggttcccagagccagtatgacagtttgcacgcacatctaattggattctttggaaaagcatacttattcctgagtattatgagataatggaattgttttaagtcatcatgaagtattatgtgtaagcattttaaaaaacaaaacatgatggatttctttcatctgaatttcattaatttcatttcttatttcatctctgatcttgatattcaaacttaatgaacgtagtttttttaagttcttaaaaaaactctttagttcttgattttatatatagtgtttgaaatcagattgtctacctttaataaagataaagttgtatatacaattaggttcatgaaaacaaaaagtatggtcattttctttgtgggccaatctatttctttttaactgagcttagttagaataataggaaaggcaggaaaacttttattgtgaaatgagtactcatgacctgacagcctgctgattgaaggacaaaaatgttcaatctttcaggttcttaagtacgtttaagcatttatcatacttttcccttgtacacatgggatgtctataggatatgaataagaat

SEQ ID NO: 93980 - DNA, 1289 bp, Homo sapiens
tgatcttgttgtctaggctggagtgcagtggtgcaatgtcggctcaccgcagcctccacctcctgggttcaagcagttctcctgcctcagcctcccgagtagctagaattacaggcatgcgccatctcgcccagctaattttatatttttagtagagacagggtttctccatgttggtcaggctggtctcaaactcccgacctcaggtgatctgcctgcctcaacctcccaaagtactgggattcgcgcctggccctttatactgttttcataagatactgggaagtttagcctttgaattgtagcaagcactgcctataaagtaggttctttgtatttttgtatttgatagagttttgcagattacatagattttataaccttagatttcttaagaaagcagactaatatttaaagtttgacttgtaacttagtaacactgtacattaggataggatttttctaatttatggttactctcagtttgagccagaagatttttgaatgcttatagatttctgtttaaattttgatatttatctatgtgatattgctgctatgttaaatgttatccattaaccttttttccacaggtggcctaggtggtagtcatgccttgcttctactacgtagttgtggttctctcttgcctgaactaaagcttgaagagagaacagaatttgctcataggatatgggacacacttcagaaattaggtatgattgtttaaatatatgatgtgtataaaaggtgtagatgttttttctttttgcaaaaaagtgtttgtttacataaatgctgtaattcagttttatggaagggctacttgattcataattttttgataatatttatttggtgaggtatagtgacatctagggtcattaacaataaataatttttcataacaagtattacttacaagtacggtaagttaaaaaagaaaaagaagaaaatagccggtttgtctgtcaaagttataaatgcacataccatttgaccgagcagttccatttgttcgaatttaggtacagatatactcacatatgcaaaaggatattcttcattgtagcttgtttgtaatagtaagaaattggaaccaattcaaatattcttctctaggggattaggtaaataaattatggagtacccgtaaaatagattactgtgtaactgttttaagaaatgaagaagctctttatatgccaatgggggtgttctccagagtataaataaaaattaaggtgtagaccagtatgtatagaatgataccattttgaagaaaagtg

SEQ ID NO: 93981 - DNA, 1277 bp, Homo sapiens
tgcacagcagataagaattaagagccttatcactattaagtgtttcaactttatttagacagattagaaattatttgggcctaaatgatccttaaaaaaaaaaaccctgcatcgttttagcctggacattggtcttcttttaaattcatagtaagcttatacctagaaaacttaaaggtagttataaaaattttggatatattttagatctcttgtcttatttacagagatgagaagagctttgcagcataaactgcttcatcttctgtcattaccttgttttggttaaggagagatttaaaaaacacttaaaacacactgtatttccatctgattttgaaatcattccatgttcaaagttaccaagatgttgtcaattattcaggagatttactgtgcatatagtttatgtatgtgtgtatatgattttatctaaagtaaaagctaaaactttctttcccattagttcatacctctatttttggtattgtactgtgattttaggtgtttaataactaattttaaaatttgtttaagttttgttcaaaaaatgacctaaatagatagcaactgattattattaattatgtttcattttttagaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtatttcaaaatttcctgttcataaagttgacttttggctggtcacagtggctcaggcctgtaatcccagcactttgggaggcaggtagatcgcttgaggccaagtgttcgagaccagcctggccaacatggcaaaaccccatttctactaaaaatacaaaaattagccaggcatggtggcgcgtgcctgtagtcccaactacttgggaggctgaggcatgagaatcgcttgaacccaggaggcagaggttgtagtgagctaagatcgcacaactgcactccagcctgggcgacagagagagacatctgtctttaaaacaaaaaaaaaagtcttaaatttaggttggtgcaaaagtaattgcagtttttgccattaaacataatggctgcaattacttttgcatcaacctaaataaatacttgagggtaagctcattacacagtagattatttgatactttaattttctttgttatat

SEQ ID NO: 93982 - DNA, 1780 bp, Homo sapiens
tggaagcaacctggatgtccttcagtaggcaaatgggtaaacaaatcatgtatatctacaaaagaacattattcaacaatgaaaagaagtgcgccgtcatgctgtgaaaagacatggaggaaccttaaatgtgtattgctaggtgaaagaagccaatctgaaagggcagcatgctgtatgatgcaactatatgacattctgggaaaggcaaaactagagacaggtaaaaatcagtggttgccaggggttcggaaggagggtggaaggaatgaggagatagagcatggggcatttttagggtggtgaaattattttgtatgatactgtaaaggtggatacatgtcatatgtttgtcaaaacatgtatacacacagtgaactctaatgtaaattatggactttggttgatggataatgtatcagcattggttcatcatttgtaacaaagatactacactacagcaaaatgttactaggggaaatgggagggagaagaaagtgggaactgttctttcagtacaatttttctataaacctaaaaacactaaaaaattgtgggtttttttctagtcagtctctgcttatcaaaaaattgtgtttattttttaaaaaaatggtacatgcttaaaagtagtggggagggtcccatggaagcctgcttagtaggataatctgatcccttatatcttttttttttttaatggacattcaactataagatcgttttctattgaagagttaaaaaaaaacccaccttaatttttttaaaaaaactgagagataataactttaaatggtagattttacaagaaaacatttatgggtaatttgagtattagtggtaggagctggagtctggaaggaacctgagacatttaactaggaaatgtaaaggagccagtatgatacttggatgagatgatacaataatttccccttatgtggttatatcaattttggtccttagcatttggaggcagtgagctccagcttgtgcaagcctggtgggtgtgatcttcttgtggggccccaccgtcacccctggacttgttctgttctttcttttctgtgacgacatacccattactccaggctgtgaaactcttgtttccagaatgtattagagtgaatttaaaaataagttctggaccatataactgaagagtgaagacttctttggttaaatatgtaatccttcctctatcccaatttattttataatagattcatgtttctacttaattaaatccaagcacacttatgagaaggagactcggctgcagtaaagacatgtatatgagaaaaatttgcctagaatattcagaacaatgtgctagtttataaacatgttttctgcctgaaatttgagttggtcttctcttacatttaaaaaatatcctgtagcggaagttttatttttgctctttaacagtttatcagatttgcattgtgtaaaaaactttggcaaatagacttcacaattttgaaatttctgtattaatcagcttttgttgttgactaatattattgcatactcctccaaacttgacatgttgtcctggacagtttaaaaataatgtcactttgtgcttgcgggacattaagaaggggatagtttagtaacaactgatagagcaactagataaatgccttttggaagtaagggataaatattattttaagggtatatcttctgtggtttgtagcttaattcagctcgtttgacaaactcgagtcaattagccatctacaatgtgctgatcattggtcttacaaaaata

SEQ ID NO: 93983 - DNA, 1049 bp, Homo sapiens
ctataggcgcccgccacggcccctggctaattttttgtattcttattagagacggggtttcgccttgttagccaggatggtctcaatctcctgacctcgtgatctgcccgcctcggcctcccctaagtgctgggattacaggcatgagccaccgcgtccggctcattaccaaacatttttaaaaggcattatctttttgcattttggatacatttaaaactcgggaggctccagcagtatataaaaagaatgatttaccgtgatcaagtgggatttattccaactgtgcaaggctggttcggcatttgaaaatcaatccacgtgatccagcgtatcaacaggctaaagaaaattcaagtggaatagttaaattagggattggtgaaaacgtaggagataaatttgagttccccattttctacattacagtgcaacaaaataagttgagagagcggctctatgaaaactagttttgtactttacaagtgtgtcataaaatccaaatcccttatttatctgccattagagactttgcactgtctagtctcactctcactgtctaggtttaattttttaccactttccagtgtgaacacccaattgcagccagattagtttcttcaatgcccttttgccacgttgagttcgtttcagaatgagaccgtctcagaatgagaccgtctgagtgctaaccctggccctatcattagccttaactgtgatgactttgggcaagttgcttcagttttttcatttgtaagttataattttctcatacccagcacaaattaaacacctgataaacattagctattaataatgcctcttctgtcttctacctgtatctacctttaaactcttgatagctctaaagtgacactaaactgattcataatatcagtgaagaagaaaaaaagtggagagaagagttttaagaacgtgtatggcctgggcatggtggctcatgcctgtaatcctagcactttgggaggccaaggtgggcggatcgcttgaggtcaggagtttgagaccagcctggccaacatggt

SEQ ID NO: 93984 - DNA, 1056 bp, Homo sapiens
ggtcctttggggttctgaaatctgtaacattcggcctctgctctgtgagtgtagatttatcaatcacagggctagacaggcacatgtacaactattagacgtgctgtccataagagaagaatataatattgtggtatttcagagagaggagcagtgccatttgttttatggcagggggacattgagttttagaggacacatggtagtggatattcagaatgttccaaaaatagagaagagcgtgaagagacttggaggccgtttatcccgtgtagctgtgtgggatgtggtggaagttgatttcttgaggctaccaagattgcttagaaggtaggttagttgatgattggaagccgttggaggattttaagtacagattttgacaaagtttatgtagattataggaacgtggggatggaacaacactggtattgcaaattagcagtaataggccttcaacgaggtagtaaagaactgacgaaaagatccgtttcttgagagaaagagaacagaagattggtgagagtgttagcagaattaagaaaagtagatttggggattagggtaaacaatggtacctttagaatagatgctgattactttcttttttttttgagatggagtctcgctctgccacccaggctggagtgtaacggggccatctcggctcactgcaacctctgcctcccaggttcaagcgattctcccacctcagcctcccaagtagctgggacgacaggcgcatgccaccatgcctggctaatttttgtatttttagtagagatggggttttgccattgccatgttggccaggctggtctcgaaatcctgacctcaggtgatccaccacctcagcctcccaaagtgctgggattaaaggcatgagccaccgcacctggcctgatgtttattattttcaaagtgtgtttgtaaacataacatcatacaaacatttcaacttccgtgggttattacaaattaggaaacagggttagaagtataatttattcaagacctcaagttgagattcaactccagataccgtgattcccgttt

SEQ ID NO: 93985 - DNA, 1796 bp, Homo sapiens
ccccggccgccgcctccgctgggctgaggtctgggagaggcgcagggagagaatgggagtttgctggaacgcctggaagctgactgattctctcttccctccgcttcagtctgcaagcatctctttcacacgaaagcactggggctaccccaagccttggcgcttctcttcctggtgcatgccctgtttgaaaacactatcttttaccattcgtttcctcatcagcttctgccctactctgcgctccacttcacttccttgttaaatcgtctttctctgctgtctatgcgttctaccctcgccttccctccttagtggctttaaattgtgtgtttctcttttcttcgtaccccggcatctcttgcctgtcttccctagcaccatccttttcggatgtcattcctaacagtgaagttcttaattgaaactgccacttattgtcagtaccccaaatctaccggagccccattaagagtatagactgactagccatatgtggtaaatcagtttttcatagtttaagcctaacaaccttgaaaaaattgtattattaaacgtaaagtgtgaaaataacaccgaaaataattttttaaatgaaggactcagtgagtgttggaaatagttatttcttcattttttaaacttgcatgacctctcatatcagatttagcagatctgggacgtttgcccatcttattcggcaaaaaaagtgcttcttaggcgtttgatagcagcccaaattcatcaatattcaatttcttctaagaacaacttgaaaacttttttaaaaagagacgttaataactgggaagttgttttgatagtcacagttaaagagcttttaaaataggctccacatgtttaatgtatcaaaataaagttggcaggcatgttgtaaaaggattatttaggaatttgagtagtcttagtgttatgtagctattttaggaaaaacattctttttctgttaacaaacgtttacaactacggtgatgtgagaattactgaggcttactgtgggattaacacaggaactgtctttatttgagctactgcatggatgaagaagtggtaaattgttcagagtagacagtgtaagtcacagtatgttctaggagatggagaaacatgccatggacgctgaatgttaatagatgttatttcatttactttctctgttgtgcaatagcaaagttcctattgttggcctacttttaaatggggcatttctaagtaaatagtgagacaagttattctaattattatgatagtcttttccaagtgtacaggccttttaaaaatatagttgaagtaatggtaattttttaaggaaatgtttttgtaggtctgccaaatggacagtgtgttgttctaatcgaaattttaaaattaagtatttagaacagaatattttagtccacacattttcagggataatctttattttgtgcttcttctctcaatgccttctttgtctttttttttgtcttaatggttgttgtgttttcgcctcttcatttgtttttgctctcatgaagtcttacaacagtttctgcagtggttctttttgttgctgtatattagcacgagtatttttatttgagctttcatactgtaagatttccccagtttctagtacattatcctctggatttgttgaagtgattgttctctttgaagtgaccagcagagctttcaacaccgttttcttacactgggtgtctgatttctgtgaagactctaggaataggtgaaaggcctttcaatttagtcatgtcagtaaatactgttttatg

SEQ ID NO: 93986 - DNA, 1437 bp, Homo sapiens
ggttactggatgttcttatgagtaggagaatctagaagtgtcagcatgggtgtttaacctatttgggcagtgtttttccttttccttgttctgactaaagcatttatctctgaggtggggaaatggcattttctgttgaacacaggtggcctttcttagtcccttaaaaagaggacatgactgggcctggtggctcacgcctataatcctagcactttgggaggccgaggtgggcggattgtctgagctcaggagttcgagaccagcctggcagcacggtgaaaccccatctctactaaaatacagaaaattagctgggtgtggcggcatgtgcctgtaatcctagctactcaggaggctgagacaggagaatcgcttgaacccaggaggtggaggttcaacccagctgaaatcgcgccactgcattccagcctgggcaaaagtgagactccgtctcaaaaaaaacaaaagtgggggtgggggaacataattaattcaaagcactccaaatgttaagattatataggagattttgttgagctttgggaggctttctgcttttatttactctgagctaccaacccactgagaagtaaagaattcagaacagtctaatagtatttagtctgtaaccctccagccaattcttatgttcactgagtgccttctgtgtgcaaaggcccccatttcatgccagtatctgaacaaaacagacaaaatcccaaatccttgtcgttgacgatcttgcattctgttaaccagcaactcacagtttacattacagctgaactccttatgtggctggcttaaaaacttgagtggaagatttggggtgtgtgtgttttgtacactaaacttaaaagctgtgattagagctttactatttttaacaaaaggaaaggaagaggttttctgtaattggataaaaactagactgaaaagaggaaagaggaaatattgttgtgccttagagaaagacattggtttgagattttttttttttttttttgagacggagtctcactctgtcacccaggctggagtgcagtggtatgatctcggctcactgcaacctccgcctcccaggttcagacaattctcctgcctcagtctcccgagtagctgggatcacaggcatgcaccaccacacctggctaatttttgtacttttagtagagatggggtttcactatgttggtcatgctggtctggaactcctgacctcatgatccacctgcctcggcctccccaagtgctgggattacaggcgtgagtcaccatgccctgcctggtttaagattaaaagatgacccaaagagagaaaaagagatccctgcattagacagacatgagggaaatttggggccttcaggtgtttccatttactgtacatccttggatagatgagttcctggaaaggaggatgggagtaaaggt

SEQ ID NO: 93987 - DNA, 1029 bp, Homo sapiens
tgttctgagagggaccccatgggaggtaattgaatcatggggacaggtctttcctgtgctgttctcatgataatgagtaagtctcatgagatctgatggttttataatggagagcttccctacacaagctctctctttgcctgctgccatctatgtaagatgtgacctgcttctccttgccttcagcagtgatcatgaggcctccctggccacatagaactgaaagtccattaaacctctctttcttttgtaaattgcacagtcttgggtatgtctttatctgcagtgtgaaaaagtactaataaattaaatatttaaaatccattgtgtattttacacttacagcaaatctctattagcattagcctcatttaacattcctactagccccgagtggttagtggctactataccaaacagcaaagctctgtgttcttgtctgtgtttgatattgagagtctctctctctctcttttttttaatctaaggagagagaaatggtgttttattttgactttaattttccatcttcctattagttttcctaatgacaaaatcttacaggcataaatatggaattactttgccgttggaatgcaggtgtttattttgttaattgtgtttaagagtttttagatattagatattagatttagatgttagtgtgtctataaaatgatggtgctaattaaagactttaacctggccgggcatggtggctcatgcctgtaatcccagcactttgggaggccgaggcgggtggatcacctgaggtcagaagttcaagaccagcctggtcaacatggtgaaactccgtctctactaaatatacaaaaattagccaggtgtggtggtgggtgcctgtaatcccagctactcaggaggctgaggcaggagaatcgcttgaacccgggaggcagaggttgcagtgagccgagatcctaccattgcaccacagcctgggcaacaagagcgaaacttcgttccaaaaaaaaaaaaaaaaaaagactttaacctcaagtcaactct

SEQ ID NO: 93988 - DNA, 1199 bp, Homo sapiens
ggaaaagcatgacaagtgacgttaaattaattcctcttgtatgataccttgccctatgttgagaactgctactttaaagttgattaagtggtaattttctgtttttgatatagcctgaataaatacttttcataggtctgcatgtagtttggtttttagagcacactgtatgtattcagtgtgatagattttttttctcagattaaatttgcgactaaagcaaaataccactgtcaacaaagctatttccattttatgaactatatttttcttgttgaaaggcttggagaggggtaagttacactgttgtcctgagtttgaaatttctagctgagcttttgatttaggacaagaaaatctaaattattcttgtatctggggtctctcacttatgatttcagagaatctgatttactgaataaatttgttttcataatcttgctctaatgtagagctatagtttccagcttttggagaattattgaaagtgactagcctatttttatcagtaacatctccttgccattggacctgggtgtggtcaatgccaatgttattcagcaattataatgaaaactgtaaaatatctcttaaacaattattcaagcccttttgaatgtcagttatgattttgaaaatctgaagtgaatgccactgatactacagttcatcagaattgatttggaagaggggaggacttaaataatttaattctgatgatactaagaattggaagaaaggatgtgagctacatgttctgtttctgtgagtttactgatgggtggagttgtttttcttttgcttctcattcaagcagtataggatttgatgcaggtgtttgtgaatgagtatgttctgtaaggtcctggaatggtgttattagtatgtgacttttcaagcatctctttgaacttaagctggttattagattttattactactatcatttattttagcaatgttttataataatgaaagccattaatctacacattgtctaggaacaggctggaagtgaagagtacttggctatatcatagaaatatttcttggtaacactttggagtatatgtggcatcagttaaattttgaagatagaagcacattattttaaatatttcatgtgtacaagctttttttcttttgagacagggtcttgctctgtcatcgaggctggaacgcagtcatatcatctcagc

SEQ ID NO: 93989 - DNA, 1218 bp, Homo sapiens
tagtgtttatacaactcaagcatgtttttaaatacttttgccacatattcatgtatgtaaactaatctgttgctttgtaaattttatttgtttttgtttttgtttttttgacacggagtctcgttctgttgcccaggctggagtgcagtggagtgatctcggctcactgcaacctctgcatcccaggttcaagctattctcctgcctcagcctgccgaacagctgagattacaggtgcccgccactatgcctggttaatttttttctatttttagtagagatggggtttcaccatgttggccaggctggtgtcgaactcctgaccttatgattcgcctgcctcagcctcccaaagtgctgggattacaggcgtgagccaccgctcccagcttctgctttgtaagttttataactttgcataatggcatcacactgtatgtatcattttccagctactttgttttgatttactcatggtgatacaagttaatgtagtctatacttttaaattctgtagagatttacattgtatcagcattattgtatgcttctgcttgtatatatgtgaaaatttctctgggtggatactctataaccaacaattctccaggaaattatatgcatttttattctaccaaatatcactctggagatttctcatgctgtttgggttcctaattctttatgtgtgacttattttttccccttttttccctctgggaaatgttaggttttatctttatcaccagtgttttgaaatttcagttgctttttgtgtctctgtatgtgtgtgtggttggttctactttcagtcctgacacttagggtgtttagttctctttccttttcttgttctttctctaatagctgttagtttcaggactgatcctgcagctttcttagttttattctttactactttgagtctgtttggtttttgtgaaggggaggggtctgggggattttacttttgattttttttttttcagtttgattttctaaacttttattgacaattttctgtcattttaattatttttattttatgttatgttatgttatgttatggtattgtattgtattgtattgtattgtattgtattgtattgtattgagatggagtttcgctctgtcgcccaggctggagtgcagtggcacgatctcggctcactgcaacctccatctcctggattcaagcgattttcctgtctcagcctc

SEQ ID NO: 93990 - DNA, 1546 bp, Homo sapiens
ggctcaagtgatcctcctgcctcagcctcccaagtagctggtgctgcaggcatacgccaccatgctaggctaatatttttccccaattttttttggtagagatagggtcttgctatgttgcccaggcggtcttgaactcctggcctccagtgatcctcccagctaggcgtcccaaagtgcttggattccaggcatgagccaccatgcccagcccagacatgtattaaaactaccaaacaggccaggtgtggtggctcacacctgtaattccagcacttttgatgtgggaggattgctggacgccaggagttcaaggctgcagtgggctatgattgtaccactgcactccaacatgggtgacagagcaagatcctgtctctaaaaataaaaaatacatgtctgcaacctatttagtaatcttctcctttgagtggtggggtctacgttcctttgtcttcaatctgaacaagacttagtgactttcttgtaaccaataatgcagcagaagtgacttctgagggtgggtcagaaaataccatgtagctctgcctgggaaaccaggtgacatgtaagaagcctgaccgtgttgaaatcctcaaactggagaggccacatacagaagatactccttgggacagtctcagctaaattcctagccagcatccctcatcagctgcctatcatgttaagtgagctttcaggtgaccttctccccagccagtatttgtatgcagtaatatgagaaaacccaagtgagaactgtccacttgaacccttacaattaatgagccaatactgatacattgttaactaaagcccataaagcccattctttatttgcattttcttagttttaacctaatgtcctttttctatccaagatcccattaaggatgtaccacgttacatttagtcatcatgtctccttaggcccctgttggctgtggcagtttctcaggctttccttgttttttatcgccttgaaaattttgaggagtactggtcagatattttgtaggatatccttctattggagtttctctaatgcttttcttatgattagactggggttattatggattttgttttggaggaagaccactgaggtaaagtgcctttctcattagattatgccaagaatataaaccgttgatgtcaagtttgattacctggctgaggtagtgtttgtcagatttctccactgtagagttattctctccctcgttttcattttgtactttttgaaaagaaaataactgcccaatccacccttatggggtgggaagttgtgcttgacctatttgaaggtggaagatctacataaactgtctggcattcttctgcattaaaggtttgtctggtatccccattcatttacgtattcagtcctttatttttatcagcaaagactcatgaatgtttgtactatgggttataatccaatattacgttattttgttgctcagattgtttatccattaaaaaagaaaatgatctgtcatagaccaagagtggttataacatctcagaaatagaatcactggat

SEQ ID NO: 93991 - DNA, 2228 bp, Homo sapiens
tcactgttttgaatattctcattgtccagtcttctgtaaacttacatgtcgaaccctagactcaccttgtaaattaaatcagaatgaaattattaatgaagttttatttcttgttttttcctttctcctagaacagtggtctcaacgtggctgcacatacaagtcaccagagaggcttttaaaagatgatatctgtgtcccatccctagggattctgatttaattggtctgattattcttacgcgctagggctgagaaaccactgttctgtaggatgtaggggaggaaatttcttgggcttttgttgttgctcccgtaaattaggataatactaaaaaaaatacttgaggtaggagttactagactatagagggaatattgtacatacattttctgtcaaatttaaacatttaacacctgcattttttatttcagatttattgctaaacatgggtgcatttttggataaacccaaaactgaaaaacataatgctcatggtgctgggaatggtttacgttatggcctgagcagcatgcaaggatggagagtggaaatggaagatgcacacacagctgttgtaggtattcctcacggcttggaagactggtcattttttgcagtttatgatggtcatgctggatcccgagtggcaaattactgctcaacacatttattagaacacatcactactaacgaagactttagggcagctggaaaatcaggatctgctcttgagctttcagtggaaaatgttaagaatggtatcagaactggatttttgaaaattgatgaatacatgcgtaacttttcagacctcagaaacgggatggacaggagtggttcaactgcagtgggagttatgatttcacctaagcatatctactttatcaactgtggtgattcacgtgctgttctgtataggaatggacaagtctgcttttctacccaggatcacaaaccttgcaatccaagggaaaaggagcgaatccaaaatgcaggaggcagcgtgatgatacaacgtgttaatggttcattagcagtatctcgtgctctgggggactatgattacaagtgtgttgatggcaagggcccaacagaacaacttgtttctccagagcctgaggtttatgaaattttaagagcagaagaggatgaatttatcatcttggcttgtgatgggatctgggatgttatgagtaatgaggagctctgtgaatatgttaaatctaggcttgaggtatctgatgacctggaaaatgtgtgcaattgggtagtggacacttgtttacacaaggtatgtaaacttttttgtcattaaaataacatgttaattttgaaaagttacggtaggtaaagttaagctaacttaaaattttaaaacttttaatattttcacagaagctgtatattttgaagtactttaccagaaatgaaaccattgttttctttgccatccttgtttgtcccagccttctaatttgaaaattaagcttgataaatttgaggcatttgttgtcatttaagtacttcatagcttgttgctgtagcaaaagcatttacacagagtgactttttcttgacattggcagtaaccatcttatgcctgattatgaagcagcttgataaaatatgtatatagtagaattctgtactagatattactaaaagatcaagagccatgtgaaatattggaagatgtactagatgcctagcctgtataaaatttagtcctgagcctcctagcagtgaagacaaaaactgaaataaaaatatgggttgtatatttctcattgtcttctaaaagcagctcttatctggcaatacaatctaaaaaggatttacatgtggctctctaagtaatacatgacttggatagtatcttttgtagaagataaaattcttttcatatagatgtttttattatttctgattaaaaaccaaaggcttctataaaacataatcttgtgaaaaattcctgtggaacactaaagtttatttagatttgtaattttgtatgaatcattgcttgatacagtaatagaaaaaaagtccagagtaatagataattggcaatcctttgaatatctttaaaatactcagttgtttcaagtgggtttttgacagcatctatatataattcaattaaaatttgagttatctggccagtgtctggagtgtgtaagtatttgactgaaaagataccaaggtaaaactgacctttagttac

SEQ ID NO: 93992 - DNA, 1191 bp, Homo sapiens
cactgtatctttttacttctggatgagttaagtaaagaagtattgatggttgtcagtgatcaaatagtaagtgggtctaaaattatgtatttgtctttgaactctaaatgaagcaattctgacctgtagatttttgagacaagcataggcatatgtttgttgcctgactagctaatgaaaacagcattttccccaattataaaaaaaaggtatatacttactattggaaaaaaaatccagatgatgaagaaaatatagagaaacacccaaaattttgccatccaccctaagtcagctactttcattgttgtggtgtatattgttccagtcttttctgcctgcctgtgagtgtgtgtatttttataaaaccgagatgattatacttgttattctacagcctgccttttccaacaatatattgtagagagatctccatgcctataagtattgatctgtatcatttttcttggctgcgtagtattttattgaaagaatgaggttgtgagggaatagccaaaaaatctattaggtctgtaatttggactaaggaaagaagtttgtgttagtagattaactcacttatccattgaaaggatgctagtttttgagaattttgactcgacccttctgaatgaggtttaaatatttctggtggtatatcttcacttgctagcttttatcaatttagagtgattaaatgttcatgttgatggtgttaaaagattctagatggcatcctagaatctcagaaatgaggaatgataataacagacaagaagttggggcccatgattcattcaatgttaatggaagctgaccatcatagttccttctaatggagctgcattcaaattgaaatcagtttggaggtttgaattgaaacaaaacagacttaaaattatttttgaacctttgaaagttacttatggaaaccttcatttctgtttaacttcgtaattttgtctttccatttatttgtattgtaaaagcaagggttagcaataagatcaaatataattactttgaatttactcagaaaaattgtaagttaaaaattcatggaaagcacttagcgattgcacagtagttacctgctgtaagaggagaggaaacattaataagtagatgtttccctgataagagatttaaatgaagtcctagttttttctaacacctccatcacttgtcata

SEQ ID NO: 93993 - DNA, 1867 bp, Homo sapiens
gtatttttgttaacaatatttcccagaagggcctgataaaataaagaagagtgggtgtgggtgtgggtgtgggtgtgtgtgtgtgtgtgtgtgtgtgtaagtgtctgtctgtttcggttttcatggtctgagaaatttttccccaagggaaacattaagactaaattttttttgtaacaaatacagagatgtttgaagtaaagtgattccccttgatgtttctgctttccagtctcatctcacttagggaaccactgctcatggtttgctgtatatctttccaaatggttctctgtgattattgatagaaatgtataaacgtaaaataggattttttctttttttgtattttatagaaaaagatcatgctatgtttgttactttgtcacctgttttgtttttcttaaattataaaagtcggtattcttttaaattgttcttttaaaacattatttgattttccaaaatttcatttatataccatctaccagaagcctatttattttaaaacatgagatagtacctcatagttggataaaattgagggaaattatcattttccaaaggcaacatcattctatattaatttatataacatagaaaatgtaaccccctcaataattgtttagttctaaactcaggagaattgcttgaacctgggatgcagaggttgcagtgagctgagatcgcgccattgcactccagcctgggcgacagagtgagactccgtgtcaaaaaaacaaaaacaaacaaaaaactgtatcagattgttttctgtttaagtttagatgcccttatttatggcaggggcactggcgtctttgatctggtactatgattattaagagtgttaactgctgtgctgttgtaaaaagtaaaaagaacatgtaataatcaatttttatatgcagagctaatttctttagttatccaaactggatttagaaaaaaaaatgttttatttatggacttagtgaaaactttatactgattatacaaggatgttttgtctctaaaaaacaatggcacaaaggaaaggaccttttctgttgctgtataacagctactgaaacatattcatacttggtgtttaggggaaagccatctttacatagaaatagaagcaagccaggcaaggtggctaagaagcaacatcactgaaatcacacatgcctgagatgtaaatataaattatttcccttaaatgtctttggagaaccataaatttattggaactctctttcaattaattttccaaaagtatttatattttataacttacaaaaatcgaatggaaattagataaggaaatgttccacaatgctcatgttgttgttaccaaaaactcaaaagggttaaaagaaattagatttctaaaagtgtaaggtgttaattccgtttatgcataaaattgctttataaagtgtaattatgcttgattctttttttgttgttgtgttttagaaagggtgtctcactgtgttgcccgggctagtctcaaactcctggccttaaatgatcctcctgcctcagcctcccaaactgcggggattacaggcagccaccatgcccagctgtttgattcttgaatatccatggtgtactttaaaattatttttaattaaaaatttttgcttgaactgcccttatgacatttatacaagtatattcatataaccaaacacatacagtatttctaatataaaagttttggtgggtttcattaaggaatgaattaatttggccaatttggaaatggtttttccagataaccgggaatctaatgaaatactcaagttggttccttgttccaaagcacaacaatctgtgacaagttaatttattttgaagtcttctgaagacccaa

SEQ ID NO: 93994 - DNA, 1135 bp, Homo sapiens
aggtgggtggatcacctgaggtcagaagttcaagaccagcctggtcaacatggtgaaaccccatctctactaaatataaaaaaattagccgggcctggtggccgtcacctgtaatgccagctactcaggaggctgaggcaggagaattgcttgaacctgggaggcggaggttgcagtgagccaagattgcgccattgtgctccagcctgggcaacaagagcgaaactttgtctcaaatagtaataataataattgtttagtttagtattttgggtattctgccgaataacaattttcagctatgttaaattcatggagtcgtagcattgctctgaggcagtttaaaagctaagctggaaaacatttgcatatgtgtttgggaggatccattgtggacttaagccagtttgggaatagacaatcttgagtgggaaatagtttagaagatttaatatgtattgaagatatcttcatttctcagactggaatggctgtgggtaataatagttcaccagaattaaaaatacagaaatgcttacagatatacccatacctagacaccttgtttcttcaagttgtgtttttagtaattcattggaataaaaatgaatgtgttaaacataaacgttctggatgattaaataaactataattgcttaaagtattttgaagtaaataatagttgattgtagaaatacaattttttttcttttttttctttaatacacagggaagtcgagataacatgagtattgtactagtttgcttttcaaatgctcccaaggtctcagatgaagcggtgaaaaaagattcagagttggataagcacttggaatcacgggttgaaggtaagacaaatgctttttaaaaatatagacaggccaggcacggtagctcatgcctgtaatcctagcacttttgtcgcctgggcgacacaccaaggctctgtctcaaaaaaaaaaaaatttagagagggaaagtattctttttgtttatcaaatgattattttaaaatttcctggtcaggcgcagtggctcacacctgtaatcccagcactttggcaggctgaggcgggcagatcatgaggtcagatcgacaccatcctggctacacggtgaaaccccgtctctgcta

SEQ ID NO: 93995 - DNA, 1895 bp, Homo sapiens
tataattcttatctagctaaacttttattatcctttagtaatggcattcataacttttatattgtttttacttaatattagatcagaagtatttttccatatagctgttactgtattcatcaagacacctatttcgtaatttttagtgattataaaccatttcactcaatggctacaccaaagtttttaactgtcctcttgttggtgaacatttagtttgttccagtttttgctttttatgaataatgctggaatgaacatacatatgcaaataactgttttttcttttttccccctgcatagcaatgtttcagtcaataagtagctttttgtattacttcttaaaaattttttgtgtgttgatggtaattttttttaatatattttaaaataggtactaccaaatagtatctcttgtttcacttcttggtgagtactggcttatcacattaatttaggaactttttttaaaaaacctacagagattatggagaagtctggcgaggaaggaatgcctgatcttgcccatgtcatgcgcatcttgtctgcagaaaatatcccaaatttgcctcctgggggaggtcttgctggcaagtaagtagaacaaaaagctaattttgagttcgttcataattagtaattaaataatttggggtaaaaaaacttaaatcagaagtacatcaattatctagaggtgaaatgggttagtgtttcttatactagagaagaactcttaaaacttcaaccaaaaacgattttttaaaaggaattatctatcatactctttgagtatgaaggtccttctttccttgctaaggagtacaaatggattgtgcaaaatcagattctgagagtaaagtgtagaaggtatgttcttgacaagtatagagtgtaccagttacttttttagtgtggtcaggatgaaatattgagatattcacaagcttaaaattctgtgtaatttaataaaactaaagcatgttttttttttttaggcgtaatgttattgaagctgtttatagtagactgaatccacatagagaaagtgatggggtaagttttattttatttcataagcatttgaagtaatttcacaatataaatactaaatatgaatacattcacattaacgaagtctataataaattatagtctgtagtaaattactactgcttttcattttaaagtgtcagttaaagtttaagaaaatgtattgaaatgaaggtagagataaaattttgttttgtagatagttttgttgtcactttctgggcatcaaatgaccttttttgtttgggctgtctttatttcttctctatatgtctgcttttccttcttctcctttaaaccttaattttgaggcaagaatgctcttttaaatatctcaatttctcctccagcaggctgctgccatcaccagaagttagtgatagtgagtgagttgttattttaataactagacctttcagtacccctgtatgcccacttggaatacccgaggatagtttttttctaatattattgttgtattatgggtacatgagtgttgagctgagataaccatttctgttgtaccttgctgtacttcatcagagcaagactctatgcccttaccttttattttgcttttcttcgaaatgtcagtgagctgccagctgcccctctatattgttttgttttgttttagtactattaccaggagacagaagtgtcctttttttttttttaaatccaagttagttcaaataagtatttttctcttgggttttcaagtttttatgtctaaaaataaattatttaatttttaatatatatgcttcaaagctttaagggaaccaaacagaaatgaaactgattgggaggaagagtccacctccagtctccagctcctcttg

SEQ ID NO: 93996 - DNA, 2037 bp, Homo sapiens
ggatcacctgaggttgggagttcgagaccagcctgaccaacatggagaaaccccgtctctactaaacatacgatattaactgggcatggtggcgcatgtctgtaatcccagctactcgggaggctgaggcaggagaatcgcttgaacccgggaggcggaggttgtggtgagccgagatcatgccattgcactccaccctgggcaacaagagcgaaactccgtctcaaaaaaaaaaaaaaattgacccaaagctgagaaaattaatttaaaaatccaaatattttatgtgatccatcagagaaccctcaaagaaatgagtataggatgttgacatatgactaaaaggatggtggtaatttggaaggttgagagaagagaatcttaactcttcagctagattatagattcttcagggcatccactaccttgattagaggaaataagccctcagaagacagttattgattcattattagccatagaagtactcccatttcctcaggtgtttcaaagtgtcaaccctcatgtgtaatctttaaaaatacatatatatatatatatataccttgctggattttggggtccttcatagtctatttttactccaaacaaggttttctgtttaacatataccaaggataacttttaaattttttaaaaagaaaaaatgattacacatagtagctacataaacagggaataaataggcaacggaactatgaaactggggggaaatgctcaatatataaaccttaccttaaatagattattatttggctatagaaatgggatatatgtacttaattacctttatacataaatgttctatcaacatcagcagatcaaacactgacagtgtgttgtatagtggattcacagagggagaagactagaaaacgtaagacgtgaccccacctgtgtgtctagtgcagcttacactgtagttataaacacaccttaaatgatcaaaatatttcgtatagcttggtaacaaataaatgacaaaatccagaatgtgaccattgccatgtgacttggacagtgattgctgtaaaagttcagctgcttaagcagggggaaagtcagcttcttagagaaaagatagtatttgaagaatgatttgaatggtagaaatgacatgaggatgatgacctttcaagtggactagagaggcaaggacaaagtataagatatcttcaaaagaaaggacatcttttttggctaaagcagagaactgttgtggtgaaaaataagaatttaggttgcagaggtacttgctaagagaccagccttttgaacatcattttagggtaatggaccaccttatgtttagagcataagaatgatagattcaaaaaaatatctgtggtattttaatctgttagaaacatttaccatattagattaaagagatgcaggcagtcaggtagttgtgaaataattacagagaccaaatggtaactgtagacttattatcattacatagatatgtggattaaaggaactttccttgtttactgtgaaaactgactttacagcctagaattttaaatggggaaatattatatgcctttcacaataatcactaacttagaaaaatgttgaactataattgcaagtagcagaaatgtgctgaaaaataccgcagaaggagagagaatgaagaaaatacagacgtgattaaattctgagctcttaacttgacccactgtagcaaaaagctagccgcaaaggtgctccataaatgcttcttaacagtgtggatgatgtcgccgggagctggatgttaacttgcggggtgggaaagatgaaagtatgctagaattacagaagaggagaaagttggaaggtattataaaaattaagtttttttaaataacaaaaattatttttgtttagatatttaaacaaagaattctagccagagttaaatcagagggtttctttagactcctgaatgtctgctttatgtcggagagaattgttctgttgtaaatgattataagtagtaccactagaaatagggattcattcatt

SEQ ID NO: 93997 - DNA, 3577 bp, Homo sapiens
gggtacactgtaggtgtataaaaaaataaattgtataatattgaatatcaagtttaaatttccctagttgtcactagagtgactattgtaattgttattttgaatcccagtctaatcaagtttatcaatcaagcacattaaacaagtctttaatcagtcaagcccctcacctgtttttttccccttgaaactgactttgaagaatctgagccagttttttacaatacgtcctgcattctgaattcatatgattgttttctcatgtgtgctctaacttgatcctctattcccttttttcctgtaaactgggaattagcattattagattcattctaaacattttttggcacgaatacaggacatgactgtactttataatgcatcatatcaagaggcacatactgtaaagatatctttattttagtctgtcggcttaactgtgatcagcttggatgattagagcttgttctgtacagtattaagtagttactattgtagaaacctgtagattttccaaaattcactaaaatatgaaaggattgagtagtttattattcatactgagaatacttaatttatttttatctagagatgtttttatcaaaataagagcaaaaagtaaatacaatttttatccgtaaaaactctaaaatctttcaaaaatctgtttaaatctatatagttttatgttttgtatttcctacttatttagcagaaatgatgaagaaactgttctgatggcctgcttttctgtccttttcctactgctttaaacattgattttcttttgtactaaatcatatagccaaatattgtttaagtaagtcagttttaggaaatgcttgtgttgctgttgaattataaaagctgagtaaatttcagattaaactttaaatgactgtgaaataagacataaactagttaatggtaatttgcttaaaatgacttgagattattattggaagtttttattaattgatacaggtaagaattgatatttaataaaatgttctcatgcttagactatattacttttcggtagagaaattagtattttgctgtaatgtgttatgaaatacatgtgatatcctagtttgtctactgacactggggtcttgaatcttaaaaaaaggcctccgatgaagcagaggaaagtggatcacagggaaaattggtggaagctctcaggcaaatgagaattaatcataggggaaactaccgacaacttctggaggagatgctgactagttacaggctagctaaagtagagggagaagaaagccctgctgaaccagctgccacagctacttcttcgaacagtgatgctggaaacccagtgacaatgcaggaaagccatactgaatcagaaagtggtcttgctgaattagacagctctaatgaagatgcagggacaaagatgagtggtgaaaaaatatgactttcctttttggtaatatttttgtgatctttgatggtttttaacctaggaagtgtaatgtatgcatttatataactgttttgttatttgaatcttggaaaactagttttattatattcagatagccttgttttttaaaaaggcctttgcatacacctttatgagatagtgtaaaattgactatttatagtactatggatttaatgaaattatatgtcatttcacattgtatgccagaaattaggctaccaattatgaattaaagtcagtagttaaattaatactagatagaattagaaattttgattagagagattatgctatattatggaaaaacttgttaatgtagaattatactgcttcatattattttacctattagtacactcatagttagctttgtaataaatttatgttttctttaataattttagttcttcaaagaatggctgatgctggcctgtaatttttctttcaaggatgataatttgtgtgttgtttgatttgtttatattttacatctctgtagttttatttttagaagttgtgagatattggatgtgtggctatttttcctttctctgtattctttatgaaacataacttttgaaaaacctatgtattattcatacagctttggtttgtatattctgtatagcctaactacacacatcaaaatgtatgtcaaccaagtgtttagaatgaaattataagtgtttaagtccaaataaagcatgtgatgtggaataatctatgcatgttgtacttatttttgaattaattttttaaaaacaaccaagtttggtatattggaagaatacccattagaaattcatttgtatttatataacatttagaacacttttggcttaccttttttcattaacaaaaaggaaaagtttaatattaaaatatatgtgttgcatacttaaatctattctttttcttatccatcttttgtggtacaaaatattaatctttggacattatgggcacacattagacatgtgagaaaattgccacagtgagcattttaaagattgcagaattgtccattttgttacaaatttttgttagttattaagaaattgaacaattatgggctatttttaaaatagtggcagatgagagtttttgtttaaagggatttttaaattatagatttgtcacatagggaaaaatattttttaaaaattattttataactgtagaacattaacttttcgtctttacgtttatatttatatcatgtgtctaaagttgctttaagttaccataaattgaaacttcggaatctttggatgttatagctgatgttttgatgtatttttccaatgccagaatatttttaagtgctttgagaaaggaaggcatttgatggagaggggaggaaaataacccaacccagttatctatccatattagatacacgtgtacacacacaatatgcaatacacaacatctctctgtaaaagtacccttttcagacaaagaaaggaaggtaatttgttcatcaattttgttttcttttgaaattcaatccaatctggaagtggcataggtaaataataatattcttccttttctcttcctgtagggtgctggagatctagaagacccatggtagccttaaaaaccttctaaaatgcttttgattctgaaaattgggggaaaaaacttttaatcacaattttcttcaatacaaggggaaaatattcttgcggattcccaacgttttgtgatatgagcagaaaatcattagcatttcccatcatttgttcatatttgtgttttctgacagttgccacttgtagcattgcctgtactacagtattttttgccaacctcaggcatactcgttacatctgtattgaactttcggccctagaaaccagtggagttatttcaccacaaatcaacaatgtgcctgaggtgcatgggaaatatagttagctatactctgaaaatacattatgttttttttctttaaacaaaacacacaacatgtaagcatgtaagagtaaagaattgtatgatatgttccttttttcagttcaccaagttggaagccttttgcagctctgtggcttggaatttcatttgagcaatttctataggatatgtatttattattgattg

SEQ ID NO: 93998 - DNA, 1921 bp, Homo sapiens
cagtaaccttgaattcttctgagttttgcatgtattaaattcaattaatgctgaacatgaagagtaaagtatttatctgaaagaagtttctgggttaggagaagtaatgaatgtatccatttgtacatggtttacatgttgtggatgctttgtaaacattttcctgtatgtttaaattgtgtttcagcaggatgtaattgcccttgtgtgtagttaaaatgagtcatcatctggtcctttgtgaaatggaattcatggtattttctgtaacgttttcctgaagctgtttctggagagccacacatttaaatacagacagctttcctgatcatttgatttattgtgcacctgatttttggtctaaaaggaattattgccacaatatattttatttattctttagattttagccttgtaagttaaagtgctttacatgatgatgtgaaaagctgtttgtccctttactgggtttggggggttgttaaaagatagggaatgaagaatgcaaaatggtttatcgttcaaactgtccactctgatccaaccctgtactgatagtacttcccagtatgatattgtgatgtttcatacaatgcagtgaacataaccaacttgttacctaaataaagaattgataaaaacagtgtgacatattactatttggtatgattcagtttttaatgttattttaaacttcttatatggttggcatatttctgaaaatttaattccaaagaggaattaaccaaactgtacaggacaatattaaccccttctgtactctagaaatatttatactccttttaaaaaaacctgcctttggccgggtgcattggctcacacctgtaatcccagcactttgggaggccaaggcgggtggatcacgaggtcaagagatcgtgaccatcctggccaacacggtgaaaccctgcctctactaaaaatacaaagattagctgggcatggtggtgcttgcctgtaatcccagctgcttgggaggctgaggcagaagaattgcttgaacccaggaggcggaggttgcagtgagctaagatcgcgccactgcactccagcctggcgacagagcgagactccgtctcaaaaaaaaaaaaaaagaaaaaaaaaaacttttccggcagggggcagggtgggggttactggtgcttgaaacagaaataatgtatgagttagtaaaagaaaaacccatattcagtgttgactcatctgaatttcctagcctggctattctcaagtattttggtctgaggacccacttatactcttacaaattgtatactccagtgaacttttgcttttgtggatactatcgatatttactatattagaaattaaagctgagaaattatacatactgttttaatttgttaacaaaacaattacatgttaatatataaaccattttatgaaaaataattgtcttataagttaggatacaaaaattcagtgtaaaaaggaccatttttcatttttgtgagccctttaatgttgaactgaattcttgtttgtgcttttgcgttcagtctgttgaagtgtggtatggcccgatggttgaagtttatgaagaaacctggcctcacacagataggtagttggaaaacaggaatattttagtcacttcagataactgtggatatcaaaacttgacaactgatagtttcttgaagattggttgcaatgtgaaatcggaaagtttattagaggacttttcttagtttgttatgttaaaatccactgggtctgtcttgcattttgaatggaccttctggctatgcatgattttgtcacatcatgaattagtcatttggaaaatactggttcactgaattatgcagttcttctaaatattgatccgttattctgcaatgattaaagttttttgttaagggtaggcacagtgatt

SEQ ID NO: 93999 - DNA, 1195 bp, Homo sapiens
catgagccaccgcacatggcctaaatctagttccttctaataaaatgcaactaataatccacattctaatataaagagcttgcatccatttggggatataatattgaaaattgttcgcccttcctataattattttgtgtgtttctgttgtacatttacatttttaattgtactctgggaccatgttgctcactcattttaacctatcactccctttcctccccctgtaaaacaggattagtaactataccatgccaagtcatgtgggagcctaaggcaaatggaaaactctgtaatgattatttttttccctttttctttttttcagcagagagtagattctgtcttatttaaaatgtttatattatgttcgtcattttgcattagttttgacttttttaatgttgcattaaaatatctaaaatttaaaaaaaaatttatcttgattacttgccattccttaaattttgtccccaaagcaagtgcttcaccctggtcccagatgatatgtgaattcctgggcctttgaaaagacaattttcctgatttaaggcagatgttcccaagaaggaataactccttagcctactagtacccattagcatgaaacagcgttttctggggtggctcagtaaaatggagggagcgctaagctaagagagtcccgagctccagcagcagccaggtgctgttggcttccttacgcagtgagctgtctcttaatactttgaaaacatgatgctgagagaaagcaagttataaggggatgtcttgtatgtaaatttgtctccaaaattaattccaaaacacttcatattttaatttctttgaaattgggaagcatctttatttttattttttttttttttgagacggagtttcactcttgtcgcccaggctgcagtgcaatggcgcgatcttggctcactgcaacttccgcctcccgggttcaagtgattctcctgcctcagcgtcccaagtagctgggattacaggaatgcgtcaccacgcccggctgattttgtattttcagtagggtgggggtttctccatgttggccaggctggtctcgaactcccgacctcaggtgatccgccccccttggcctcccaaagtgctgggattacaggtgtgagccaccgtgcccggccaggaagcatcttaacaattgtctttgactaaggcagccatcatg

SEQ ID NO: 94000 - DNA, 1035 bp, Homo sapiens
tgagctgagatcatgtcactgcactccagcttggatgacagagcaagaccctgtctcaaaacataaaatgtcttcaaaatgattatattatgatttggcatataacacagaaataatagcatatgtaagattaaaaaaagatctgtcctaaaaacctgttataataagtattagaaaataatctttttttttttttttttttgagacggagtctcgcactctcgtccaggctggagagcagtggcgcgatctcagctcactgcgagctccgcctcccaggttcacgccattctcctgccccagccttccgagtagctgggagtacaggcacctgccaccacgcccggctaattttttgtatttttagtagagacggggtttcacagtgttagccaagatggtctcgatctcctgaccttgtgatccacccacctcggcctcccaaagtgctgggattacaggcgtgagccaccacgcctggccagaaaataatcttaaatgttaacaaaacattatttcgtagtttaattggcagcattttttcttaacatataaaagaatggtacgtaaaataatggaatcttagagttgatgaaatatgataggtacaatttatggatagtagtatgtacatataaaacacacatgaaaataatacacattaactttagaacagtggttacttttttaaagatattgggaaaaggagctttttattttctccttaaaaaaggtaaagatgtcaaaatgtgaaatctgggcaataggtaaaattgttgtatttttctctaattttccatatgtttgaatttttcataaaatcttgagttaaataaaatacagaaacaaaattcagtgtcctaaattgcctttcaggaagagggtacacatttacaatcttaatagtatacaagagtagctatgtttttcactttcttaccagtgttgcacattgccaagctgctgggtaaaatattgtaacctacattttcttgatttaattcccaattatttgattactagtgagtgaaaatg

SEQ ID NO: 94001 - DNA, 1207 bp, Homo sapiens
ctatagatttttccattatccctttataccagctgttacataagccaatcttttctcattatttgaagttgtcctttatgacatattcatgtatatgcttgtatttttataagcattctattttatcgttttgtgttgtgtgtcagtaccatgtcatcttaattatcatagttttactatacattttattatctgatagggaaaatgccccttattattctacatttacaaaaattgaatgtgtttatttttccagatgaatttttcaataacttggccaagatatccctgccaaataaaaatctcattaatgtgttgattgaattgttgtatgtgtagattaatgtaggggtcattggtatctttagccaaggtgagttccaccaggaagatgctacatctttctatttatacaagtgtttttaatgtccccagtacagttttgtaattttctccatatgatctacaccgttcttaaattaattccttgttattttatatttcttattgctgtgatgagtgaacccccctcctcagtatattttaaatgtataccttcttagacaactagttttatttacttaccaaccccaatcctgcaagaaaaaaaaaaaccatatatatatatatatttcaatttctatcatatccaccagatggcagtcttgggcacgtccatctgtaaacctgctgagagctctggtgacaagaaaggcagtggctggcagaccttccaagcactcagaagcacgcggacaaaaaggtttttttgtaaacccgaacgaaaaataaacccagcattatataattatagtatttgtactgctgttaacctttaatcttataacccattagtggagacagagaaggactgtcactgtgcccttcaaaatcatattttttcctgtccatgtgataaacacctgtggcttcttggcagcacttttggtttgattccagggactcttatggttaaaggcaggctttaatctggcgttgttttccttctcctaaaagcaccatttaaatcggaagttactggatttctaaacggttaagaccgtcttccgactggtttttatcattcccagatctcttctgaaaggaggtggtgtgcatagttaatatgaaaggaactggcttgttctacgcgaatacaaatctgaataactcttatatattagacctttttttttttttactttag

SEQ ID NO: 94002 - DNA, 1403 bp, Homo sapiens
ccctttcccctgactcatgacctatgacctgctgccttttgcacattgagtgcttaggaaaagcaatgctctgactgcatagacctaaagccctaaatccagagatatgtttaccacttcctggccctgccttcttaataatctccttctggataggtccaacattcctgtaaacatggtggtttctaatcagctctgatgtttgtcatttccaatacctgttcttggaggaatgttttacttcctgcaatccataggcatttgtctttgaggttgaagggatttcattgttgttattatgaagatcccattccagctttgagtctggttttggtgattgccctctctccttctaaaatgtggggtgggatcccttgtttactttctccagccactttgttttcatcctcatgttcctttgtgcctcatcataagatatattttgttgctgtgctggcttagatcaaaaccctcttgctgcctgttgataccgtgtgagatcttgcagctacccatatgggggaactggggtacagagacagaaataagcagcctgtcaggccaggcgtggtggctcacgcctgtaatcccagcactttgggaggccgaggcaggtggatcacgaggtcaggagattgagaccatcctggctaacacggtgaaaccccgtctctactaaaaaaatacaaaaaaaatcagctgggcgtggtggcgggtgcctgtattcccagctatttgggtggctgaggcaggagaatggcgtgaacccaggaggcggaggttgcagtgagctaagatcgcaccactgcactccagcctgggcgacagagcgagactccatctcaaaaataaataaataaataaataaataaaataaaataaaataaataagcagtgtgttataggggaaaagcccagatcccaggtgtcgaatgactctgtgctttggaattagtgaccttcagcctgcggtgtggcctctgacagtctaattctaggaagtcacatcaggattacacagaaagttactggagattgaattctagactcaagttgctgaatatgcatttgggactctgaactagaaggagaaaacacattatctgctcattatcctacaaagttctaaatacaaagtttcatttccacatgtcttctcagccaagcctagaattctcttctgtataaattcctgggttcctatataagtgaacaagggaaatagtccaaatttagcaagttcaaaggcagtctgagagtggaaacaaagactcctcaaatattggcacaaacttaccttctgtgttgaggttgcactccttctcagaccccgtgcactgacaacatttatcacctttttaaattaattgatgcatttacttatttatttatatttattattt

SEQ ID NO: 94003 - DNA, 1066 bp, Homo sapiens
gtgtgaagccataggctactctaagaaaaatgtttttgggctggcacagcggctcatgcctgtaatcccagcacttcgggaaactgaggtgggcagattgcttaccaggagctcgagaccagcctgggcaacatggcgagaccctgtctctgcaagaaattaaaaaaaaaaaaaaacctacccaggcttgttggtaagaggatctcttaagaggttgaggctgcagtggaccactgtgctccagcctgggcaacagagtgagacattgtcaaaaaaaaaaaaaaaaaaggaaagaaaaacatttctgttacagttttaccatagcataggagtataacaaagcttttaagttttaaactcagaattatagcttgaggagaacttctaaagttattttaatccaactattaaccgttattcttctctgatacagtgttctttattatctttaaggctttccactgaaagatattaatggctatttccattgctcatttgtatttgtaaggacatttagaattggtgaaaaagcactgaagcatatatgagtcccagttgagaaagccaggcaaagcacgctgtgactctggaatgcactgagtcctttggctcctggtcaccttgacaggctactgcccatcaacatttcagtcctagatttataggctctttatttttagatagtccattcttaatggtcgtttgggcatagtttttccgtattttaattgaaatatcttaccctgttctgaaaatgattatcttttcccagtgtcagaaattacgaagttacattgtagcagttggtttcactgctatcattctcctacttctaggttactctgaaaaataatgactgagatgggagagagtaaattattttcaggattttttattttgaggttggggagtttatactgtgggcttgtaaataagtgttaaatagtagtcacctgtaagtctattttttaaaaacagaaaaatgtggagaatagcctatgcacaaagataatggcagaattatttacagtttaaagacaaagcaactagattttgacttttagaa

SEQ ID NO: 94004 - DNA, 1069 bp, Homo sapiens
gctaatgcctctacatattttaattgtgcctaaaaagttagtaaataaaacatattctgtcctgagtttatgttaacaaaatcaaacttagtagcttaaaagagcaaacttacaaactcgtgattttatgagttggcaatttggattgatctcagctaggcagttcttctgctgatatcagctaagctcactgatgtatctgtagtcagctagctgtcagtgccctcactcaaatgtccagtggttggctaagcactggatatactgtctcaccacccagcaggctagtcaggactcattcatatggttgatggtcacactttatccctgatgcagcgttagttccttcagctcttcataaaacagtgaggactagtatggtctagttctcagtgattgcatctctggatgctgcagccttcgtgttttcttacctatatgtcttctaactttgttccacgtagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaaggtatgtttaattttcagaagttaatactgttaatcaaaatatttatgcagtttagcttaacagaacatcacattttgaatagtggcagcagtgttctttttcttgaaaggaatgtaacttaaatggaatttagcaaagtcactcttgggtttaggagggttatcttagaattacttagaggatcttgctttttatgcagttttacttaagatagtgtcttatggcatggacttcacaagtagagttgagtgctaatatttctctttctgtatatctctctacctcacatatctctgcaacttgagatatagtaaaaactcaggccaaagttggtagctagtgcctaaacactgactgctgttcccccatcccacatccccaacagggacagtagtggtatccactgtgtttttagccac

SEQ ID NO: 94005 - DNA, 1070 bp, Homo sapiens
gtagtgataatgtcttccacttctttgatatttcccttcttttaggaagtacttcagtacttcctaaacgcgaaagatttttttctctacctgattttcctattaaatatgtaaaagttcatggaattttattttctccttaattgtgtataaattttccccatagtatttctgaacattcttctgagcttcttagtattcctgcttcttaaggacttattcatctaaaataatagtataaccatcaaatgtctatcttactttgtttactttttttaacgaaaaagatcattttattgatgagcctaggaaagaacatttacaatctgtgaaatacctactatttaatcttatttcttttttgtacaacgttaagtctacggtatagacctacttatctttaaaaagcaaaagttttttttccctagtttgaaatattttgatcataacaaaactttttccaggatcttcagcctgttaaacaagaaaacgaaaaaccccttccagaaaacatggatgcatttgaaaaagtgagaacaaaattagaaacacagccacaagaagaatatgaaatcatcaatgtggaagtaagatatctcatgtctttaaaaaaaaatttttgatattaccaatcaagatgcaaatgagatacttggtgatttagagacatagtccacatcaagattatactgcttttggcctttaaaatatgctgaaaaacttaaaaagcaaagatttcagagattgtgatcacagaatgtgatcctttacatcttttaataaatgtaaagatcgaaagtaagatgaattttcaactgtaatatattaattctggtttttgcaaacaatcagttccgatttaaaaaaaaaaaatttcaagagacagggtctcactgtgttgccctggctgatcttgaactcctgggctcaagcaaccctcccacctcagcctcccaaagtgctgagattataggtgtgagccaccatgcccagcactgatttaaaaattttttaatcattctaaggagaagttcaaatgaaagtagttcatactttgttattatttgaaa

SEQ ID NO: 94006 - DNA, 1693 bp, Homo sapiens
ttagaaattctttataacttctttttatttcatttttgtgttttttgtacatctttcctacttcagaaagataaaatttttaatttcacctattgaactaaattttggacctttaggttattttattttgcattgtgtttagaacattttgtcatgtcgtactttgtcttaacacttagtttataaatagtagacaggaattaccatcagagtaacagctgtgatattagctcacattctaaacagaaggttgactatttcttccctccatttgttcctgaagcaacttttccgttctcttttatagattcccactacctggaaactttaacctgactcaataactccaagtattaatagttcatttagtaattcctttacctgataaagtaatcctgctgtcacatgtcatgtatcaaccattccctctatgagaaatgatgtaatgtaaaagccatggtctttatcactgagacctggggaagctttataaagatgccccggcagctgtgaaaacacctgtagagaagaatgcacatttccttctttcagcaagcatccactgatttccaactctgtccacttttatagggtgtaataaagtagaaaaagtagttactgcttttaggtaaattaaaatgtctgcttaaagagctattacctatataagttaactaaggaacagaaaagtagcatgtgtagtgggaatgttagaaggcaaaagatccagccacgattggtgtgactgaactaatcaggactcctaattttcctgactgaaaaaaatagggagttctgatcaggcatactggctcacgccagtaatcccagaacattgggaggccaaggcgagcagattgtccgagctcaggaattcgagaccagccttggcaacatggcaaaaccccaactctaccaaaaagactaaaaattagctgggtatggtggcgcacgcctgtaatcccagctgcttggaaggctgatgtgggatgattgattcagcctgggaggtcgaggctgcagtgaggttgaggcacagtgagatcttcagcctgggtgacagaaggataccctgtctcaaaaaaaaaaaaatagggagtttcaacttgtcattctgtagaaagtcttagaggtgctaaaatttcatgattctatacctcttgttaccttagcaacaaattactgcctaaaagtttggggactcttcagtatcaacttctgcagtctaactgtatatcagaaatcctggagagctttttagaaatgcggattcctggatctcaccccacatctgcgtaatgaaaatctctatggttgaggcctacacatctgttgtttgtttgtttgtttgtttgtttgagacggagtcttgctttgttgcccaggccggagtgcaatggcatgatcttggctcactgcaacctccacctcccagattcaggcaattctcctgcctcagctgccaagtagctgggattacaggcgtccaccaccatgcccagctaaatttttttgtattttttagtagagacagggtttcaccacgttggtcaggctggtctcgaactcctgacttcaggtgatccacctgcctcggcctcccaaagtgctgggattacaggagtgagccaccatgcccggccccagatctgttttttgaagttcacatcaggtaattctggaactcacaact

SEQ ID NO: 94007 - DNA, 1024 bp, Homo sapiens
ggagcttctcatgtaaggtatggactgtttaagttaacctatttgtaggtcattaagattaattttaatttaaaaataaagaatgggtagaatatcagagctactaattttctcagtaattctaacttgatttttctaattttcaagtctcaattgtctctagtcaaaagtaagtataaaagagtatatacatcgaggcaggcagatcacctgaggtcaggagttcgagaccagcctggccaacatggtaaaaccctgtctctactaaaaatacaaaagttagctaggcgtcatggcacccacctgtaatcccagctacttgggaggctgaggcagagaatctcttgaacccaggaggcagaggttgcggtgagctgagatcgcaccacagcactccagcctgggtgacagggagactctgtctgaaaaaaaaaaaaaaaaaaaaagtgtatacatatatttatagggctctaatgtaatatataaaaatgtaggtttataaaaaatgattcacctcaggacttccttagtatgcctgccagtgcatttcaaagtataattcggccttctaaatttcctagaacactaaattatagctcttaataaaatctaatgatacgctaattgttttatgaatcacaaatcagtaaacttcagtaaaggccatgaattgtattttatttctctgtaaaaaaatgaaaaataatcttgcgtttttgaccacttgagtcattcaggaagacactgtcagagtattgtacttctgccagaccccaagctgtgggcgtgaactcaaccttaaggacctgattgcccttatatagagagtaaccacataaccacttttgcctggcacagctccagcctacacctgttgtccctgtgtaattattaatagtgtcccctttcctctcaaaagtgtcctggttagaatggtaaattatatggtcatcctacagtaagtaggattaaatgatctatttgtgctgctgctgctttgacatccctctcctaccttttactt

SEQ ID NO: 94008 - DNA, 1729 bp, Homo sapiens
cattcttgctggtagccatcttgagtgagggcggaccagaggatgagagagctgtggcagggctactggaacgctgtccctcattgttttagccttctgtgcttcatctcgagctcagaagactagcgaagaacgaaaagtcttatatatttcgagactaaagaacccaggaacccaagaagactccttgaccacaacaaagatggcgaaatctgcctgttgctcgtgctagattgaggttacgtagattggcgtgctgcaaaccagctctaggcggctctgggtaagttgtcgttctgtgggctgcggaacgcagacttcggctggacttgcctgcggtgacacctgctcccctctgagagcttcaggttctccggcctgccttcactggtttgtgtccagagccggactgattctctcaatttgcgtatgtatggggggtgtgctggtctctttccttctcccctttctccccccgcccagccacccacccctcagtccccaggtcctcgctttttgactaatgtcccggcactgcgtgcgtgtcacctggtccctctccctgttgcattcagatcgcctcatccctggggtggagagttgcacggggtaaacgaataggttctcctgagaacacccatttatctaccccacccccatcctagccttgcatactgtcttcttggggatgaaagatggatggataaaggctgtgggaacgtggtgatgtaggacctttgcaggtccttgttattcgggtcttttttcccctttttttactagtgtcggctagtaaactagtgttgctcccctacccccaatcgcccattattttgctgcgacatggaaagggattaaggggggcgggggcgtcgtagcgcatctgatctatggtaaatttgacgcagcattctacctttgataccagggggcattttgtggaagacttccataatgacattcagcggtgtgcaacatacctagattattcctgtcgtaaataatagcaactgccatttattgagtggtcactatgtgccaggcactgtatggtcttaatgttaagctgtctcattttgtctttacaacaacaaccctagaaggtaaatggtgtcatttcatttttgcagatgaagaaactgaggcccggagacacagttaagtgtaggagctaagacctcaacccaggtctctctgactcttaactacttattagcaatcaaggttaataaaagctacctcctgacaaaccagagatggccttacattttatttgtgcatcttgcaggggttttttgttgtttttaattaaagcgctaaatacctttttaacattaaaaatccgaagttgagtatgtccagtatttggaaccgaaccaaattggattttttgctatacagcttactgtacaagtgacctggaacagttgcttagaacctcccacagccacagtttggcaacctgtaaaatgtgcatggtaatatctactttattaagtccatataaaatttaaattagacaaacaagataaaagcacctggcagttagttaacactcaacaataattaatcttccctcccccacctttattaaataattaggcttttccagtttatcttccacatatataccaaagatacgttcataattatgtaagaccaaagggctttttaccttttacagccctgagttcctgagataccccattaagtctgtgtacttatttgc

SEQ ID NO: 94009 - DNA, 2041 bp, Homo sapiens
ttcataactgtctgtagatggaatagcagacctgaagattggctatttctttgtgactgaagttctgaattttttgtgctgttatagagtaaatttatgtattgttgagtgtggttctggaaggtgatgatttttcagcttgattctctaagtatactgtgtgggtttttggctttaaaaaggttaagaacttccctttacataatgaaaacccaacaagtaaatattatttgttagtactttaagatgtagattaatcatttaaaaagtcattatgttaaatattctgaggaccatactgttatttctttccttctccctctagtgggcagaaaatattcttaaaatatagcatggaataatttattgctattgggtataccataatatacagtctcagtctcagcttttttgaatactaaaaatgttaacatttcagaatcattaaagcaaacgctttactcctttctaggcataatagtggatccttgaatgttgaagatgtccttaccagctttgacaatacaggaaatgtttgtaagttatacattcactctatagaaatatatttagtgttttacaaagtgaatttatagttgatgttttcttctcactaatatttattatactcactaaatgtatgcatatatgtatatataatagaaagtttgactgtctttagctgcaaaataagccttgtataaggtacaccgacaaaatgggatactgcagtttctaaacttcgcaggtgtgtgtgtgtgggggggaggtgggggagggagagagagagggagatggagagagtaggtcagaaagaacactggacactgaagtactgtcccttttatttttgtttccattttgacctcagttaattcagtagtggggctgtttcttccttctttgctttgtttcgggtgctttctttgccattccctgcttctttactttcactgtagaataaacccagaacatatttttcttgatgctactatacattaataccagagtgtttttgtttgatgcagtattacaatattacagaatatattgccttttcatcaaagcttctgattaattggtgatagatttgtccactgagaaaatcacttaaatatttcttataattcttgtaattaatttcatgtgatgaaagacatcagccaagaatacctttatgtcactgagttaaacagcataccatcataggagctatggactttttatgttttttgtataggacatttctcttaagatagtgaattgtcaatgaaatatgagcattttaaatgtaaaaatagtactcatactctttttctcaaagaaaatttcagaactgttaacttttggctgaatttaggtagtgtctttggcttaacaatgcagttttatcaaataaatagatttgcatagaattgtgttcagtaatactcagacaacacttttgttcttatgtccacattatgataagcttttgattttatagaaaaatatttgtggttcactaaggaatctataaatgtccttaaattatcctaaatacctaaaataatgtaggtttcttttttatggatagtgactgatgtgccttttagtttctttctttttttttaaattttccaaacaccaacttgaacccgaatgccttttagtttttccatgttggcatttagtgaattctctcccacttaggtgtatctcatatttttattaggtctaggcaaggactgggcaaagcataccaatgatggttgaggatacatactcttttagttctggggtaatgttaaatatcattgagtcaggcttaaacatatgtaatttcagaaaatgattctagaatgttaaatgtggaatttttgattcagtaatgtaaaagtcaagtattgttcccagttggctccgtatgaaatagggccactagctgacagcattatgtaaaataaaaataatttcctaaaggcatcaattattattttaggcatgaatgactgtcttagccttctctaacattttttcccatcaacttgttccatacccc

SEQ ID NO: 94010 - DNA, 1027 bp, Homo sapiens
ctctgatttggatgataaattatatgtgtatgtttagaagacaaggaaagagaaagattggaagcttaattatttatagtcatttataactctttatcccagcatagtacctttcacaaagcctgacccaagtggtattcagtaagtatgcattgattcatttgaatcccaagtcatacccaaacaaatctgttcattctacacaagtgtatttatatttgatatgttaatatgttctatataatggagaggtaaatctaagtttcaattttagaggacatataccacaagccctataaactaatagaaactgagttcagaacacatacattttttatttaggtaatacaataatttttaaaaaattacaaccaggatttaaaaatcagaaatattcacataaaaatgtcgatttttcagtttcttttagagaaaaaaaaaatgatctaatggcccgagtctgagctcacatggtaattattatatggaatgagcagggtctttattttgccttggcactcaccactctacccatggacattcagatttgcaatccctgatgcatattgtatatttggaagcatttaagatgttaaactttgtatatttagttatctacttaagatgagccaattctcattagtcatgttgtttatcaaagctatttaaatgaaatacttaaaaattcttttggtgataagcctttttaaaaaaattcaacaagttaatcattaatctttgggaaatattttttcccataccatccatgaatggcaacagctattaacaaatatttatattattttattgaataaaaaataagctaacactattttaaatatttttcaacagccagtatcttcgagaaagcgtatttttgaaacatacttatttgagttaaaattgtgaaatgcatttaaaaattgaaattgaaagtagaactactggagaagttttaaatatttgtgagtacatgtatgtgtgtatgtgcatgtatacttatgtgtgtgtatatatatatatatat

SEQ ID NO: 94011 - DNA, 1453 bp, Homo sapiens
gggatttttttttttttggtgttggttgaggtttccattgatagaatattttagacttttaaaaaaccatctgtttatctgaagcacaggaagtgcatccgtctgttgactttattaagtgtattgcaaataacagatggcttagtattaggtttgctcttctgtaggaatttgttgcttctaaaagtaacaaatttttgtctttcaatattaactcatttaggatatttggactgatgtttgatttcattctaaaataaagctttcattgacaatctgacctaagctctccatttatgccctaattgtaatattgtcctactgtatggtaattatctgcttacttggcaatgtccttagcaaagaaggtagtgactttgtcttattcaatattgtctccccaagatcaattaacacaagtatgttgaatgaatgaagcagctttgtgtgtgtgtgtatgtgtctgtgacaatccagaagaaacatccagagatgctgtaaattcctctgatttagggattggtgaaattcagctattttgtgaaagctctcctcccatttttagataaaggttgctaataggtttccaacaaaaaatggcagaaacctagactgctaatttactgtttatgtttgcatatattaaactaggaccctaaatgaaaatatcagagtagcatgttaatcacaatttgaggtcaagtcaattagaaaacattataagtaagtttgctgttatttccaacttcatataatggcatcattgtctctggggcacgtatgttttcaaatatgagcatcgttaggttcttttgaacaacagtacaccatctaatgaatttacatacgtaaatactactaattaacattggtttattattttgcatttcactgctatttactaacagatttcaagacaatggacaattttgtaacctcgattttataaaaaccactagtatttttggtccctagcaaccatttagtatgtaaattaggtattctcaggcttaatgtacttcatttttataaaacaaatacatcattaatctgattaagttcttgggtggaagtgctgtcctcagatcattgtggattatttattgttgggcacgcatccaaaaaaaaattcaagcatggcacttacagtctagatttaggagaattgttgaaaccccctaaatgacattttccagaagaatagaaaggcactgcttacttacaattgcaagcattacctaaaacttaatgatgttcttatccttaattacaactcagttggatgatgattcagtgcctgaaattatgccatgttttgctttgatgttataaaatgtataatgaaataaaggtgatccgagtgaatcaaaaatagattctggctttccagtagtgacttaatcactatgtttctgacttcacaacttgcttgactgtcatggctattatttgg

SEQ ID NO: 94012 - DNA, 1087 bp, Homo sapiens
ttgttaacactgaactgtactgaaatattttactctcagggcttttcatctgacaaaggaggctttttgaaaatgaaaaatcacagctcctgtccctggtatgctatggggaaatttattagttttgtaatgcatgggttaatattaccatttttttatattgaatattacttgaaaaaattactattaatatcactgcagcatgtatgtatataagtcctgtcatctttggggtatgtaaatcaggaatgttgctgaagaactacttagcattttcttgggggtgaagtgcttagttttggaatttaattgtaggttttacatttaagctgctcagtattactcttctaaaggttctataaatttcttgctttgtagtttaacaggtttagtcaccacagttgaaaggcatcatcctcataatgaagccagagaagaataaaggttgatcatgcagggctggctggctgtgacattgaacaatagagcttgacttcttcatgtctgttaaattagactatggggtgtgcttatcttgctgcaatgatactgaattgtaacatgaaaatgttatgttgtgcagctctgcgaagggagttcatccgttctcacctcatatgtatggcaaaagctttaaaatactactgaagctgcctagtgggcttaaagtctaatggcacagaattgggcataataatgaaacaaataaagaaaaagtgcaaaggcttttaaatgtcttgtacaattttatttatagtagtcttttaagggtctaaggcagaacacaagaagggtatgctggaaaaattccatttggaagaggtctttgaaggagataagtgttacggcctgaaggaaaagtaagaagatatgttgcgtaggtgagtgatttattctaaacttttctacacgtgtacttgatacatacaactcaattctttaaatattgataaaatacctactatgttcccagcaccgtgttggataccataggagattttgaaagagcattaaattcagtcctgccttgagcaatttagtattttttgaggcgacagaaatgaaatccatgaaataatttcttaga

SEQ ID NO: 94013 - DNA, 1868 bp, Homo sapiens
agcttcagagtactcaggaaagaaaagagagaagcaattattttcagtcattgagttttgaagatcttagcgttaattatgccaaacattgttggttcatcaacaaatacaaaccttaaaaggggttatgaagcattctgaacttgcttaaacatagtttatggtgattaagagaatcttgtatacactaatatatttttagttacactttcacccatatattttcatatacagtttcaaaaccaaatattcaaattaaagctaatttcagttttggttaataaattttgaaatgcttattcactttaattagcatttctttcgtatttgaaaaaagaggaataaaaaagtacaattcactatttctctgtggagtccagagtaattttgggtgtgaaaaatatttcaataaaacaaaaatcacaatgtcatagctctagtaatgctatttaaaaattgatttaatagtgggctttgagatttagaaattttctcccacttaaatctttaatttatcaaagattatttgagcattaaaaatgtgctttgcctattgttttccaactctctgtgctctctgacttgttgaagttttgcaggaagtgcccaatcaaaggatttgaggaagcagtactggacattctttggaagtgttcatctgagaaaatgaaagttagaggctaaactagttttcttgtttgcaactcaaattttaaatctaatttcccatgtaaataaaataagtgaaaagcacaaaggatgtaaacttcctaaatctgccagaatcttgtgtcttaattaaaaaataattttatcatagcaaaagaaacacatttagttcctaaagaaaataccatgggtggtattcttttgttgtattagaggtttgaagtagaatagttgtttctcatgtacatgtattacagtagacaaagtgttgaatagttttcatttctgatacattaatgattagaaaaatcgttaccctaatcctttttttataactcaaaaacaaactaaaaaggtttttgtttttttggaggatctgttctttccaagaggctggtgttcttctacctttactgtcctaaccttgcctttcaaattaagatataatagttagaatctactatagaattaatttagattcagttgtctctattaacagaaagtgatatggttttaaaaaatgcagatgatcatttatgagaatctggctgtaatcaaaagcagtaactactatccttagcagttctttattcagtaaagagttatcctctttttgctattctttatttcatttattcttgtgaaatatgtttacctttttaacaaaactttctattttacgtggctagatatgtgataaaacaaacacggtaaaatgttaaggatagaatctaggtggtaggtatatggtcttctctgtaaaatttgcttctctttcacatttgctgtatgtttgaaattttcatgagacaattttagagaaaaaaagctttctattttgattgtaatagccaatagccaaaaaccttattccatttttgaaaaaaaacctagatattttaagtttcttttacttatctaagcataacaatgcaaataccatataatatatattgataatatcacacatttagtgagttagaaaatataaaactggcttttaattgttaaatatgtatactatataccattcatattttagctggtggtttaaaaagctaacttaggcattatttaaactgaattagggtaattacatcaaaagtagtttcttagccagaataattttccattttgttaaaggagccatgatgaaatgaagtgtttagagagttttaggaataaaatgtgggtgtgta

SEQ ID NO: 94014 - DNA, 1167 bp, Homo sapiens
attaggtatatttacaagtcatctgtgatcagtttagttaccatccctttgatatcctgcagccattattggatgcctttggggttgtgatatcatgctggggaagaatggttcggctgcaggttttatgtgtctttttatagttgttcacaatatcccatgctaaattatatggtgaattattatacatttgctagtttaaaagatgtctaattgatttactatgctaaaatatcaaagactatatgctgcaggagtgatgcttccagttaacaacttatcatgtattcatggagacgacaatgcttgctcacatattggcactattgtctaatttggtgtgccttgtgttgtaattcaatcatctattattaaaagtagatgtggctgtagggagcaaaaccacatacaaatccataaacatacatatgtgcatatttacttatactcacatatatgttcaataaggtttttgttttacctgctattaatgtttgtactagtgagtcataaatggaaaatatctattagctctaaggtaaaataaaataggttttgatttagttcaagtgaaccatctcatttaaaattagcccaggggtcttgtaaagaatgcaagtaatctaaacataataatgcacattgcccaattgcttctgtgtatgatacaggttcagtgctgtagtgctttgacagcccattactgaatgtaatgaacagctatttttaaacagaagaaattcaagttgacagcttggcaatgaaattcagctagtgggataatttttgtcatctttagtatagagaatggattcagtttggtttaagcaaatttgtatcatgtagtttatagcgcaaacatttttattaaaagataattttattgtccattttgtggagaggggcagatgttactgttaagaatatgtaatcagcttttaatgaatactttaatgaattactgaaacatcatttctagaacctaggtttaaaatgaaatttctcatttttctttcctgccatgggtgaaatagtctaataaaacgactataagattaagaggtgtttttctatgctgctttttagtctttcagagtttaaaacaagtagttttaagaaataagatagtctttggaaatggatataaagcttgaggcagtgttgtct

SEQ ID NO: 94015 - DNA, 1060 bp, Homo sapiens
gcttgaaaaatacattactcaacgaaatctgggtgaacaaagtaagtaaactgagtactttacccaatatccaataatgtttctgaccctaccagtaaaataaactaaatatatagcagtggtgaaaattttaaaattgtcagaaatccccctctaaatgcattgccagaaagctttgttcatgggtcttcattaccccttcatgcttccagggcacctcctctgggttcccaaggcactgggaacttaaaagttagctttgcttagtaactatgccttgaagtaggataataaaacaaatcatttttaatagtcagtagattttttttccatttctgatctgtttctctattttacttatctcttggacggcataatggccccaaacctaatatagcaatgaatctgtgtagaagtcaagcatttttggagaggctttcatgttaggtcactactgtactctttagaattgtattgtatcagtgaatcaaaagaatttcttgacatgaaagaattggtacacatctataaacattttatttaaacctagagaggatattatttatctaacagaatccagcttacttctagcaacagtaccatcagtttgtagcctggtctttgaactcttgattttgttgtgaagtgaccctcttgaaatcttaatttacccatggatagaggacgttgtatgaggcagaagggcatcatcacattagccctgcttctctatggcatcatgagatgctaagataagcacttgaaaggtattttaactttcttgatctcagaataacttgagaagaaattcatggtacccacatactgggttaacaaaataattagtcgcatttggttatttgtgaggaggaaactgtgaaacgtgaaagtaggactggggattccaggacgaagcctagagatagattttttttagaaggaggcttatctctgaagatgggcaggatgaaagaagtcaccagcgattccagtggatgctttctgtgttatgtgactacatttttctttctgcttgccctttgaactttgaggtctgagc

SEQ ID NO: 94016 - DNA, 1038 bp, Homo sapiens
cattctgaagttttaagtgacagataaacaaattcaacatgcaccaccaactttttgagttttaggtacactaacttattgtgggatctgggccagctgctctacctctgtagacatttctaagtgggaaaaaaaaaaaagatttaggaatagtacccttttcagattctctcagaattatagttgtaagcactatgtaaattcatagaacatagttttgaagaccagctttagaatttcaatagttattgtatattcaaaacagctacacaagcactttattttcattttaaagatttacaattaaagtcattttatgtatacctcaaatgcctgattatacacaaacccattacagggtttatacacacattaaatcccttcttattatggggttttgtgcacattaaatgcctggttgttatagattgttgtttttcttgttaccattaaatgtaacatttccctaggtgatgaaatgtattattatttagaacatttattttagtgtgtgttctgtattttaaaagagaaaggtatttaagcagcaaagatgtaactgttatgaaatttatttttataaatagctttcagcagaaatcagaacagtgctttaaaattacagttaaaaaatcatttaatcatcacactccttgatggctaatagagtagtaagtgactcccccatatcccccgcaataggctattctcgatatgctcacttaagtggccctaagaatagtactagtatattttatgttagcaagccttgatagcaaagtgccaaaagttcagggggcatttgtctcctttctcaaaaattcatttaagtcttgctggagctttaactggggcagacagccatacaaatgacttgagataaaatgaaaataatggactgagctgggtgctggggatggtagttatgctgagcacacatcaataagcttggagtgtgattctatgctaatgcaagcctgatggatcagctttctcttttagcctggaggaccattaagctctggaagctgagtcaaa

SEQ ID NO: 94017 - DNA, 1028 bp, Homo sapiens
aatcatttcgatgaatgacaaagcttttgatgaatcagatactatcaaagcttggagttgttttcagaaattgaatgtatgctggtttaaaaaataagctaaaatatatttttaggtatcatacatatggggaaaaaatgagatatatagttaagtttgaacagcttagactcatttaaacccgggttttagaaatttcaattccttgtaattaaaaattctgttgatctatttaaaaatgaatatgtatttaactttcccatatttaacaatagtaaactttaatattagtaaaatattacctaaaagatgttcacagaaactgttgacatgtttgaaaggatagaatataattaactcatgcattttgaggggaattttagggcttagagaattgcataatagactgatagggaaagactttcaggagagggagcacagtgactgatatgcctgaatttgagaaagcagcagatacaataaatgtctgattctatgtaacaagtagtaaatggaatttttcactaattgaatttttctgtttaacctagtgtccatgtgtacgtattgtacatatgactagttttgtaagcattagaatataataaacttaatcttaaacatacacccaaaacaattacttccaaaaattcttcaggaggtctattggaatctttagtgtgaatgattatcattgtgagcatctattgctattttagagtcttgcttatggggaaaaataatttgataatgattgagctttctgattacctgggtactacataaataagagtgttaacactaatttctgtacatttaggtaaatatatttacttataaacatttaacgaaaatattattattaaacatagttctattttgagtaaataatttaaaatgctgggaccgttttctctgagtggccttcttcagacttctggaccctagaaatggccttatacttcaccctaggagggccctttttttcacaggcctgaaactctgtagaatccatgttggatattatt

SEQ ID NO: 94018 - DNA, 1030 bp, Homo sapiens
tatattctgatgtcgtggaagaactccaaaatgaagtaatgaggtataatagtatattgcaatacttggattacaattgacaggaaaataaaaccttgcaaactaattgccgtgagaagtagcaattgtgattcttatgctttgaaaactttaacagaatggaaaaaataatggtaacatattagaaaaattggattattgtaaaaagaacaagaaaaacctaatttaaaatgaaattaaaaaaacactttcaatgagaacagtgtttttatgtcttatccatacccatctaatataaggagaactacttattgggttccatgttcactatttgggtgaaaggttcacttgaagcccaaacctcagtattatgcaatatacccatgtaataaacctgcacatgtacttgctgaatctaatgtatatattagattaatacacacacacgcacactcacacacacacacaaatatatgggcaatgtttcactgttggatctgcataccagatgcaacatccagttatagtattatatatatttttaatgcagacagatgcaaaaatccttttccacacagatatgttagaaataaaaggaaaaatatatagacttttacaatagttaggtactcttgaatcagaccattccaaagtgtttaattatataattttcaataatagctcatttgtcatctttctttttcttgtctttttctttctttctttctttctttttgagatggagttttgctctcgttgcccagactggagtgcaatggcgcgatcttggctcaccacaacctccgcctcccgggttcaagtgattctcctgcctcagcctcctgagtagctgggattacaggcatgcgccaccacactcggctaattttgtatttttagtagagatggggtttcaccatgttggtcaggctggtctcgaactcccgacctcaggtgatccacctgcctcggcctcccaaagtgctgggattacaggcatgagccactgcacccagccttatcgtttttc

SEQ ID NO: 94019 - DNA, 1046 bp, Homo sapiens
gtgtagtaaaaggaaagtttggcctggatagattgaataactttctatgggattttttttcctttaggtaaataatcctatgataaatataagtaatctggttaggatatccttatcaatttctataatattatgttaaaggcagtggaaaaatatgatgtaacttgtatgtcttaaattgtatgtctcagctgggtgtggtggctcacgcctgtaatcccagcactccgggaggccaaggcaggtggatcacctgaggtcatgagttcgagaccagcctgaccaatatggtgaaaccctgtctctactaaaaatacaaaaattagccgggtgtggtggcatgtgcctgtagtcccagctactcgggaggctgagacaggagaattgcttgaacctgggaggtggaggttgcagtgagccgagatcatgccactacactccaggctggatgacagacccagaccccatgtcaaaaaaaaaaaaattatatgtcttaaattcctgtagctttaatgtgagaacactgaagcacagaaaggtgacaagagctaatgagggactgagccagggtttcagctcagccaggatttgagctcagggaactgtctccaatagcctaattatttttctttgtttttaacttttagttattttagactattacaaaaaaaaagttttttgtttttgttttttgttttgttttgttttgagtcagggtctctctttgtcacccaggctggagtgcagtcatcttggctcactgcaacctccacctcctggactcaagtgatcttcccacctcagccttctaagtagctgggactacaagcacatgccaccatgcctggccaattttttgtgttttttgtagagatggggtttcaccatgttgcccaggctggtcttgatctcttgagctcaagcaatcttcccacctcggcctcctgaataaaagttttaaaataagtataattcctgctgtggtttgagtatgtcaccagaattcatgtgttggaaatatggtccctggtatggcagtgttggga

SEQ ID NO: 94020 - DNA, 1026 bp, Homo sapiens
aaaggggaagataggctccagcttttggaggaaaggcagtccagtatatacctaccataatgatacttctttccgtgttgtcggttcttattttataatggtgtctaaaaaataaacaggtaccactactttactaacctgcttttagaccaaatgtaatgaaagtgatacggaactgatttttaactattgaacctctaggatagatgaactcttaatgctatcacaaaccaccatgagatacttcagcataatagagtgctagcaaagttgaaattgctgctattgtgtatctcagacttgttaaagctgttccagactcatggtgaaatagattgctttcttctactggtggacattgaactttttccctctatacatgtgtttataaacaaacagtgacataaacttttccattggaacatattttgaagcagagatatgtgtttgtagagagcattatatatatcatttaaatgtattttttttccaaaacaagtttccaggtcataattttgaacctgtataattttcattatgattttcctgtctgaactgaaaggccatgcaataagtgaaaatattttatgtttatttttgttaagtacctctccctctctgccttagtacgaggcatagcaaggaaggattaaggataatttcataaagataattaaacataagccttgagtgacttctttctatcagaaagacttcagaaaggaaagagttgaattagcatggtatgtttaaaaacgaaacaaaacaaaaaagtgtgacttaggacacaggagatgtacgttactaaaaagttttactatgtgccgggcactgtgcttcaaactcaacatgcactatttcatttggtcccaacaacccagtgaggtagttgtattatcttaattttgtacatggtggcatgatcatagctgagaattcctgggctcaagtgatccttctgcctcagcctcctgagtagctgggactacaggtgcacagcatcatttccagatagtttttaaattt

SEQ ID NO: 94021 - DNA, 1005 bp, Homo sapiens
tgtcaggtttcttctgcagttatgtcttgtcctgtcacgtcctgctagcacaacttttggcagaatccaaaatttgggagccaaactagacattaacaatgtttcttcaacagctcagccatagaagctgatttcaaagttaacagtaactgctctctttggatcgagagtcattcattcattcagcagttatttatcgagtgcttacttagcactggggaaactggtgaatgaggtaaaatgctactcctgttcttatttacaagtaagtactggggaccaaggttaattgtttacttgcagttatgataagggtcgctcttagagcttataataaggagctctaactttgccaggggccagggtgggggtgggtgatcaaagcatgcaaccttgaggaagtaacagttgagcataaatctgaaggatgcactggagagcgagatgaaggagtagggcaaagtgttctaaacaatgggaagagcataggcaaagtcctgaaatgagcaaaacgagcaaaacaagctgagcctgaattgagcttcctccaaatgggaccctactttcatcagtgcatttgcttggaaactgttactcaaaagtttatgtgtgttgtgtcttttgccttagtctattacaagaacttacataggagagaagcaagatgtttccagaccctcctgaatgaacataatttttcaatcacagttggtagctgttgctctgagcttagggcagaaatatgagtattcctgctcagcaaacatcatgtccatgcagaggtcacccacagctctgtggtcctgtggagagcattttaatatgccactgactgatggctggactggatatgtcacataagcctgacaggtagcaaggagattggttttagaggaactgaaggtctaaaaaggccaccctggctgaagcaggtcagcataacaggagaggaaggagaaggggccagactgtgggtccatgagggcacctcatggacatggcagg

SEQ ID NO: 94022 - DNA, 1048 bp, Homo sapiens
agagctgatattttaaatctagtcgtttttaccaatgtaagggaatttaagagataaaatttgaatagaaaggtaagatttgtatagtgattacaaagatgtgacctttaacagagggttttgttgtgtttgttttccacataaaagaatgaagaatttgtgagggtgaggtaaaagagaaggggtctccttaaaacttgagagaaggaaagaatttgtcccattgtagcaatatttgaaaacaggttttattaaggttttaatatgtgttgaagtaaataattatgcaaattgaactagaaacttcttagtttaaatctagtctgctatttacagtgttagtagctggacatcatacttttttaaattaatgtaatattgataaatagcaatcctgtgtattctcttatttctcagacttaataacaaagactttataaatccacatatgtagtgggtttcagttgtttgcacgttattcatgaccaatattatgtacatagcattgttctaaggccttctttgatctgatcttgggtataaagaaacaaaaacaagccgggtgaggtggcctatgtttgtagtcccgggtgccctggagactgaggcaggaggattgcatgaactagggagttcgagaccagcctggtggcaacacagtgagaccctgtctctaaaaaataaaaattaaaaactaaaaaagagacaaaacaaataacagttattacttgcagagcttatacttgagatgatattaacatatgaaataacaaattcgaacactgacacatcactcatttgtgaactaccttcatgaattattaccaaaaatcctattttaaaatattttttatcatggtaaaacatatataatcttttacgtatcttaagtatacaattcagtggcactaagtatatttatgttgttgtgcaaccatcaccaccatccatctctagaactttttcatctccccagactgagactgtacccattaagcagtaattctacaatctccccttctcccagtccctggcagccaccattcta

SEQ ID NO: 94023 - DNA, 1030 bp, Homo sapiens
catatctgagctattcttttcatctccttcctgtttctttgtatacacttctagtagttaaactgattttaatggatgaattttcatttaaaagtaaaaaatgatgttctctgcttcaagcagcaggtgtgtttttaatctttaataggtcaccttcccaagtgcaagcaggcaagctgttattgatcaaagaggttttgttgggtagctctcagattattgagtgacaaactttattgaatttgacttaacagaagtcagaagacagctgaagcataagagcttgcactgccatcagagtcattttacgacagccagggagcaaagctcagagatggatactgagctttttgctggcccttggagattaactgaacagccttcctaccaattcccaagcctgtcagcagaaccaattagattttcaaccagtagacaagaagggtggcacttggggacctttttgctttaggtcgaaggcttttcagactgcgatgagatgacattgatgatgacacgttgagcattggttggttttaagacaagttaaattagcagtcttgaaatgattccaactgtctcctgacttctcactgttgccatattcagtggatcctgtcaggagcaagttgatgacttaatagtctttcttgagtggatttgagcactttggctgtgtgtttatgtgtagttgtcatgcttaaaatattcatatgaaggtttgaaatatttatttgaaggcgccttctgcagagttcagcagtaaggctctcagtgcttctacctactttttattttttattttttgcttctctaagcagttattttgtacaactaccttttattctatttcatgtataattgatgacaatgtttcatgtaattattgataacttcatttatgataaacttaaaaagcctttctgacatcatgcatttctcccagactactgtaaattcagatctactcataaatagtttggaaatcactggggattaggaagggcactattgtttttattctgtgacc

SEQ ID NO: 94024 - DNA, 1036 bp, Homo sapiens
ccacttctatggttaaattttcttgagtttcttttatcatactttttttcttctttaaacatctagtaagtttttgaggatgcaggatactgtgaacattacattgttgagggtctgaatttattttttgttttggtagtcagttaagctacttgtggatcagtttgattctttcaacacttatttttggttttggtttttggggtttttttaagcttttggaggacatgtctagtgtgacctttactttatgctagtttaaccctactattaaagccttaccttttggtgttttcactgaatgcctctgttatttaataatatctctctactatggctagaagtaactggaacatcttacagactattgtttttttgcctagcctgatggagtctcacactgcaacacacagcttagtgctcaggcaaagattcaaggaagactctgcatcggtttctgaaactctacttatgcatagctccctcttctctggtattgtgccctgaaaattccagccacctcagcctcccctaatttcatctctacctcctcaacttaatgagtcatccactttctgcttgtagtgatcttaagtctcacttcacttgtttcccttttctcagagatcgcagtcctttgctgcctgttgtccaatagctgaaaacaatggttcgatatattttgtccagttttccaattgtttataattggaggtcaactctagtaccagctttcagtcatcactagaagcagaagcattttaatgccttttaaatataatagtatattgtttagaaatttacttatacatcataccacagtgatttattgagtacctacgatgtgctaggtaccatgccaggatttggggatacaaaggaataactctttctatcttcaaggaagctcacagtctgttagagaggacaaacatgtaatataaatagttagaaaggtgtttgggagctcaaatgaggtcataagtaactatatggtgtggggtagaagtatttatgaagcaactagtctggtttt

SEQ ID NO: 94025 - DNA, 1117 bp, Homo sapiens
atattttatatatatatatatataattttgagacagggtctcactctgtcacccaggctggagtgcagtggtataaacttggctcactgtaacctccatctcttggcctcaagcaatcctcccacctcagccttctgagtagctgggactacaggtgcatgtcaccaaaccaaaataacttttgtattttttgtagagatggagttttgccttgttgcccaggctggtcttgaactccaaggctcaagtgatctgcccggcttagcctcccaaagtgctgggattataggcgtgagccaccacacccagctctgatgtatttttatctgatcctcaacatgaaccaggactttagaagagaaatgccatccttgcgccaatattaactatcacatttcccagcatctactgagctgtcttcacccatcttgccacctgacatcctgaaatttgggtgaaagtcttctctggcttactattctgaaaggcttgtattgtttccagacctcttaccttatttgtttgtattttatcatacagacatagtaaaatggtaatgaatatgctattttatattttttctgcctcctatataaaaataattagtggaaactatttgtaaaggaagatacatttacctttgttggctaaaagttatcttgattgccagtctgaatagtgccatggatggtataggcaggcctggggcatagatgggaacaaacctaaaagataagcaaagaatgggtggagagaagataagggtgcagagaaaacagaggctcatctggtagaaagaaataaagtgccctctgaaagtgtctcaagtgcttcctagtggcactggtgccataaggcagctgtgttgagtctaagccaagtatcttcctgatctccactgcttcctgcggctgaacggggcacaggtctttcatacacatttattgtaatttagggagtgaacatggtccaggtatttgaaaagaagactggttgtcaggaagcattccttctgcttctctgcattgtgtgtctgtgattatgtgtgtgactttatgagaagtatctgaccttctctctacacaattcctcctgcttgtgagataaggtgtgccct

SEQ ID NO: 94026 - DNA, 1041 bp, Homo sapiens
ttatgctgctgatccaggaaccacactttaagaaacgctgcctcagccaggtctgtcttctgaacatctttcgccaatcctctctccatggttccttagagattacactctattgcctaaaatataatccacctcttctgctcttgacctatcaatttttgggccctgggtcaccttaattgactttttaccaggccttctcaatcctgggtacagatagctagttgcctaaggaatgcttgcaatattaataaatgctgcctttttgttcaaagttaacaggtagcttttagaatggcctagtattattgattagctgactttgtagtctcctttaggagtataagtgtgctgaagttattctgatacaacgttaagtcatgaatcaaactcattgtccttccatgctccagtacctagtctccttccccaaaatcctacccccttttttccttcaaaattgcacttcagatctgcatcctttcctgtcatcagttagtcccctaaatccccagtcctatttgtgatacccatgtatttttctgggacatgaataacaacctcaaacatcttaataataaagcctcagatgggtaacaggaatacactgcaaaaattaaattacaatatttaagccttccttgtaatttatttagagccaggtttcccagcagtgacactgttggccttctgggcagatgactgtttgttgtctgggcctgcccggtgcactgagggtgttcaacagcagcagtggcctccactcaccatgccagtggctctccaccctcaccccgtgtggccaccccaaatgtcctttgagggcaaaaacctcctctggttgagaaccactgatttagagacatctcatgccttatttgaattttcagggatttttttggtgtgaagtattgtcagctggtttgggccttttaaaatttcaactccccaagcccttttaatcttctccatttcttttttatcatatatttctctttgtttctggctaaaagagggcattgtattttcatgattttttga

SEQ ID NO: 94027 - DNA, 1046 bp, Homo sapiens
atctttttaatttctgctgcccttagaatagtaccacagttgaacatggcatagtttctttttgttcaaagcatgttggctttgtttgcatgttcactggtttatctacttgttgacaaatattttgaccaccttctgtttgccaagtcctattctagatgctagagatggagtggtaaacaagatggaaaaggccgtgccttcttggagtttatgtcctagggagggaaacagatcatgttcttgaaggcaagaattctgcttaatatgtttttgtactccctgaagcaattagtacactttatccttggtatatgaaagcttttaaaattggtatttagagaacattttgaaagacatgaatccataaggcttatggaaccaaaccatttttagtagaggaaagtcaagctctagagaatcagacatccatttctacatcagatagctgactttcatttcagtgttggcctcttctcaggcatgcgcatgtagtgtctgtagacaaactgacagtgtgagtaggcatttatctgttctttgtcaggttgaagaggaaggttagtagaaggtaactgagataaggaagctgaaggctctctttaagaaattttctgataaaatatacctgttagtgagttttgctagaattatagtaacagaatcctgaagaccgctgagaattctagagatgccacactcctgtttccttctgttgctatcttggctatgacaaaatgaaattatcatgtgtactttctgttactaacataacactgttgatttgcttaacaggtttatagatgggctcatatccctactatttagtgttttgcactgaagacaccaactcccataagaacgttagccggttcagctatttttgatagagttatcctttttgtattaaaatgagccagactttaaaataggaggatgctgtatttttagggaccctcttaaactacagtcaattaaaaattaaggccttttattttagaataacattgtattgattctttggatttgcccacttctacttttta

SEQ ID NO: 94028 - DNA, 1050 bp, Homo sapiens
gcactgacataatagctatttaaaagaattttgaagtttgtcttatcttttgaaccacctcttagtgggttgccctacactgctaccataattctagatcagaacaatttttaccccattattttgtacgtgatatttggagatatagtggcaagaaagaacaaaattacattaaaaaatgcactgcacttgaaagtatgtaagtttgaaacattaaaaaaaggaagaaaaataaatgaaaacaccaaaaagcaataaataattttgtgatttcatctgagatggtatataattgtactttctagtccattcattctaatattttgttgtcactttgttttgctactatgtaagttaatcagctgtcataggatcagagatacttgaaacggaaaatataattagtaaaataattagtacctttcatttcaaggtcttgaaaccctttctagtcctctttaaccagtgcagaatatactggtccccagcatgaggggggtctgaatgttaggaaaatatccctcttttggactctgaaataagttcatttctgctaaattccaaacaaaaacacagagctgggatcagttttaaagtcagtccagaaaaatgtaagtgataagctggaacaacagttctcaaactttgttctcagaatcatttgtagagcttgttatgacacattctagatccccacaccctgagagactgaggcaggcctggggttttgcattctaacaggtaactctgacgcctggtctggagccctcacgtggggaccaccaaactagagttctcgctgagagcttctcattcaattctgcagtgttccattgctttaaaattgttcaaattttcttgccgggagttgtagctcatgcctgtagtcccagcactttgggaggccagggtgggtggatcacgaagttgggagttcaagacctgcgtggccaacatggtgaaaccccacctctactaaaaacagaaaaattagccaggcgtgtcggcgggcacctgtaatccgagctacttgggaggctgaggcaggag

SEQ ID NO: 94029 - DNA, 1054 bp, Homo sapiens
gatgttgccacggactccaagcagtgatctgaaatgcccgcctgcctgaatagtgtggcattggtcagaggcagagggtacagagagcagaaacttctatgtcaaatgcccagtcaggtgatgatgaatgagccccagctctgccttctgtcaagtgcctcacagtttatagaggtcaaagtgcagtttgggtatttatgaaaaaaaccctacccacccccaccaaaaacaatccccatgttaatgtatagaattgtcacattagtgccactgagaactactttgagttgcttttctgtgatttatttttccagaactatatattttggtgtaaaagtcatcatgatactcaacattaatattgactggtaaagatccctaattggagtccccttacctttttctttctattattgttttcagttgaaaaaggaaaacccggacatatatgaagaaaaccttcattacccgcttctgcttattttgaccaaacatggatagaagattaagcttctcaaagacgaagaaacgtatcaagtgcatagggaatatttttacaaaaacggaaatctgtaaggggtataatcgcctgcctgcgccctttgcagcatttcacgtgtgggctatggactccacctgtcctcacccacgttattccccagctgccctctccagctccctccccgcctctttttacactctgcttgttgctcgtcctgccctaaacctttgtttgtctttaaatgtgtataagctgcctgtctgtgacttgaatttgactggtgaacaaactaaatatttttccctgtaattgagacagaatttcttttgatgatacccatccctccttcattttttttttttttttggtctttgttctgttttggtggtggtagtttttaatcagtaaacccagcaaatatcatgattctttcctggttagaaaaataaataaagtgtatctttttatctccctccaattaattgtattaaatccgccatccctttctctgtccctctctctccttctttttttccttttaaacagtatgtt

SEQ ID NO: 94030 - DNA, 1035 bp, Homo sapiens
atgatagtgaaaacagcaacactaataactacacatgcatagaaaaaggaaatttacagagcactgttgcttctgttctaaaatcactgagaactgactaacatttcatacacactcagtaaatccttttcctgggattttttttccctggccacacaggtagctccattttccagcttcccttgcagttggttggtcatgtgacaaagctccagccaattgaataagagtaaaagtgccgttttcttggtcagaggcgccaatttgactcacaggcagggcatgatggtggtgggtacagacacctcactggcgatctcctccctcctgtccctgctgctcttcactgggatgcagatgtagatccatcagctggcctccaccgagtggcttaccatccagggtggcctgcatggctcaggtctcttcgtgctctccctcactgccttcaagattctggagaatcttgtgtttggcaaaggatcccaagcaaagaccttccctgagattctcctgtgcctcctgttggctctctttgcatctggcctcatccaccgagtctgtgtcaccacctgcttcatcttctccgtggttggtctgtgctacatcaacaagatctccactctgtatcaggcagcagctgcagtcctcacaggaccttggctcttgccaaggtcacaggcaagagcaagaagagaaattgaccttgaatgttcaataaagttgattatttgtttaaaaaaaaaaaagagtaaaagtgtaccacttctaaaccggcccccacctcacacctcccatgcctgtcctccacactcgttacttatccagcaactaagtgcaaaggattctaaggtcctaggtgaggatggaaccatttgataaaagagcctgggtccttgaatctccctgtgggaaaccacctgctcaccggaagcactcctattgaacttttgggtgggtgaaaaataagcttatgttttggaatttatttgttacagtgacaccttatgtagtcttttttcctgttctttacct

SEQ ID NO: 94031 - DNA, 1163 bp, Homo sapiens
tgcagattgttctgttccaagtgggtaaatggaaactgtgttcctaagatgcagccagttaccttggaattcctgttctccattccgtatggttcaggcaccctcttatcacatcatcagtcatgtttctagctgggttctggccttatggttagggagcagctttgcttcagagctttccttcccctgcgggctcccccactcccactttggtgtgagaatcatggggaaccaggggtgacaccatttattttaaaacaagccagcacacatgtttgtaggctttttaaagccatagactgtaagtggacacttccggtgttcctcaggccccagctggagaagtggcccttggttccatgggtcctcgtggaatggggatccaaggtgattaaaaagcaccagctttgcggcactcagacctgttgccactcctgcctccaagcacggtgttttcttgtaaaaactgggattcaagttttcatctctcatgagtggtgaggaagatggacataaacaattagaagtataagcaccttcccatctccattttgaagtcctccttctacctcccaaaccttacattgtcttctccaaagtggccatcctgcaatgccagtgagcctggccctcagggaaggacattgccagagctctttcctcctcctcctcccctgtgccctctcacagcacccggctcactgtataccaagcatttctttcagtttccctgagttggtgaagtcttgttgaaatgatccagtgtggtctcagttctgctgtaagaaattggagctagggtgcaagtgttaatagttcagaggtcttggggcaggggtaggggaactttgagacaagaatgaggcggaggaggaaaggcccagccacactttctcaaccttgcaaaacctgagttttgctttatgaaggcaactagtcattctctttatcatctgcactgtcctgttagcaactctactgttttggtttcttttggggaccatttttcccccacaaagaaaggccttcctacaaatctagggcttttagttttaaaaattactccatgagagttactacgtacgtgatcataagtatagtaatatggcattaagtttagaggttatttatccattcactaatttactcagcaaatattcctt

SEQ ID NO: 94032 - DNA, 1212 bp, Homo sapiens
gcataaccttgagattacagaggagttgcagtttttggtactgacagcatagggaatgatagtgggataagtagcagaagtaaaggataaggtaagatcaattaaagaaaagaaattctggtctgtcaagaacagaatttgagcaggtgtgctggctcatgcctataatcccaggactttgggaggccaaggtaggaggatctcttgagcccaggggttcacgaccagcctaggcaatatagggagaccccatctgtataaaaattagattatccaggcatggtgccacacacctgtgtcccagctatgcaggaggttgaggctgcagtgagctgtgattgtgccactgcactccagcctgggtgacagggcgagaccctctctcaaagaaaagagctgagaactcagaaaggattatctatgtgaagaatgattttaggaggctgtctcagtaatgcaggctaaaataacggtggcttggatcagagtgttagtggtaaaaatgatgagaagtggtgggattctggatgtagttaggtggaggtagagccaaacaggatttcctggcataagatgtgagacagacagtctaggatggctccaaggtttttggcctaagcaatcaggagtatagaattatctactgaaatgagaagactagtgggggaacagttttggtaaaggaattcattttagacaggttaaatttgagatactcattagacatccaagtgctgatgtcaagttaggcagttggctgtgtgagtttgaagttcaggggagtgggctggactggaaatgtgaatttgatagttactagcataactgcttagagccgtaagactgaatgagaccaccaatgggataagtggagataaagcagagaaggggtccaagggctgagttgttgaaatccaagaccatcagctataaaatttttgaacttcataagagcaagaattttttctcatggcacggcctgctagatgcttgttcagatttctccccttctttctaagaagatcctgcctggagaggagcaacgacgtggctaatggatgtgaacatgaccaattacgtgtaggcaaaagtcataggatggaattctaggaaagttagaaagtgtggggagcacaggcagctcagctatcatgcttttcttaacctttgtccttgccctccttcctgcttggaatgcagatagaatgctga

SEQ ID NO: 94033 - DNA, 3141 bp, Homo sapiens
gtgtaattaatttcatgtgtattaacactatggtgactagttaatttccctaactgggtttattagaagcagtccagacacaggggctgaaaatgcttggctatgaaagtgttaaagtttgcatggtacacagaggattttctgatttctcagtgtccccaactgtcttcaggaatatgttaagtagttcctgactctgattttccttgcaagattaaactaaacagctgatcaggaacccttagggaatctgcagcagctggacctccccaagaaaagagagagagagaaagaatttccaagcataaaaacaatgcctatggggtctcggagacccgtcctacctctgcccctgatcagtgacttagttccactttgctttgacacagccttagcctggtgtaatattacattacagtaggtttcttgcttttggaattcactgctttagcatcaggtaaaattccacagaatcaattccaattttagcgtactcatttttatgtgtacagtgagatttggagtttaaagaaggtttttattttgttttataagaaaaagcttaatttttaaaacgtcttggtatcagtatggttggactgggggaagggaagaaaggggtgaccagttgttaatacaaatgtaaaggatagctttaacaagtcatcaggataaagccaacagctgtggaggaaaaggaaatggaatgggtggaggggaaaatgaggccttagtaaaaggagatccaagcatagaatgtgttctttgttattagagtcaacactcagtaatcctaggaaagggggccttcaggaggagcatggataaatggagtccacagataatccacagccccgtttaaactgttagttctaactctaactgtctccctcataaaaacctttgtttttaactagaaccataatgattccttggcatgctttatgcctaccttttggacaataatgaacaaagaaatgtatgctggggtgagcaagaaaaaagggctataaagaacttggaaacagaaatctgtatcttcatcattgtttctctagcacccagcagagtgcctggccaggagataatagagttaacaaatgtttgatgaatttaattgaaagaagagaaagaatattagatactacctggtctgggattctgagccatagataatcaagaatccataaatgttgattggataaatatatatgaaataggtgggaattgattttctgagttccaaatttgtgggaagaagtgaggaagaaagaacatttgaatttcatccacatttggccaaaagttgatgtactttctaccatctttaaacaatttaataatccaggcactgggggaaaaaccaaaaaaaaagcttccagtctcttgtttccaaaggtcttactttctcagtgtttgtggtttagctttgtatatttgttaagcaaatatatattctcatcacctcttcacaaagaggaaaataagactgtcttctcgatccttatgtataatgctagtgtgtagcattgtagaaggaagtaaattttcttgaattgtttctactgcatgaatgctgtctccaactgatatgcatgttctctgaaggcaagcgttggtctgcagctccttttataatccccccttaatctttaatattggtctgggcacatagtatgtagtaagtacttattcacaaagttatgttgtatctaggaagtacaatgccttatttacacttactttttttctcttacagattttgataaacctgatttcaagagaagcatagtatgcctggaagatctgcagattgggacagttcttacaggcaaagttgagaatgccactctctttggaatttttgtggatataggagtggggaaatctgggctgattcccatacgaaatgtaacagaagcaaaactttcaaaaacaaagaagagaagaagccttggactgggccccggagaaagagtggaagtccaagtactcaacattgacatcccccgatctaggattactctggacctcattcgggtgttatgagtatcccacgaaggccagacgctgattttattttctcatttccacagattgacaaggataagtcagttgtttgtaaactctaggtagcagatgagaaataattcacttaatatcagaaatattttccaaacactttcctttattttttcttctgaataaatagaaaaccaacagtttgatttccttttcccttaaaggaaacaactaatacacattcttatatggctttatgtagtaatagttttctgactaaaattttgttttttattttttgtaatttatctttaactccttttgcattttgtataacagattgcttaacttctacttgccaacatctgccttgctggacttgtatgggattgtcttcttgatttgaattgtaccgtctttgttgacacagtagggctgggcagtgtttaatccttccattttatagatttttttttaatcaggccttttggacttcattcataattttgcaataatctcttttcccttgtcatgcaagccaaaaatataccagtaaaacagattctgacgtgtttgtagttatcaaatgaatggctcgaaacacttctcaaaaggatatacgtattgaccccaacaataaatgtttgtggctagtgacttgttttttgctatgttgattcagtgaatgacctagaagtcagtcttgatgaaaaaagatatggtttatgcaacctttggagaagagggaagcctttgaaaatttgaagaatggttttgtttgatttagcatagaagagtgtgtcctttcttaaatcagaattaaacttcaaatggggatagaaatggccgttttaaagatcaaatatagatcaggtgtgaagggacaagaaaaacaagtatataaaggaagtgactcttattccatttttatttagtggagatggtaaggattagcatgaccattcaggatcaaaataaagcccacagtggactggtatcctgttcattctgactactgctgctgctgttgatttgcctgatgaagatatttgtatgactgaatgagtgtctggttttctccatgcgtgataagtaggggatagttactaaagacgacca

SEQ ID NO: 94034 - DNA, 1255 bp, Homo sapiens
tatagtgtaaaatatttttggctggacgcagtggcttacgcctgtaatcccagcactttgggaggccaaggcaggcagatcacgaggtcaggagatcgagaccatcctggctaacacagtgaaaccccgtctctactaaaaatacaaaaaattagctgggcgtggtggcgggtgcctgtagtcccagctactcgggaggctgaggcaggagaatggcgtgaacccaggaggcggagcttgtggtgagctgagatcttgtcactgcactccagcctaggtgacagtgcaagactgtctcaacaacaacaaaaaaatgtttttggtgctgactctgagcaggtgcttcatttgataaatagcacaaaaatctttaatccactttctccctctccctcagccttttctttttcaggacagtttacagcacaggacacataatagattctcaataaagactgattgattgacctatgggtctaagatgaatgaattttagggtgatctgtataaggagattgcaaaaggagtaatattgttaagtgttgcgctttttattttttccactgcaggtttttgtcatccattggagggacactgtatgaggttggaaagcctgaaatgcaacaaaaaataaattcattccttgaaaaggaaggaatggagaaaattgcagaaagattgcaaacaacagtacacaccttacaggtcatcatagatggtctcagccagcctgaaagctttgactttcgaacaggtaaacagttgaacttgaattatagcaccttgcatttgcatagctcccattatctcctttgatcctcacagcaatcctatgccataagcagaatggatattattctcccattttatacatgagaaaaataaagcatggtgatcttccttcaaagtcattataattaatatccagagccaaagctagaagccaggtggtctccctggaccccttgttcactgtgtatttcccatttactaaacgaaatgcatcatgcatgtactgctgtatgcatggagacacacatttttttatggtccttttgtaagttgtctttatctcttgggagccagaagtgcaaggtaaagcagtcccttcacaagctaaaaggtgaatcttcttcctaaattatagctttccaagttcttggattctgtgtcaatgaacccattgaacaaataagataatatctctgttgattttccttctaattaaaagtgctctcagctttcagcacaggta

SEQ ID NO: 94035 - DNA, 2396 bp, Homo sapiens
gcaataatagcaacatttcagtacacaacacctttcctatttttatatactcatactcatttagaggtatacgtacagttgtttaaattatatgataattacacagtataaagcgagtggttctgaaatagggaaagttgcataatcactgtggttgtgtatggcattggttattatttcactgatcttagatactttgaggtaactatatgagcactgttcaactatttctgaaaagatgatcatcctaaatcttttagaagatttctatctcgggactttttaaatggcactttaaaaaatttttactcttattcagtaatgctaaattgctaagtaatagaaattttaaaataaaacagctttctaaggatatattctcctacatacaatgaatgcaacatgcaatgagtatccagtttctgtacatgtataacagatctttgaaaaagcaggaaacatttagtaagttcttcagaagtcagaagcaggtaacagtctgatgcttataataccaagtcctttggaagacaaactgcattccttcatctatgacaggaaatctttctcttgtcatttcttttttttttcttctactcatatatgcaggaggtgctccaaatggtaccaagaaataacatttaaaacgcccccacccatgcccagatagctgcatgcattttaaaactatattctctcatcagagtctggaagagctttcagaacaacttcatgactttctgaaggggttacatttttaaaatgtttatcttagtatgttaatttactgtaaaaaaacggtctcagctgtaagttctactggataattctttgccctttctgtggttgattattatgctaagaaatgccatttaaatattattttcactagatatctgttagcttctgtagtacaacaggtagttctgtgggcctctctataaatgaatgatacttgaatttataattacttgtatattttgcaccagcatagattgttaaggattctggcctatttcagtatcttggtttaacaaggaggtaagacatttgaaaatgccaggtgcagtggctcacacctgttatcccagcactttgggaggccaaggtgggtggatctcttgagcccagaagtttgaaaccagcctgggcaacatattgagacctcacctctacaaaacatttttaaaaaataaaaattagctgggcttgtggttccagctacttgggaggccaagggaggaggatcgcttcagcctggaagtccaaggctacagtgagctgtgattgcaccactgctacagcccctgggtgaaacagcaagaccctgtcttaaaaaaagtttgaaaagattcctcagtgatgattaaaatgcagttcacattgctgtccctttgatttgactgctagaacagcccctatggtgaagccagcactccttctgtaagctaatctaaataggtactgtgatattctcagctgtgtaaattcagctcctctgtagatagcataaaggagcagcaggttttcctcgtttgccacacttgaatttatattcaatttttaatattaagagcagtaaatttgaaaatagtaataaattttaaagaaatgtatacatagagtaacatatatatgttatatagagagaaaatatagaaacagtaacagatttttagagtaacaaattactactgaacttgcatttatgtcccacagtttacatagttttttagaaggccagattttcttagagtataagctttctttttaaattattgaatatttaacctgtattacagattaagacctgctctgtctacctgtacctattcatttctaaaatgatgtgttcttgcatttaattttgtgcttgttgcgttactccattaaaactgagtaaagctaatgggtaaaaatagacaagtaggaaagtctcttgaaagtgttgagagtgggtagactattagatgtactttgcccttatagcatggttcttggtggagttgtaaatcatatgttttgcccacaaagcacgtactaatattaagttgtttttaaagtgattgtgttgcatcaccatggttcttctatgctctgtggggtatcatgttgctttaatgtaatgaaccaagtcctcagctcctaaatctccatgctggaaatgatgacataaaactgaatggccatgtctgaagtcatgaatcttgagaatttcttattctttgggaaaagccttacaagacttttcttattctttgaagggaaaagccctgcacttataacaagtttctgttgaaaatattagccattttaggttatatagcattctgtttgaaaaataagcattaactctgctgcaaggtctgtattttaactttgtgcagatgtgtgct

SEQ ID NO: 94036 - DNA, 1032 bp, Homo sapiens
ctaaaatataaaaatgttaagtggacagattgctaaaagttaattttgtttttaaagatacagcagtctctctatgttgcccaggctgtactcaaactcctgggcttaatgaccctactcctcaccctccctagtggctgggactacatgtgtgtgccactgggcccagttttgtgtgttgttgttagtagttaaaacctaagcatcttactctagttcccaagaagtaacattcatattttcaaaagtgcccttacaaatgagaaaagtgaaaaaaattcacccacttgagaattagatgatcaggctatggattgattgtcatatccaatgtcttacacactgttccaaaacacagcccacatgacgtttctggcaaagctggtagaggaaactaggaagatcaagaacctgagacttgacataactttcccctaactcagtctggaggcagtgaaatgtcagactgcctggattcaaatcatggctgtttgaactgggaatgttatttaacctctctatacctcagttttcttgtctgttaaatgtgcgtaataatagtaccatatctcatggggttatattaattaatatatgtagaatacttagcacctggacagagtaagctagtgttaatatgattattattgctgttatttttgttgtgattgaggaggggctaagctaagccataaaagaaatgggggtagttggagggagtgggggagagttacaatggttggtccccaagaaaaaaagttgttttttcatgtgatctggatgtaatttgagacatttaacattgttaatgaatattaatattgggttttgagactggagaaaatgctggtttctctcctgtgtttctggagcaacctattagtacccaatgaaggaggagtgtgagggagttgctggccaatcataaagttgtgcttgcttcagcctcttccatcttcaaaatatttgcctgtccttctcctttttttcttttcatcaagtttagaccactcagtctggagcctgaaactc

SEQ ID NO: 94037 - DNA, 1076 bp, Homo sapiens
ttgagtttaactggctgtccagtccaaactcggctagaagaagggaacacgtgtataaagttgtcaagtagagaacgtctatgggtttatacattgctttaagtaatcagaggggaagacatcatttaagaaaagaattataacaattcacattatcatttttaatattgcaggtctaaagtgaagagcatatggtaaccattgagtgtattagtgttgctaatagaatttaaataaggttaacatggaaaagagctgtttcccaccacgtgagagtagagatttttcactagttaagcctcttgcatgcatctgtcaaacctggcagtaaccaaaagataaattctgagggttcaaggtatggttaccatatttttaccctgattccacaagaaacctgtcaaaatttttatcatactataatcgcatgttatataatcttcttttcccccatggttttagaagagctgcttttttgttcacagttttgcatttattacacaagtctgctaatgcagcatgaaattccctgatctggaccgttttcactgaaacaggtatagcagaaactgtcccttacattttaagttgttgattttctaacacatctacaaacatttcataatttcatatatggaattttataatagagttgagattctctgaaataatcttttgacaccaagcaaactacctaatgatatagtctttgtatataatttatactaaccatgacaattatagataagggcctttctgtagttcagctctatattactgagaacaggctaacacacaaaaaaggtagtacaacacagttgtagctattataacttcttctaactcactttgtatgtatgctgaaaaaaataggcaaaattattactttatccagaaacataaggaatgtgaatagtatagaaaaactaaggaacatttttttcttgcatcagtgttagccttcttaccagcatctttatgacagctgttggttttgtcattatttttttattctgttgtccttctttcctcttgcacaactctttttttctccgttttttttttgtttttttttt

SEQ ID NO: 94038 - DNA, 1232 bp, Homo sapiens
aagtgtatcaataccaggatttgaggatcattgggaaccatcttggaagctgcctagcacaaagtatgaggcaactaaatgcagtatgtcatcctaggttgaattatggattgggaagaaaatgctgtgaagaaaaattgagaaaattgatgatttgagcatgggttgaatgttaggtaatattattacatcagtatgttttctaattttaataattgtattatggatatgtaagtcaatgtttttgttatttggaactatacgctgaagtatttatgtgaaggaagggtaataaagttttagtactattcttgcatgccttctctaaatttgaaattatttcaaagttaaaatttaaaaatgtcaagagagattgttttaaaatgaaaacaatgtgagtctggttcttaagttcatacatactgaatacattatatgtatgtcgtgtatgtcaatccttttaataggctgttggatttagtttattagtattttgttgaggatttttgaactggtattcataggaaatcagttcaaatgtaggtttctttcttcttgaggtatctttggctttggtatcagggtaatgctggcctcatagaataggtaagaagtattggctcctcttctgtttttttaaagagtttgagaaggattggtgttcttcaaatgtttggtagaattcaccaatgaaactgtatggttctgaacttttttttgttgggagagttttgattacttattgactgtacttataggtttgttcagattttatatttcttcttgagtcagttttggcaatgttggtgttcttagtaatttgtccattttttattctcctaccatgtatctggtttaatgtatatggaacaataatgtgtttttgcattgtgtaaacacatctgatttaattttatgtgaagttacatttaaaccatataaaataaatcctccattaaactgccttgccttgcatatctaacctaaaatgcatttatcacttgagcattccatttgcttcacattcacatcaatatttgttattttccattgttttcattttagccctgtggtaggggtgttccaagtgattttgttttttaagtttgaagttttatttcaacactgtcatctacaagaatatcattaccaacaacacatctggggtccgtcatttttattgttttgcacatttataaaaccatgttttaaatcaagcttattttaaagtc

SEQ ID NO: 94039 - DNA, 1067 bp, Homo sapiens
tggaaacagtatgggattttgttcagtattccttccaccaaatagatatgatttttagttttagaaaatagtgttggccaggcgcagtggctcacacctgtaatcccagcactttgggaggctgaggtgggcggatcacctgaggtcgggagttcaagaccagcctgaccaatatggagaaaccacgtctgtactaaaaatacaacattagctgcgcgtggtggcacatgcctgtaatcccagctactcaggaggctgaggcgggagaaccacttgaacctgggaggcggaggttgttgtgagccaagatcgtgccgttgcactccagcctgggcgacagggtgagacaccatctcaataaataaataaataaataaataaataaataaataaataaatacttttaactctttagtactttcctaagcaaaaaattggggaagaatgtaagcaaagtttatatttacagctgacctgacggcagcgtttacagaagtttctattacataaatagctgctagaagagtttttaaaacttctaaattcagtgagttaacttggaccttttttcttgtaggatgttttggtgaaataactggtctactggtttgtttttgttttttttctattatactttaagttctgggatacatgtacagcacatgcaggtttgatacataggtatacacgtgccatagtggttcgctgcacccatcaacccatcatccacattaggtatttctcctaatgctatccctcccctagccttccaccccctgacaggccccagtgtgtgtgatgttcccctccctttgtccatgtgttctcattgttcaactcccatttatgagtgagaacatgtggtgtttggttttctgttcctttgttagtttgctgagaatgatggcttccagcttcatatccctgcaaaggacatgaactcattcttttttatggcagcataatattccatggtgccacattttctttatccagtctatcattgatgggcatttgggttggttccaagtctttgctattgtgaatagtgctgcaataaacatacg

SEQ ID NO: 94040 - DNA, 1187 bp, Homo sapiens
aaaaaaaattgtttgccaaatgttaaggtgcacatatgtaagccaagatccaatgagggctgggacagaaaagctgctaaagatttgtgaggtgaatggagattccaggggttacacagtgtcttgggaacataagaattgaggccatccagaatggggagacctcactgaacaacatgggcactcatttgatacccgagaaggtccatgacttgagtaaggctattgaagccctggaatgttgggttttaaaaattagtttacatttgtcttgtgcagaacaaataagacaatcattgtcccaaggatccttctgtcaagttggcttgataattgataataggttcatgcaaatctgatgcttaaatactgagttagcagtaaaggaatcttcagcgtaccttccatatgctttatcagaggaggaggatttgcaaagagaatgtcttcctgtttatttttttccctcttatgaccactggccatgcttcaatctgtgtttctggatctggaaaaaatccttccagtgctgatgccctttgccatcttaatcccagagccttataggcacaatgaattatttattttacaagtttatgcatctacaaaataaaaatcttctgatgtttgaagtatgtatttttaaaagaatgtgcttatgaaaatatctttttcaaagtcttcttccaatattatttgttctatgtacttgtctgtgatcaggagctagaacacataggtttttaaatagctaactaaagcatttctttagtgctgaacattgtctttaacgggagtatataaagacctcttgtttaccggatttgattaattggaggaggagctttcttaagcacacactgttttctcaaatgtttcccagcctcctgtcagttctgtctgtcatgggtcattcagcacacactcgtttggatgactcttaaaaactgtcacatgtcaatcaaaggaaaggagatgcaaaatgaagaagtaaacttgcttcatttgaaattgaatagactgttcctgtaaagctttttttttcctgggttaagcttaaatttattttttttaatttgacaaataacattgtatatgtttgtcacatacagcatgacgttttgaggtgcacatacattgtgaaatgattaactcttgctaattaacaaatgtattacctcacacag

SEQ ID NO: 94041 - DNA, 1477 bp, Homo sapiens
tctgacttttcttactcaagacacctaatactgaagttttgaggcaaacgtctgttcctagccattgaactttctctagtagcaggtacatcatagaggatttggcaagggaaaacaccctggcctttactttttaaaccatgtttccatttttgttgaactttactggggaaaaattgtagaacttgagcctttaaatttaatgtctgttgagatgaaaacgtttcataggtgagttatcagtagttgaaaagtatatatgactcttagtaatagctattattaaaacaatgatggactctggcatggtttaagtcactgacaacatggtttttctatgctgtctaacattggtttctttaatatgtttctgactttgttccgtggcttgactaacactaattccttttctactttttttttttttttttttttttttttttacctctgggaagatattgcttctgtgcatttcacactatagagagaaacttgcctcattgtgacccctaacctatgtagtaaatcctctaaaattaattttggttccttctgatctgtgcccccatgtgactccccccaagatttcattattagattttgacagccttttaaatttgtaaatgccacaaatttgtcactagagatgaatgggtaaaaagaaaattccttgcagtggaggatatgggtaaaatatttcaagtgacagatctgcatcaataatgttaatgtttatggggtgatgaaaaccatgtaagtcttaagccagaatcttttttcagctgagtcccagaaattttgaccacagaagccaaggcacattccgtttattccaacaagtgttttttcacatcctttccaactgtctgaaagacaattgtcactcttaaatgcctgaaactttagatgctttttctactggattagttaaaagcaatggaaacattgtctactgtggtcgggatgacttttgtcttgccttgagttcctaaaatggagagcaaatttgacaatgttattttgccctctactttttatgttcatcatctggcaaagttttcaagaaattttgcatcattctttctgactgacttctgaaggcttactttcatgccagaaggttgcctttgctgaatgaacgttgagtggtcacagggccagaggctttgtctcttactgataccaaaggagttccccaacttgagtggcttctgatgccagtgcagaagagcattagtatttgagcagttgagaagtacattcagaggaaatttagagaaaaagattattgaaattatcccaattatgatgccaactaacatatgtatgtgattatttttaactaaagaagaaggataaagaactttgaaccagtatagtgtggtcctttgtctatttatttgcatattttgatttttaaataatgaacaaaaaggattcattcaaagcaaagctattttaaacttaccctgaaaag

SEQ ID NO: 94042 - DNA, 3255 bp, Homo sapiens
attatgtattagcaagtctgaaacaatatattttttaacattggttatatgacagtagccattaatattttctgtccctcaattctgaataaacatttgacatgagaaccatctaacagcagtagcatggaaagttttttttaccatcacttaactgtcaagaaaacaaaagggttaacttacttgctggacatttgaccacctgggatagcaggccatcctgtctgattcttacagagcttattttcagtctctcacctcggtcagcagaaaaatttctatcaaggtcatcttaaaacatagaatatattgattgccgttttctaattgtttcattctttcctgtttaatactttttttccccttactttccagaaaggccagtgtggaaaatgaaataagcagaagtctttcagttaaacaagctttcccccactgctttttatattctggggactcagaaaatatgagcaaaccaaatttagcttttcttttgcatttgccaggaggttatttagtaaggtgattttttttttctggttcacagaactctataaaacatatagtgtttattactttatgtatatttatttaagtcactaaggtgaaactgtagtgatggtggcaatgttacagttttaacaagtggggcttattttataaatgtgtctttgtggcaatagctttcaaaaatgcacagggttagcagtgacatgctcttttggaaagaaaatttgctgtttaattccagggtaaaagtactactagaacacaaaatcaccactgttatttttttattttttattttttggttactatttattgttaaagtcaactttaaaaaaatctgtactcgcaggatttaactaactacatacattgcaaagttgtgtcagggagaaaatgtttgcttgttatccctatcagaaggggggtgacagggaagtccccttccctatgcttcagagggtttccctctgagtggccttcagagttaggataatggctttcctctttatcatcatcagacaaaatgaaaagattacacatgtcaagttacgcacatttatgtttttgctctgacctaaatatagattgttgtacagtcaggtttaagggaaagcagtctttcaaaaataatttaggcagcccaggtgatgattattctaaaaactctattcctaaatctactatcacatacctgcaatacgattacatataaatacgtatgataatgctgcatacattcttacacagtttttaaaaaatgcttctgccttctttctgaaatgaactggtttactttattctggttttgaagtggaaaagtaaattcacccttatagaaatttactaatattaatctgcatttaatttcagaatatattctcttaaaaattaaatttaaatgaaaagagtttgtcatgtccttcattaacttttgtgtcaaaatgaatatcttagaaaaacattttatagcaaactaagaagtgtagaggaattgtgtgtgtggtgggtgtacacaaggagattttaagagtgtggagaaaagagatgctaaatttgagctacataatatttacccaaaactggcaaaggaaaactttgttaaaatatataaaaattatggattcaagaaacaaagcttggagaagtaaaattttttacttcttactttctgtgattattctgttgattcaaattagaatagaaacaagattttgtgatagaaatatgaatgtgctttttaaaaatttataatgttaagatataacaatgttcataatttgctgaatgattgtgacacatgaaaaaccgtgctgtttgtgagaagtagacaaacaaatgttcgtgcattgtaagaactctgaggaacttagagcagactatcgcttgagtttggtcaataagactttattttttacctgcaagcagagtgtaagtaatcataattattcctaaattgctccctaaagtgtggtaaaagtggggtttgcaaactgctgatatttgttggacaattagattgatgttttataacatgttactattcaatggagtccttcacagtgccgttgggtggaaaagtaaatttgtacctaaagaaatgtacaactattaatttgtattatattccacactgttctttcaaaacactaaatttaaataagtttacacttctactcacaaagggaataattaaattaaggtgatatatagaaagataaaatggcaatttaccaccacctgagattgacaaaactctcccaggtctttcaaagtgaatcatgctcccagtcattatctcacagtaccacgatcttacacattgacaatggggtaaattggattacatttttgcttttactagaaattcaaataaaatcttaggcaagatagggaataccacattgtaatatcctgcttttatgcttctgttagggctgtacattagtctttggctaatagatcctgctagataacgctttttccttttgtagcaccattcatagtttgaggctgtcttcaatctgacctgtaagaactctgcttcgaaagactgtgtatataagaatgttggaataatttaatactcacattttgataggtttaaaatgaactggagatttatgttaattgcagtggacgaattgccacatttgtcctactaaagttgcttatcagaagaggaaaatgagcagaagaatctttaaaaagaatgttttgtctccaaattattttatatttgtatgttaacccagaactttttctctagtctctctctgtatatattagaggagtaatttctgagttttgtttttcatcagatttgcagtgaagattaaaaacaaaaacagaaagaacctctttgcaataaacatcactaccacatttaagtttgtaatttttataagaaaggaacactagttagaagctatttttttttgagttttaatatttaccaaatttataggaactctcaacatgttttacattttttctctccatgtatgtaaacagaatgaagttaaatttagtgatttcttccctggagtgattaaaagtaatgtaatttgtttgttaataacaaacttaaatttattttgacattattgtattttctgtatactataatgtggaaaaaagtacttaaggaatggagagaaatagactgttctagctaataaaagtgcttaactctggaggggccaccaaggagtctgtcatgattgacaagcattctagtggagtctt

SEQ ID NO: 94043 - DNA, 1048 bp, Homo sapiens
gtgttgcacagggaaagataggcatttaaagttgaattggaaagtacactttaaacttctgttagttattacctacagaattttttgtaagtctatagtgttttacttgttatccttgtgtatctgattcttctgttgtggttcacatctaaattgactcagtattttggaggtgggagtggaagagggtagaatgcttaaaaacaaacacagcagcaacaacagaaacaaactctgtagtttgttgggatgcatgatctggttatcggttggcaataagaaacagctgtttgtttgttgacagcctgcctttcctctcccctaatcaagctgtttctcatcatgtaattaccaactctttagtatttgagacttgtggatttatagttggtcatataatatttgccaaaacgtcatagtttacataaaaaattagtgattcccctgtagtcattctactgaaatatgaatgtgagttgtaataaaatacctgaagagacttctgaaattcatttcagacttaagggaatgtagagggtgttttgtgtgtgttctaaaaaggaagtattggtgtaactcttccctctcttgtagactccactgccaatctgaaaagcattctgttttcaaaaatgtagtaaggcagcactgatgtggataacaggacagattttgttctgatgaagaaggatatggttgcttgtttctgtctttgtcttttttcttaaaacactgttctaattttgaagccaagtgtgaaaggaaataaagttgtcagagggtccaagatgatgtttcagtcttctgggtagctttagtagcagaaaaatagctgaatgtacctcctactctaaagagacttaatttaggccattttgtaaacagactactttcagtctggcttatgctgagtgaagcccattttgaaataaaggtaatcctgtgttttaggaaaacaagccagaaagggtgaggcttctgttgtttcatttagttttacccttcaaaataaaacaaatgttttctaatcacgctcaggtcacagctt

SEQ ID NO: 94044 - DNA, 1056 bp, Homo sapiens
tttatctttgtttgatacagagccctaagggagtttttagtgtactggttatgtgtggatgcatatattggttgtgtgtggatgcatagtttgtagactaaaaatagtagaataagattactccaaaaatgtttaatccttcataaaggtattactgctttgctaaattttgggatataattatatgtggataaccatttggcacactaacaatcttggatgtaatgtttaactttactcatggaaaaaaccatgtaatataataatgttcacattagaaaaaatgttgagaacccaaatataagattgtgctaggtgattatagcaattgagaagagaaataaaatgtggaagcactatggggggccacttatgagaatttcaaaactgtatcctgaatatctgatacttgctatttttcaggaatgttgattaactcattcctttatatatgtgtgttggagtgtgagttgatcatgatctttaagaatagcacaggcaaatgtaattacttgtaagattatgttacattttaaatttaaggggaagacatcatcattattatagggacagtatgcattaaatgcataatcctgcaggaaggcctaaggtataagagttgaagtgggaaataaaccctgcctgcaaagtgattttataatgtggtacagagacaggaagggtggcctcgttgaattatggtatgggttcactcatggcaaagttctccgtccaatctatcttatgctatagacagttgtgttacattgtctttctttctggtgatcatggaaaggaattctaatgataaaagtctgtagtgagggaaaattatattgacaagagagatttccccccccccccccgggttattctcaacaattaaatatcattaccatgtaagaaaagttacttatcctggattcgtgtagaatgaaaattgtttttcagtccacagaaatgcatgtgttgtcgttttgaacaactaaccttaaaaaatctatttttgggtgggatagtaggcaggttagcagccttcttagtgtactttttttt

SEQ ID NO: 94045 - DNA, 1031 bp, Homo sapiens
aaaggatagttgcatctgtactgaacatgtacagactttttttccgtgtcattgttgcctaaaccatacagtttaacaactatttaaatagcctttacaccgtattaggtattataagtaatctagagatgatttaaagtacacaggaggttgtgcagcataggttaaatgcaaatactacaccgttttatatcagggccttgagtacctatggatttgggtatctgcagggagtcctagaaaaaatcccccataccaggggatgactctgtgtgtgtgtgtgtgtgtgtgtgtgtgtgtgtgtgtgtgtgtgtgtgtacaatctcaaccatgacagtttctttttaacagagtattggtactcaattaattgagaatagttatgacaaatgtttaaagatgtcggtaaaaccacttcattatttcataaatagcctttttttcttattttattaggttgtatttggcatacaacttactttttatacttttgtatacatttttagagctttaatgttcagacttcagttacctgaaaatattctgtctcatttacacattctgtgatctggaacactgatccagtctccaattttgtgtctcagtgttttatacctgtgtgaatttcaagcccttgggtttagttgatagtgaatggctggccttgtgaaggcctcgttaacatattcaaaatgtaatctgtctcaaagctgaggtagtgaccagaataaccaatgccacattctttcccttctttgtgatagaatgctttgtgtaattcagtgtatggaggtgacacttacagctctttattaattgaccttttatgagggctgttacttgtttattatatttgccatctaaccaatgatctgaggacgtgaaatgtcttttcaaaaggtaccctagaacatcgtttttctgtgaattggcgagcaaaagtttcttgaaacctaataggataggagagagctatcttgcatacctcatctcttttctgttctcttttgacttggatctttctgtgggag

SEQ ID NO: 94046 - DNA, 1016 bp, Homo sapiens
ttcaatcatatttataatatcttatttcttaaactggttggtgttgcttatactctgtaacttttgttaaatatttcataattttttaacaagatgcaggaaagcttggtcaaatgctacagatgctttaactcgggaactttggctttcagttggttttagtgtcttccctatatattgatgagtgtgtgtgtacatgtgtgttttacaatgagaatttacttataatcagaaaaaggtaagctattttcattgttagtgaaaatttaaatatacatttcatattatatgttacctttcccttcataatattcttagaaatctttctcaagcccctaatgttgcacgaagtcaaatgctttgtaaggcacagttttgacactatcttaaaaaatatcttatctcataaatgcaggtttttcttctgtgaattttaggaattaaataattatttttcccccatggtcattttagacagatgtggcctacgacaaacctgtagactgccaaatttctagtgcttatatacagggcagagttgggtagagcagatgtttaaggaattatggtatcatatgttacagtaatggtactgtcatttaactagcatttatcgtatactattttcttttcgccactacctgcttccctcactcttaaattatttaaatgagaaaccttaagattatgcaggggagtttttaaaaatacctaggctacatctccagagtttgtagtttaattggtctgggggtgggccccacatgccaacaagcttcttaaaattcacatgtaattcaaatgtacaaccagggcggagaatcactagttctgaaaatacagtcagtagactagcagcatcaatatcatctgacaatatgctagaaatgtgcattctttcacttgcttcccagacctgtaggatcagaaattcagggggattggaccctgtagtctgtgttttattggcctgggtttgagaaccactggtctctaatgctcctcaaacttgacta

SEQ ID NO: 94047 - DNA, 1050 bp, Homo sapiens
tcctttctattcccctgtgaggtatttattattatccccactttttaaaatttatttatttatttattttattttattttattttattttttttgagatggggtctcgctgtcacccaggctggagtacagtggtgcgaactcggctcactgcaagctctccctccggggttcatgccattctcttgcctcagcatcccaagtagctgggactacaggcgcctgccaccacgcctggctaatttatttttttgtattttttagtagagacgaggtttcaccatgttaaccaggatggtctcgatctcctgacctcatgatccacccacctcggcctcccaaagtgctgggattacaggcgtgagccaccgcacccagcctatccccacttctaaaataggaaactgaggcttaaaaaggccacatagccagtaaatgtgcacataatatttgtgtacctaatttctatgataaaagggtactttcatttataaaaaaataaaatccagaatttctcaagttgctattgagaaggtatctcccaatagtgtgttggaaaaaatatttagaccatattttctgagaggtaacaatccctcaggcctcccgctgctgaagatactgctgtttcttcttaaccactggcccatgtgtgtaaataattgtcacagtattataggtgagacagaattacaacattccaacaagattctatgaaaatagaagataataaaatggagaatcattctatgattctaattactctaatttcaaagtctagctgtgtcatcagtgtgtgattcattttaagtatctgtgtcttccttctgtgtcttagctcacttctatgtggcaatgaccatgtttaatatatacctagaaactttgagtctttaaaatctggtcctggagtcaaatattcaaagagcttggagtctctactcttggttttccagagtccactttcttttcaattcctatttctcattgggagtctttctttttcctggtgattgatgccaggggtgactttttacgttatgtgagatct

SEQ ID NO: 94048 - DNA, 1632 bp, Homo sapiens
tacaggagaggctatgtgcattctgaatattttgaagttggcatcatgggagagtattcattgtattaatctataaaccatctattgttaccagtgacagagaaagcaactgatttctctgattgaattcattatggatttaagtctgtgtatttcatatgtgaaaaaaacaaacactgcataatcattttatattaatgaaatattagatgctgtcagtatcattgagatatgaagagaacagtttgccctgttatttttttttttctggtaatgcctggtttcattcatttattttctttgaccaggcaggaagttaggaaagtgatattcccctttttctgtcttctcagtatcgtcagtgaagcaggagcatcaatctacagtgtcagccctgaagctaacaaagagatgccagggctggaccctaatttgagaagtgcaggtaagaaactatggaccatcacaaaaacatgtgattttgatattttgggcagcatgtgtggcatgctaaatattctaaatatcaaagaaaatttaaaagttatactacatgcataagaattggcatattagaaagaaagtggttaattggactaataattgaaattatggaaaagaagaggaagaatattgtactttttaaaagaacactactgttctatagtggaaagctaacccacaaagtctttagcaaaattaaatgctagagagttcagtaataaaaataataggccgggtgcggtggctcaaacctgtaatcccagcactttgggaggctgaggcaggtggatcacgaggtcaggagttcaagaccagcctggccaagatggtgaaactccgtctctactaaaaatacaaaaattagttgggcatggtggcaggtgcctgtaatcccagctactcgggaggctgagacagggaattgcttgaacccaggaggcagaggttctagtgagccaagattgtgccactgcactccagcctgggtgacagagcaagactctctcaaataataatactagtaataataatattaataataaaagatcctaagatcttttattattgttacaaaatattattgaagctttttattggcaaaaagtaatacagtaacataaaaatatttgtaatacaaatttatgaaagtacacagactttcagtttattgccaaatatttgtcaaatgaccagtctctcatcttgctaatagagttgtcatttgatcatgttttgcttaaaacagcttgctttgattttagttgtatttgattgctttgatttctataatgtggaagagtcaaaatcttgtgtgtaaagaaattaagatactatgatgcatctaatgaaagcagttggtatcataagcaatatgttagatcaggtcagtgcatttttctgtataataagtgaatatttagaccacttggttagtaatggaccttttatttaattttttccttaaatattctcatcagatttcatcggctgttcttgaaatctatacctggagagatatatatgaaatttttacagtaatctaaagctaaaagcgttcttacgtccaaaagagcttgtagtttccctttagttgtttcatgacataattccctctctaaaatgatcatc

SEQ ID NO: 94049 - DNA, 1023 bp, Homo sapiens
ttggagaaaatgcagtattaccttttaattttgaagctggtctctgaagttatggaacgtatttgactcctgtatgtcctcaagttctgctttagataagtaaacaattcactttaccttttgatcaaagaaaaaggcaaaggaagagagatacgagttcttctagatcttttgtttgagaaagtagctcttccttagaaaaatatgttgcgttggttgtttggcacaaaaatatgagttctcattttattgagagtttgagaaactatttaagggttacctggttgtgctggttaagggctcagacttggaaatcaagcaggttagggtccaaatctaactcagttcctttccagctatatgatcttgggcatactacttatccccaaaatggaacctactccattaaatgagataatgtctgtaaagtgtttttttgctttgtgtataatatgcactcagctgttattgtatcatgatgatggtgatgatgaaaaacaggataagcagccttgcttttcagttgtagtgtttatttttttctatttaaatttaagagagtagatcttggttgcagaaagagaagttgtcacattccccagaataatcttctcaagttgtggtggcttacatttgtcataaaaatttattcaagaattctccaaagatggggatagcaaactaacttttccacattttacttctcaatgttcagttgttacagtggggcagtacgttacatgtcatccattaaatttgcctcatgcaattgaagtaaatactgaggagcagagaaagggagaggttgctaagagtgaattaaaaagtgagccctaacatgtttctggttttgaatattgacacctacatggtcacatggtatagagccacatgtattgtgtatacttagagtagatgatgtttctttgcctgtcatgtcataaaggagaactctaatgtaaaaatttttcataagctgtacaaaatggcaatccccatacaaatgtcagctgtaagacagta

SEQ ID NO: 94050 - DNA, 1010 bp, Homo sapiens
atttttgtactgggcgtagtggctcacgcctgtgatcccagccctttgggaggctgaggcaggtggatcacccgaggttgggagttctgatcagcctgaccaacacggcaaaaccccgtctctattaaaaatacaaaaattagctgggcatgatggtgggcacctataatcctagctactcgggaggctgaggcaggagaatctcttgaacctgggaggcggaggtaatagtgagccgagattgcgccattgcattccagcctgggcgacagagtgagactctgtctcaaaaaaataaattaattaaataaagcagcatttttaactcaatagggtttttgttaaaaaatttgaaagtgaatgcgttgatattgtaggtactttacttgctttttactttataagtgtgtggtttgtttccttaaaataaaaatcctaaaaatagtgcttaaataaaatatcttaaattatcaatttaattatagagaattggcatattaacttttagatctggtaaaatgtaaattcaatgctagcttctgaagtgtactttcttatatctaaagcttgaaatactaatgtattggtttaggtgaaggtctaaactatagcaatttgaagggccttctgagtactgtaataatctataaataattagttgaattacaactgtggcagttaaaatccccccagatgataaattctgctcagtcatctgcttcatggcaaaatacataaaataatcaaattgctaggattttgaggctaatttgtttgtactgctgagaaatttgttttgtgaaatgtaatattaaatcgttagatatatgaattttatataaagttcatttttgctttcttcaaaatatattagagataattggaataatttcccaatagtttattggaaaatttcccatcaaacagaaagtgttttcgtaaatttagtgtacttttggcaagtgtctattcttgaactcttaaataggaatgaaaaagggagggtatta

SEQ ID NO: 94051 - DNA, 1043 bp, Homo sapiens
agatttttgaggatgggcttctgttacgatcatatgtcatacatatgtacacactggtgaccatcaaatctaaaagggccaggcgtaagacctcctgtttaaggtccttgccgcttcctcttcccttttccccctcgagccatctaaatgtcctaagtctagaggactgattagtaataaaggacagaaaaagtgtttacttgataagtgataagtttttgccttctagtaattgatagctacctgtttaaggaaggaaattggtgaaaaaggaaggcttaaaaaactattattattttgcatattattaccttttaatattatggttaaattataattggctgtatgctttgagtaaactatttcctctgtttctcgtatgttgatctttatcttgaatctctggtctgattacatcacagagatgatgatagtctaatttggtgtaatttgggaaagaagctccaatgactctaatctttttgaattgcaaaaaacataaagaatttggatgaaaaaatgccctaaaagtcatttttttgggaaccagactgtgttgaaagtttgtgggtcagatatgaagctacatcctctggcatcactttggaaagctttttctcaagtggctttaagtggcacgtggaaaagggagaatgaaggattggccaacaggcttgtaacttatagggtaatttgtgaagactagtagataatttatgaagactagtagatatgtaaaatccatcttgagcaattagaaggcaatgaggactaatggcttttatgttatcaataagatccatgaattggaacataaatatttgaaaatattttatagtaaaaacttggtagttcttcagtaaagaaagcttcttgcttagggctttatataactcaagactgacttgagttatataaagaaggattcttgttgcaaatttaaactttctttatcttttaactggattctgcctattataacagtttttccatagaattacagaatatatgtcttaggttatagaaatagcattcatataagc

SEQ ID NO: 94052 - DNA, 1598 bp, Homo sapiens
ggaatatataccattgaatttttgccgataacattgtttctcgccacagttaaaattgaaactttgatcactctagtagccacaggtcatttgatgatttttgccaaaccgtaaacttaggcaacttaagtacctgcctcatgtaaacggtcttatatgtgagcatgtttttcctgttatttgtatttctattccttgacataaagttttagaactttttgggggaagttcatgaacactcatagctctttctggtagatgaacatgactcttacttctgtggataaattataaatgtactataaaaattcatctggagtggcaagtgaaaaagatacagtatgatttgctgccaagaacatcttattacatctgcatatttatgctgctaatgaacggatactgctaacaagtcagtttccgaagatacgcagctttggcgaaacaacaaagtgaacaggaaatgtttttcttagaggattttatttgctcatccaaagcaatagaaaaacgttaaatgattggtggtagattttattttcctggagcaccttgtacagcctgcaattcagtcggttattgtgctaagggatgggtgcactgaccttgtcaaaagagggagcaaggatttcgtttgactttggtttgttggttcgcaatactcatggatatctggatctctaaccttggctttttataactataatcctaggcagtcattcactatgaaaacacttgtgcttctctttttttctttgtatttgttcatttgaaaagcctttcaaaaaggagttgcagcctgcatgtgattatagctatcagtagcacttaacctaactgctgagatgaaacttttctttttggaacctgctaattttacatatcaatagaaaaaaaatttcttgtactgttaaaaggcccgactttactaattggtagctactctttggattgagctagaatccttagggacagaatttgatagaataatttttgacattttaatttgacaagaaacaattcagggaaacgattttagtcttgggcctgaagtggagtcttctcttgctgtttgtgatacttagtgtggggaatgcctttgaaacagcactttataaaccctgtgatccatttaatgtgatagttcaagctgcttggctgtttttttcataggagcctcacctaaaatagtctaacacagtggaaagatttttctgtattttagagggtaatgcagtaaattctaatctttgtgagaaaaacatagctttccagaaggacaataaatttaggtgtaaaatgtgtgaattgtatgctcctttatcctttaattgtattatagtctacatctttctaactcaaaaagtactctttgttttaaaaatatcccttcccacacttgaaaatggtagaataagactaattttagttacaggttctttgtgtgtttgtgtgtatatctctatataacagaaaacttacatttttaaataatgaagttaaagctttaaacaagtagagtatatacacacataaacatgcgtgctaatttgtttctgaaaaattatcttagaaatctgtgtttctccaagtatttg

SEQ ID NO: 94053 - DNA, 1104 bp, Homo sapiens
tgaactggaaatttgtgaaaaatcaggttataggaaataatacacttaattgtaagaatttcaaatgtactttttcttagagatgaataaaagtagattttagtaaattctttaattcagacttttcgtaatcatatcccatggctttactgctatttatcaagtatttttatacctattcttatttatttcttactttaaccccgtggttgtaagtgttgttcacagttgataggtgaggaaactgaactgaaaactgataaactaatatgatgaaagagtttggacttaagtccaaatcatctgattctaaatctcaaagtcctagcacaccatgcagcctttccacctctccattgttttaatatggtagctattaccagaaagtttgaattgagagaataaacttgtctttagcatcctttaatttttaccttttatctttggttgaggagacaatagcaaaaacaaacaaacaaaaaaaaactgttttgaacaagaccgaatttacattcagattaatgaattttcatctttttttcagcattaaagaattttcgtaaattatacatgatacggtatttgagtcagaataccctcaaagatctgctctaactcctcattttcttgaagggacctgagggctcaatgatcaagccagccagagtttgttctttataggtcctaaactctgccaaatagtttttattaaggttgtgaaatataacaccttttgaatttttcatcttcttcaacttttatgcactttagaattcagcatgaagagaatttgtctcagtgctaggctgaaacgaagtattttattaactggtcagttgttttttttttttccttaaggggcattctggagaagaggaactttcagcttgtaatctagcccttgttacataactagactactagactacataccatatattctcattataactggacatcttttttgagcctgaaatctcagcagatggcaagaaatagttagggattacgtttgggctaacacagtttcgtatgatgaagaatgtggggaaagatctgtccagctctctggcatgctatcctatggatatgttcttgctggag

SEQ ID NO: 94054 - DNA, 1034 bp, Homo sapiens
aggaatatgtgaattaaataagatatctacgctgtactgaatatagtatatagctcacaatatgggttaagaatatgggttcttgagtaagactgtctgtgcttagatcccagctctgccacctactagttgtataacctttaacaaattacccaacctctctaccttcgtttcttcagctactatatgggataataataggtttgctgtgatagttaaagaaattaatacacatgtaggataacagtgtctgaccatagaaactgcaaatgttaacactcagtagctaataataaatctcctttaattctgaaatggttccacatgtatataggatataatttcttctactctctcttgttcccatgttctcatggaatttgctgttcttgagcttgaaacagtattaatttccaagtgtcttagtcatattgctcagtgttatgttttcttatgaaatacagaaattccttttaaaattaaaaagtgacatccagtgattaaaagactgaataagaatatttgatcaagaatatggtctgttacagctgttcatagtctaagatagacttggagtttttgtttgaaaatgctttgaaaattgttagtgccattaaatttgtaaggtataaggaagttgttagtaattttaaaagtggtttaagtgcaaattggaacactttcaaaagtatttattccagagagactgggatgaaaataggtgtttcctctggaaatcctgactgagcctattcattgagttctgtaatgatagagccagaagaactcagacagtttcagtaccctccccgccgccatcccatatgattctggctgagaaggatccagaagtgtgacacgtttgttttcattctagccatgtattatgtaggcatataagaaaattatttttctgccaaattttagtttaaatgttagctaaatgacttgtgttggaatgcactcagtagcactttaggagttaaacgcagtggtaaagcagtcgtttttttcccttttcatagataagttgt

SEQ ID NO: 94055 - DNA, 1031 bp, Homo sapiens
tgccatataccatatatggttcagcccctgtatttggaagagtgacctctgggctttagagactgatactaggaactgggtagtagaaaaaaggttggaagtgctatacctttctattcatgccacatttcctttcaacctctgtcctgctccccttcacagttaatagcatcttctttcatatataggatgtgtgtctttaataatttgatatgacccatcatagtcatagacaggagacagtgaagcatgatattgcttagaaagttaagatcttattttgtaagcactttaactttcctgaggtggacagttgtggagtcctttgattgacttttgattcatgctgctgctgttgcttttttcttttttaaatattctgaggttttgtgtatcctacgtaatttaggatcagcattgttatagcacatgaattggccttagtgttgtgttgtcattcaaatatattaattacaggctagtccaaagcttgattaataagagtccacctagtcaaggatcgtaagatattacttagtgataagcaacttgagcttgcaaatgagtcatcaggttagcagttaatgggtatatttttgactgattcttctgtttactcaattagtccatttacctgaaattcccactaccttttgaagcatttttctttttcctttcaacataatggttttcctcaatctaggactacataagaagtttggtaggccactcttctaattcctggtttgaatttagatagttccattgtttaaaccatgctgctgccatcattgccattgtcatattctacttcctattttaagttatgtccagcaatatattaggaatatttctggctcagaattcagattttggtatcaccaaaaatttgagggatacagatgcaaagaagcctttgtactgtctttcataaggagaaatgctttgaggaagtctttctattcttgtatgctgtaatttctagcatttaatgatttccttgtcttcaaggttctaggcttaatttgagt

SEQ ID NO: 94056 - DNA, 1061 bp, Homo sapiens
gaattccctggtatttaacactgtctgtcaaatgtttcagctggtttgcatccttttacaagctattgcttgctgcatgaaaagaaatttaaagcagttgttttaagtcttggggagggtggttgtgatggtgctgatggtgctgatggtggtgatggcagcggcatggcaaaagttagccagagaagagagtaaatgagaagttaagaacatgttctttttcagctgtgcccctcccaagattgtttttgtgtttttctttgggttggagagtctttaatacagtgcttatgattaagaggaggaggcactcatcttggttatcagaagattgaagagggtggccaaagaaaagtcatcaaactttagtgaaagaaagaataacaggcagtgtcagtatcttattcagagattgttcaaccagtttaacttccagcctgtttattctttattgagtcatatgagaagaagctgtaaagtgggaaactgagtctgaagaaagaacaaaggaaaaaggactcagagaaggcttgccatatgtattacggaatatttattttcctgtaaacatgttttagaggctgttgtctgttctaggcttaatatatggggtagaacttcttacagctaagttttgaaaccctggttacttctttgtttcataaatattatttggctgtttctcccaacttaagaaaaaaatatttaaaagcattttattttttggattatcaccatgattgtctttggatctattcctatcgtctttactgtagaactttcttaatctgaatagtggaaaatagaaattatggaatgttatagaagatatttacttgccttcaaatatatactttattttcagtttactgatgtaaccttgacctgtagagatctttaaaaatctattgtaataaaaacttttttgtaaatagtatttttaatgtgcgtttttacgtattgaaatgctttaaagtcatatattctcttgacattctgtaatattgttttcacttacctgcttatctttttatttatatacggtgagtatggaaataaat

SEQ ID NO: 94057 - DNA, 1098 bp, Homo sapiens
caaaaaatcagtagacttagctatataacttaagatctatttagctatgtaagttcataatgttatgaagttaatactgttttatatggaggaaaagatgtggttggtgttattaatttctcactagtgcagtattttccgtttcacaagtggaatttgaaatcaggatttttgtatttaaatatcctgtctcctctatatgcagttttctaggaatgataaaaaccataaatcatccttggaacttgggatagcctaaattgttttctggatattaaaactaatatccagattatcatgcctaatgacaagttaaggtgctgtgttatttaaatttctcatttctttctacagtgatggcttgagatgatgtactgtgacattctagaattttgttgccttttctttattgatattcatctccatttcggtgactattatgaacactgggctcttgtttatagtgtttcctttctaggatgtttgtgatataaggtaaattaaaaaataaaactatgttttacagtcaatacaatttatgttcattttgttgaaaggcagaatgtttttaaaaatacatatttaaatagaccatttcagtgaagtatgttgggaaaggagacataaggaatgaataatttggatgtgtgtgtatgtatatgtgtgtgtggttttaaaatactatttggatttgaattcagtttgactgtttttgatcaaaataaaatgttttaccagttttgtaacccatgtgtttttgtgttcgtaagtccaatttaaatatctgcaggagttaccccaccccctcactgtagcccctcttgcagatctttgtttattgacttagattagaaatggcctaaagcccagtgatggtcatttcttgttttaagatttttggttacaaatctgcttttgttgccagatccaataaagattcttgattgtttttgttagttttaagttcttgccaaagatacaatgtattataaccaaaacagatgtcctgtttagacaagtatatttaggctctaacagaacctaaaatgtaaattaaacatgttcagcattaatgtagcaattgatgaactttgggat

SEQ ID NO: 94058 - DNA, 1842 bp, Homo sapiens
catgcagtaagctaagtattgtctcatgaatatttgttttggttacatgtatatatgtgtactgggttgtgatgtgtttcttatggttgatcataaaagtttgaggaacattgctctatgaaattacagttttcagcctttaaaaatgcaaagttaagagagaagattggcccgcaagagtctttactgagaagttagaaagcttttagaaataaaattcagactaccttatacaattgcaaaagatcctctgaagggaagtaaatagaggaatggttctgagaacacattgggatatgtaagctggacaaatgtactcttccagtaaaataatgagccatgatccttaccatattccttggaaaaaagttaaattaatggatagaattttcccaatctcaattaaaattcctcatgtcaaagaaaactttacaaatactttagttattaacacatgataaaactttattataatcttatttcaaggcaaaaggtttttaataggccaattcagagatgcactctttgtaacaaaattttatggaaaagagaacataattccagtagagaaaaacacaaataaaaatgtttgggtgattggtttgctagaacaagtcttctacctattagagtatgtcagaaaattgcttaagtattctatcaagtatgtttttttcccctagaagaaaaaaaagaaaggaacctttcttgtatgaattatgtcattcatacaagaaagtttctttgccaaaccaagtttggaacaatttatcttacatttatgtatttttcttaatttgttggtgtctactagtaactagtatctgatttagctcttatatgtttaattatattatataatatgcaaatattctgttgtgttctcagtagagcacattgacttccaggggctttgcaaccagaaaaagattaggaactaaaagtaaattaatttgtatgtattgactgcatactccctgccaggtgtggattttacaaggacatatacaaagctgaaagaagtgtaagtaaccaagaatgtgtgtaagagggaagttactgatctgttaaaaatagttctggaagaccaaaatttaagaactgaatccctccttttcctgcttccccccatgtatagcataaaagtcttttaatgattatctttgggtaaagagagttagaaaagaaatctcattgcttctagataatatcataatcctaatcagtggataaaagagtagacttgttcaacttctcttttgatttgtgagataggatgatttggggggctgaaaagatgaataagtatcaataaaagaaaactaaaacataattaaaataagatattaagagatcttctgtttcttattttatcttctggcccagatgaaacattttctggagttctgggtggacttgtacctaaaattttgataccactattggtaattgttgagaaattgtggaagcttggagatgaactgatgttattttgttgttccagagggaaaataaaataggttgtatagatgactgagtgtaatcttggacaggtaagattattattaaattataaaggaatggttgatgagcacttaggtaggaagggacagtagaaaaataaccactggacatcaccatgcgtttcttacaaataaaacattttggtcttaacctatttcattttctgttaggaaaattagactggtagaaacatctggacctcagcacagctattgatagtctcttaatacccttatggacaaagtggagatttggttatgtggctcccaaaaagatgttgattagctaatgtgttgatgtctggtttgaggtctctag

SEQ ID NO: 94059 - DNA, 1020 bp, Homo sapiens
tgatgggaagaaagctgacttttttgagatagtgtgacagtaaaatacttctctgctgcctcctataccaaatgcagggcagtgtcttttattccatataagtctgtgttttccttatgcaacagtggacaggttgcttgtatatatgagagaataagagaatcatataatagtatttgtgcattctgtacattttctccagctgatttcaaagcatgccttgaaattcagtttgtcattctgtttctgccttgaagctgcagcacagtagtgattggaaatggaactgcctgcagggaaacagaagcttactttgctgacctgataatgaagaattattttgcaccactggatgttgtttactggtaaggctattacatatatctcttttcttggagaagcatgggaactttaaagttgcttttgtgatgaatcctcccttctctttttaagatgtacatcttctttgccctccagaccacctcttggtgttcatgagaactttgcaggataatgtaaagtgtctgactcttggagaaatttgagacaggaatgattagagcaggacagagtccagaaacctcttacagaagcagcacgttagggctcagtttcattggattttctaggctatacattgtgtgagggttctagttaactattgaataataagtagaatgatgtaccaggctagcagctagtagactgtgaataacttagcctttttctcccaaagctttgaagcctatgaatcattacccttcagaactgagagccaaggtaagtattatgaattaaaaagtatttccagtattctttcctcatttatcccttggtcacaaacttttatttcatataggcatacagataacttgtgaatagctttggattagaaagacccaatttctctagtcttgcccctgcatttgtagtagttctgctttctttcaccattgtttccctacttcctctttggatctcaatagtcatgtcttccttttccaaactatagtagaatat

SEQ ID NO: 94060 - DNA, 1859 bp, Homo sapiens
tattttctattagcctttactattttaattttttaagtttagattttcatttctgaaataattttttctttcatctcgaattcattcccagtttatctcatctaatttctgagattttctaattttgacttatgttattcttttatttatttaacttttactgagtcagggtcttgctcttttacccaggctggagcacagtggcgtgatctcagctcactgcagcctctgcttcctgtgctcaaactatcctcccacctcagcctcccgagtagctgggaccataggcacgcaccaccatgcctgccttttttttttttttttttttgtatttttagtagagacggagtttcgtcatgttgcccaggctggtcttgaaatcctgagctcaagctatgtgcctgccttggccttccaaagtgctgggattaccagcatgagccagaattaacgttactcttattttctgtaatgtttttttttaagaagcttgttctcatacattaggcacatctttctgtaaggacattatattagtcttttaaaaatttttttgcttaaaaaaataatcattctatatagaatttgactatcatgcatttcttttgtttagttttacatacgttagtttgaacttttagtagaagctgggtcaggcaagttgttctcactgtatatctctagaacttgctcttctgttttttccaaatcattaaaaaaaaaaactctgtgtggattgagagatagtttatagtttctggaatctgcttctctgttgctttcctttattttatctgggctttctttttcctttgctgttgctatctttactttgctcagtttgaatgtgattaccaattgtttctcctcagtgtggaatttttgtctttaaaggtatcttttactagttagtttcaagagttcatagggatcagtgttttccaatcctttcagaagtactggatcccctttgtgctgaatctctctcagtttcagctcctgttctcaaactgactgttgagatttccagggaagtagcctttgacatttttgggattctcctgttctcagttccatcatatattccactgtttctttctgcttccttccatgcagatgctgatgcataggtgtcttgtcagtacattgttcccacctgcttttttggagggtgggggtttgtggggatattttatctatgttctagatatagtcgtgactttttgtttttgttatcctagttgtctttttatgctgttcattttacagccagtgggaaatatattttatcagtgttttttttttttgcatctgttcatatatcatgtggcttttgtcctttactatgttgctgtgattaattatattactagaattttttaaaatgtcaagtcacactttccttagattaatggaacttggttatgatactttcttttgggtgtgttgttagatcagttttcagttattgtattgcttataggataattgttctaaaaatgtcacaaacacatctatattcttaagctgttttggtaagatatttctaattatctgttttcataatttaatataaagttgtttataatggtagatatcttttaaacctgtgttcaatctctagttatatcttctttttattcctaatataattcctgtatttgtatcttctatcctttcttttacttgattggtattgctaaaagtatgtttttctcttaagtgatttgtaactacactttgttgatcttttctgttgcatttttttctgttaatttttgcttttaacttcaacattttctatcttctgctttctttgggttattttgctgttcttttcctaacttgtaagttagtct

SEQ ID NO: 94061 - DNA, 1017 bp, Homo sapiens
gggacacaattcagtctgtagcagtggtgtaataattttttggtgactttcttgtatcttaagattttggccattattaataatgctttggagaccctttactgaagaggaaattttttccttgttttatatctgaccatagatagttactaggatttttaaaataaaaactccagatgtcatagtaataattttcagataccacagcctttcctcacagattatgttactttggcttcaataaaggttttccccgcttctgtattccatctcccttctttttgggagcctttttatggccttatttattgttgcatcagttttagtgtgggcttttctgttttgcaggtggagaccacgtagctttgcaaggccagagttaatgaagatcttatataattcactgaatgattcctttaaacgccttatttatcctcttctctgtagagaattcaggtatatatcttgtcttgtttaattttgtgtactgattattgttatatgatactagtaccattacagtgtgtagctaatgtttgttgattgattaaccaatcgaaagaatttagtcagcatcacaaagtgttaaagttaaggcttgatttcaatctgtagatgcattcacatgcatagatcataaaaatagttcttaattatgatatgtttttcaaatcttgaccacttaatgtgtaccccttgaaatcctgcaatactagtcttgcagctggaggcagtttttagaggtaagagagccaaagaaagcataaggaaatcagtagggtacatgatgaatcaattactttgtttttaactccaaatgggagttatttggatgaaaaattatcagcaatgataaatattaggagattattaaaatggcaatgtgaacggactaatagaaggactaagtaatatagatgaaaactgcaaaagaggtgaggtgcagaattgttttcaggacagaagatggaaagaaaagaaatgtagggaggcaaaactcctctctcttgcttctct

SEQ ID NO: 94062 - DNA, 1432 bp, Homo sapiens
acttatccattcaagttatgtgctagattttggagattcccctgtaaattagacagatatactgcttatccatgatgacagcgtagtttaatgagaacaacactgggaaaatcattacgagtatgttgagattatgaaggaaaagtgtagtaagaagaagaaaagtgcttgtaacagagccctgagtagtgtggacttgacagctaggtaggttggagatagaaggagaaggaagagaagtgacatggaatgaagattgagatgttgacacaggttagatcatacatagctttcaggtatgctaaagatttttttcttttaaggatggtgggaagccaataaggattttaaatacaggagtgtgatgatcagattgcattttaagatcactcaggccacagtgtagataattatttggaaggaatcaagagtagatatggcacaagagattatggtagcttagactagggtggtagcaatagggaataagtagatagatttgggcaatatttaggaggtagacaggggcaggacaaggtatctgattaaatggtgggtggattggttagggagaggtgaagtgaagcatgaaatttgtgtggcggctgggcgtggtggctcacgcctgtaatcccagcactttgggagaccaaggtgagaggatcacctgagatcaggagttcaagactttgagaccaacctgaccaacatggcgaaaccctgtctctacacaaaatacaaaaattaaccaggcatggtggtgcatgcgtgtaaccccagctacttgggaggctgaggcaggagaattgcttgaacccaggaggtggaggttgcagtgagccgagattgcgccattgcactccagcctgggtgacaagagtgaaactccatctcaaaaaaaaaaaaaaaaaaaaaaataattgtgtggcttgaacaataaggtagatgatatagttactatcacactataaatatattaagaactatgtaatagggcaaatagtgatttaaatggcagtcttgtcattacataagttaattagcataacaaggaataatttaaagctaatgtattagtattaaaactaatatttaggtccagattcagcaaatgaacaattcctcatttggaattgtatgttactagtacaagataagtatgaagaggatttctaagctttttagatgctgaaatagttgctgtgtttgtgagaacctcagtaatttaagtttctgcatttgctctctaaataaaaacgtatctaaggaaattttttttaaaaaattaagaaaacttctttttagagacattatctcactatgttgctcaggctggtctcaaactcctggatttaaacaatccttctgcctcagccttcaaattagctgggactgcaggcatgcaccaccacacctggcttcagaacttgtc

SEQ ID NO: 94063 - DNA, 1226 bp, Homo sapiens
gaagtagtttttctgtcttattttgtccaccttttatgttgatttaattttattgcaactttggaaaaacattaatgcttttattctgttaaaacctagccttctaatttctgcttgaaaatattttattgggctctgcattttaactagtgtgtgtagcaaatgtggcattctgagttagtgactgaatttaagattatgattgacacaggcttctgggtgtgacagtattcaggcctgggaaagcagagcattttggaaatgtcagttttgaaaaacagcactgctgttttacgaactttttagtttatcatgtacaggccggagtgatgatatgctaggttacaaaaacagcttcccaattcctatagtgctgagacctcatgtcctaaatctgaaccttacttttcagcctttatgtagataaccccagcacagtatcacagaacacagaaatgaatgcaaatgatgaaagacagtgtggtgaaggaaaattactgtggaactctctccaagtactgtgggaatagccgttaatagctgcttagtaaattcttccagctgcatctttttttctttctttttcaaattggtccttagtgtgatcttttctaccacatgaatttgtaactcagtcttcacattctctcatgggactttctgttccttatctttattggtgtgtctttttactgacgtgcaatttcctgtgtcttaactacctatttcctgttcaatgtcaccatctgcagtaattccgctttaacccactactcactttcaatttcagtttctgtcccaagctttattatttctgttaccttattcccttctccaccatgggtcttcctgtgtgtcaggattttttgtaagtttgacgtattacattactaggtatggtgaaaaagagcaaaaaacctccaataatgtattgtgatattatggtatacttatgtaaatcggaattaaataactctcctctatattgttgtactctacttaatttattagagaaaatttcttgtatgaagaacttctgtttactaagctggcacagcctatagcaaatacggaagtctctgctgagctcaaactgaagtttattttgtattcacaatttatttctttatagatagttctgtgcagtattattgaatatattgttttatgtaagcttacttttttttttttttcttagacagtatcttgctctttcacccaggctg

SEQ ID NO: 94064 - DNA, 2139 bp, Homo sapiens
tgacgagaggcaggcacccttgttccaacttttattgtaattaatccatgtagaagtgcagactggtgcagtggctcacgcctgtaatcccaacactttgggaggctgaggggggcagatcacttgaggtcacgagttcgagaccaggctggccaacacagtgaaagcccgtcactactaaaaatacaaaaattagctgggtgtggtggtgtgtgcctgtaatccctgttacttgggaggctgaggcaggagaatcacttgaacccaggaggcagaggttgcagtgagccaagatcgcaccactgcactccaacctggaagacagtgagactccatctcagaaaaagaaaaagaagtggacctgtacccatgttgtttaaaggtcaactgtaaacataattacttcagtaggtaacatagctatcctaacacaaccaaactagatattttctatttattaattatgccataacaaatatcttcctgtcctctttggcttttgtaccttattacttattaaaactttacttacaggaaaatatacatatgatatgcagtgcttgtgtaattcaggtttagtgcaaaaaacgtttcatgcaaatagaatgataaagacaaaagaaatgaaacaaagcagtgcaaatgatctctctcagtgtaagttgatatcagaaagaccttgatttacaagattcattgctataaattagcaaattagaaatgcttaaagagaacttaatgctcatctgtagacaatttaactgtgaagaggaacaactgcatgaaaactcttgttttgtgcttttgagatttgtgaaattcaaatgggtcgttgaaaatgtgaaaaaatgccccataatccaaaatagaaattgcttctaaaggataattttttaaacaaatggagtagtgtcccttgggttttgactctattaatatatatttcccataacatctttagtatttgtaatcacttcataaaggaggtactgttatgattccatttttataggaaactgaggtacagaggagtcaagtaggttgcccagtgtctcacaactggcaaatggtagaaccaggattcgacaaggcagctggctccagagatgcatttttaccactgggcagtatattatgtattatgtctgtattattgcttttggagacttgtttttgttacaaagggaagctagtatactgctgcaatatctttctgtcttaagactgtcaacttaaggttttattttgactggaattaatttactgtgatttagttatagaatttaaaaccaatcgtatactttttgtttttgttttcctttttacccttctcctaaagggctttcaacgcttcaggatattgaaataggagtgcagcatattttagcagatatgattgctaaagacaaagacacgcttgacttcattcggaacttgtgagtatctcttttatggagttttctgctttatggactcatgctgttaagggtcacacggttagtgctaataccaatgttcattaaaaactttgttttcagacttttttttaaagtagcaaaactctttgttcaaacaacagagcccaaatatataaaacagataaaagtaaagttgttttaattgaattctggacagggagcctggaactctgcctactcaccctccttacactgaggcatctcagtggaggggcctgatgagtttaaaaaccattgccttacacaatatatacgaagagagattcatgtcctttagagtggcattgctttttaaacatgttgattgtgatgtatgcttattttatagtatctcgtttctggtgtttaccagtgattggctttacttgagaatgtgtaatatcagatatgaataaaagtactgacctccaaatgatttttagctgttgaggagagcagcttatctatggcatcacagtcccaatttatcagacattaaagatctttgacctagagccttcttgggcttatggattttatgcatcattaaaaaaacacattaattaaaaaccctatttttgtattattttgttctttttctgctgtgtatcagaagacaggtttctgctagaggtttgttcttcctctctctccctccacatatctagctgtttgagctgtg

SEQ ID NO: 94065 - DNA, 3508 bp, Homo sapiens
gactttgcagtccaagcaatgagtttttaagatgagtgaaaccaagcaactaatttagcatatagaaaaatataaagaataagataaagcacataccatcttcatacagtaaagcattttcaaattagttttaattcatctctgaaggaagaggaaaagattgagaaaaggatttctttagcattctcagcatgtcctctaattttgtaacctagttttaacttttgtttttttaaaacataatcatatgttttctgtctttattttctagtctgctccatataaaactggaagcaaagggactaaagcccagagagcaagacagttgggcttagaaggagcagccagggcactgcttgagaaaccaggggagctcagtctgctatcgtacattaggcctgacgttaaaggtactggctttatttacagagatcaactttgtttctttttttttttttttaatttaaaaacgtatgttaaaaaactgttttgttaagtactgattatacaaaagaatattacagcgtatgtagaataattgaaataaatcctgacatacctattgagtagccattcagcttttctcttttgatgaagtgcctgttctagtcttttgcccgtttttctattgtattgttctttttaaaattattattttaaaataatttttgtcatttatatgtgttgcaaatcttttttcccagtttgtaacttgtcttttcactttctttatggcatcccttgataaataggtattagttgagttttattatagttaatcatcttttaagataatagctgtattttctttttaaagaaattccttcatatcccaagtttataaagattctcctatattgtctgttacagcttttatttctgaaaatttgtttacttgcaaaagtcataaatactctttaaaaatgtcaagagttttgacatccaggaagtgtaaagtgaagctccactctcacacttctactgtagaagtaaagtgtatttttctgaaatttccctccaagtgtatcttcctgttttgtgtgtgtgcatgcacaacagagaataagagagggaagaagtaagggagacatatttctaagaaaaactcaagggaaatgacagttgataaatgtcaagatgcattggttttattgtaaaaatgagtcttagagtgacaactttggttaagagtggctttttctcaggaattcgctgttaggattgagtggggaaattgatgttttggtggtctctactctcaaaaaattatttttttaatattaaaaaattatatagttaacatgtgcaacatgatgttttgatatacatatattaatacatagtgaagtgagtattatagtcaaactattctatacatgataatcaagcaaattaacatattcatcatctcacatagttaccttcttttgtgttaagagcacctaaaatctgtcttagcaaattcacagtatacattacgatattattaactgtagcccccgtgttgtatgttagaactctagtctttttcagcctatgtagctacaactttgtaccctttgacctacgtctttccaccccgcccccacctccagtttcttttgtccttctgtggatcccataggctgggacatgtaaatgtctgtagggggcagtctctgataacaaaatccacagtatgtactaatctgtagaaaattatagcatactatagcctgtttttattttacataacccagcaaatgtgaatttgtgatttaaaaaactgagtgggtgtgtctgtaaaatccaaatatctgttcatacccaaacacacttaatcttaatgtttggagaagggcaataatgaaaaagtaaaaaaggattatgtgaatttagagatgggttgaaatgagtaaaattcaagtttgtttaatttttaatgtgtatttatagttagatttccaaatggttgcaacacttaatattttaataatagctaagactatagctaagcattaaggttaaccacagtgggaaactgtctgtgcccagtcatcatatgttttattaaaatggaatgttgaaactttcagaatgttagatgcacaaaggcttatcgactgcttttatttttatttttctccttgtggttgattttctttccttctacttctcactacctttggtaccaaggtctcttgagttctctcatacactgagttcctactgggtaggtttttgataaccatatctctttggattgtcctacatggtgatgctgctggaatatatgacaatggacacttggtgatacttcttataatgtggatagttcagggtctagcacagttacagtagtactgtactagcagacgtgtgaggacttttgtttgctttactccctctttcttttaccctgatcaaaaatgtagaattattattagtaagtctatataagctaggtactgcttttttttttaagtttgataggaatgttttctctttctctttgtctcctcctcctttatgttacacacaatcatgatcatccttaattttacttgtttttcgaaagaagtttcataattcctatcattcctgaaagaaatatttaagaaaccagatagttcagttttttttttccccagtagaagacacttcttgcttgcttgccacagaccagtaagcatttggtctgaatcataaagctatactgtgccacaaatggactatgtcctgggagatccaaaatactactttcgtgtccaagaggaagttctgtcatacataagaagaggtagcttaagtgcggagaaagtgaaaagaaatgttggcctttcggtttttgtttacaggtgtggaggtttgaagattctgtagctgggaagatttcattgtaaggcaaaggatatgattttctggttctgtgtaccatatttcctcctgatttaactgaggtgctaaacttttggaacatctgttatcttggctgtattaaacccacaagatctattccctttgattgggaaaggagctttttcaaaacacagaagactttccttttaaattatttttctccctggttggactgagaaggggaatgtaatttgaaagagtgtcccaaatgattctgataatttctatctcccattgagaaccactgctctagaagtagctcaaggcatttccctagtggcagttttttaaagttgaatgagtatcagagttatctgggacactccgtgaagtacttcatttccacagtctagccattcatagttttaacaagtacctggtatgattttatttttgggtccttggactacactttacaacatttctctagcgctctagcacaattttaattagattcattaattacataaagtttcaaattatattcccctcttatgatgggggattttcaaaggccctttcttattgcaaagtctataatttcttctgtcctctgcttccattaatggttctccctgtaggttccatctttactattgagttatcaccc

SEQ ID NO: 94066 - DNA, 2113 bp, Homo sapiens
ggccaaatctggaaaaatttgaacattaagataaatgatagcaatggattgtagcactaagtaaaataaaaaaccattaaatctatagtgatataaataaatcagtgaataaattcaaagtttaatgaggaatgggataattatatagtctcaaagtacctctccacaaaatacttataattacaagaggaataaagagtacctgtgtcttggagaaacccacagatactaccttaatcaaatgatcaaagttaattagtaatgagacaaatcaaaatcatttgtcacctaataacgtgtagtaagaacacagtatgacttctatgatatttctgccaaagatgctccatcggtatttaattgtgaggaaacatcagagaaacccaagctgcaggacattctacaaaataactgtccagtagcgttcaaaaacatcaaggccttatcaaggagaagaaaatcaaggagagactaaaatattgttttagcttgaaggagactgtagttgcatgccaactacatgtaacccataattcttaactgaatccactataaaggatattattgggacagttggtaaaacctgaatgagctctgcattagatggtagtaatatattagtgttaattacctgataatgatggttattttgtggttatgtagaagatttgtatttgtaggaaatcacactaaagtgttggagtgcagggatgttaacttattctcaaacagttcagagacaataaagttccttttactttacctgcaacttttctgtaagtttgaggtagctttgaaaagaaagttttgacatacagttttggtatattacaaaagtttctcttttcagggctgttgcaaagaaagttcatagtacaatccagaaaattaagaaggaagggaagatgtctgagtgcttgttaaaagccatgctgaattgtaaaacttttgaagaactagaacacgtggtaaggaatcctttttatcttttaatgtaatacctgaatatattgcaatttgggtcttcttatgattaaagaacaccaagaaataaaaagctaacgtcattagccaccattatttaatgcaacaaaatatttattctttattcaataaatatttatagagtgttttttttgtgctaggcacttgggtttacaaagatgaataaatacatagtctttgtctcaaggaatttccagtcaagtagggaaggacagtagattatacaaacgtgaagcttatcagagagggctgaactagagatccagatgtggatgtcttcagcctgtagttggtacgtgaaaccatgagaatggaagaactcaagaagtgtttgttagcaggtcaggattgaccactggaggttaccaccttttgaagtgtggatggaggatgtgagagcataaggaggtaggaaaaaaatagagaagtatgaggagaatcaggagatgatggtgccctggaacagcagggaagagagttttagatggaggtcatgatcagcagttatgtgtagcagagaagtttggcagaatgaagactgaaaaaaatatatatatttggtaattaggagatcatcatggatttttgtgatatcatttcctgcaaggtatgtgagaagagaagccagatgatggtgggttggagagtgagtggattaagaagtagaagaattggctgggcgcggtggctcaagcctgtaatcccagcactttgggaggccgaggtgggctgatcacgatgtcaggagttcaagaccagcctggccaagatggtgaaaccccgtctctactaaaaatacaaaaattagctgggcgtggtggcgggtgcctgtaatcccagctactcaggtggctgaggcggagaattgcttgaacccgggagtaggaggttgcagtgagctgagatcgtgccactgcactccagcctgggctacagggcaagactccatctcaaaaaaaaaaaaaaaaaaaaaaaaaaagaagtagaagaattgaccggccaggtgcggtggctcacgcctgtaatcccagcactttgggaggccgaggcgggcagatcacgagaccaagagatcaagatcaccctggccaacatggtgaaaccctgt

SEQ ID NO: 94067 - DNA, 1221 bp, Homo sapiens
aaattattataaataatattttctagaggcatgtatatgttatgataaatttccagtagtagaattgctgctgggccaaagtttgtttatgcattgtaaattttcatagatattgccaaattgctcactagcaatgactaaaaatggctttcctttgctctcatgctgacaaagtgagttaccaactccttgctttgctaccaatatgagagatgaaaagtatatcattgcatcattaaaaagtgccctcattgaacactggaatttgaatgatacagtggtttggattagattttattgaatttgtgaaatggctattttaccattatgattgtcaatggatacatgtattttatatggctttcttttttttaaaaaactatagcaagtagtttctaagtcactggagaacattatttgatactatgttttaaattatacatgatatagatgtttaattttcagcattttaaatcactaagtatctttaatttgcaggttttatctgagagaactaatattgaaccttgggtttgtgccaacatcattcgtctctttaatgatgataacacaattcccttcattatacgttatagaaaagagctcattaataaccttgatgctgattccttgagagaagttcagcaaaccctagaagagctacggtaagaaacctaaaaaagaataagcctagtgtaaggggaaaaggccaatgaggaacagtgagaaagtgaatgacggtatatttgacaatttcaacattttgtttccttgaattattgtaatctggatatagtcctctttatttagcgagtgtatggagtccctctgctggtgtgtttatgcatagcttgagcatgtattagcaaaaaggtcatttgcagtaaaagtgtgtgcctcagagtttgactgtcatcttctttcatagaaaaggttgggcataatggcaaaattaggactgccagcaggaaactcagaaagtacattttattctaactcttttaaccactcacataaatctgtccttttaatttcataaagttcctaagtggagagttctttggcagtatagagtttggtaggaaatatgtatatttccttttcccatcttttttttttttcggagacagagtcttgctctgtcgcctgggctgaagtgcagtggtgcaatctcagctcactacaatctctgtatcccaggctcaggcgactctcctgcct

SEQ ID NO: 94068 - DNA, 1050 bp, Homo sapiens
ggcatataaattgaatttttgaagaggttatatagcttgtggaattttgggcagtttactttttcggccctcagtttttgcatttataaaatgggaacaataaagtacctttctcatatagtttaaatgagtttatattgactgtgtaagagtgtttggaacgtaatagactctatagaggaattagcctaaaacaacagtcaaaataagtacctctgtcttagaagtacaaaaaattctcgagagtgccttttttcccctttactctcattcctatctgccagttaatttttaaaaaatataaaagtaataaatgtgaatcgcttataagtgaaaactatggtagttctttgccctaccccttcccaactctaagacttgttctctgtttttagctcttttagttgtttctttgttgtttgcctaatttttctcaaacacacgttattaaacccccaccccagagtttctgattgagtggcttttgggtgggacccaagaatttgcatttttaacaagttctcagatgatgcttatgctgctggtttggggaccacacattgtaaaccactgctgtagttcatagatctcatcaactcttgaaaagggggttgactcaacaggtgagaccaaacaatgagtggatccattgttgaatggctttgttaccagtggaaggtatccaagttactgatgtcaaatctgtaagggtctgcagcaacctcagtttttgcctcctcctccaaagaattcgactgaggggcataaagcaagagagaccaaggcaaacttcagagtaggagtggaagtttgtttaaaaggctttagaacaggaaagaaaggaaaggaaagtatgctcggaagagacccaagcaggcactgaggtcaagtgtggtgtttaactttgatcctaggactttataggccagcccctttcccgtgattcttcccttagagtgggctgcccgcatgtgcagtgccctccttatgcttgggaggtgagtacatggtgtgtgtttaggaagttgtacatagcccatctgaggcttt

SEQ ID NO: 94069 - DNA, 1030 bp, Homo sapiens
cctagtgttgcccttttatagccacacccacctccccccatcatctctgacccttgccaacctctaatctcttcaggaatgttatataaatgtattcatatagtatgtaactttgagattggctttttttcccactcaacataatttacttgagattcttccaagttattgtgtgtatcaataatttgttcacttttatttgtgagtaatagtcccaggaaattgctttttatcttctaattctcatatgttctctttgtggtttgatagaatagctctgtggctattgctgatactgctttagaagacagaaaaaataaattggatactgtacagactctgaaaacagccaagacaaaacagaaatgtgcagcgcagccacatacagttcgaaggactaaaaagctgaaagttgaagaagaaaccagcaaagccagcaacttagagggtgagagtaatagttcagagacaccatccacaagcactgtgtggggaggtacatgcaagaaggaagagaatgacgatgactttacatttggtcagtccgctttaaagaaaatcaagactgagacatatcctcaggggcagcctgtcaagtttccagcaaatgccaatagtactaaagaggaggtggaaatgaattgggacatggtacaggtatgtgcagcctttttctgtcactttagttgttttgagtgctttctttttgactagcataggggttgtactgtctaagggaagggctgggggttttcaattctctcttcagttttgccagtgatttctggaggctttcctacttgtaactttcttgggtacactgttttgtgttgtagctaatcatcagttcttcagctaagatgtgtggcctctcttggcctttgctatggtgttttagtgaacataaactatatagacagattgtaccaactggttgggcccccacaggttcattgttaagtttttgctttgaacttggactgtattttcctataaaagcagtgtaggtgattaggtcactggctgttca

SEQ ID NO: 94070 - DNA, 1073 bp, Homo sapiens
ctttcattgatttgaataacttaatacaatttaaatgaatttgattagtagttgggaacttatttaagtgcttttcactgttaaaattgaaaagctcacattgactatagtttgacatgacccagtaaattacttaaggtaataaatgattttctatgtcttgaatgaatgtgtgtatgtgtttgtcagttaggtgagaagagaatggagagacagagctgtgatttacagcatactgcggtatttttatactggtccgtcatcaactctgttggttcaattcttagcaataactgttcacagcctgtactcaatcactccattttatattaaacacctcctactttatcattttttcaagaatcttgcatctcttttttacctttgacatttgcttttatttttcctggagattattctgttgatttacttctagatcatctgcctctgaagaagatgacaaggaagatagtgcctgggagccccaaaagaaagttcccagaagccgtaaacagccccctcccaaggaatccaaaccaaagaggatgcctcgggtgaagaagaatgccccacagatcagtgatggctcagaagtcgttgttgttaaggaggagctggtaggtgctacagctggatagagggaactctgtagtgtcttcctgattggtgatgttattttcttattctacagagtaggacaaggcatgtaaatgacaaaaactgccagcaatggcatcccctaccctgggtcttaatttttgggtctgtactgtgtttctttgtctattcccttttccctctcctaggagttggtctgggtgtggtagtgctggtaatgatggtggcattagcaaatagttgagtgcttaccattagccaggcaatgtgctcaacatttcatttaaatgatcttaatctttataacaaccattgaggcaagtgcttttatgctgattttatagatgagaaagctgaagaaagatgttaagtgacttgctcacggtgtacagatagtaagtgatggaactgggtttctaagttaggaacatgattttgtcaacattttgggaaca

SEQ ID NO: 94071 - DNA, 1004 bp, Homo sapiens
cagtagctgggatttcaggtgcccacgaccacacctggctaatttttctatttttagtagagactgagtttcaccatgttggccaggctggtctcgaactcctgacttcaggtgatccgccctccttggcctcccaaagtgctgggattacaggcatgagccatggtgcccagccagctactcttttaattggcagctacatagcagaggaaactgatgtttgggcttgtgaataaacatcattgtttttgtttttttcctatgaaatgttagttttgaatgacccattacttgtagccaaataaagtgataagaatattcaagtgttgctgattttattttctgtttcttctagatgtcatcattgccaagaagagcgaaagtacaggtccaggatgtggtactgaaagatgaattttcttcattctctgagttgtaagcatactggtttaatatgtgggtaggggaatgatgaatattttaataaggagtaatgcattctgtcactttctaactccttaagtgatgtgggtagaaaaaactttttttattcattcatgcaacaagtatttgttgaactcatgctgtgttccaggttctgtctagtgttgctaataaagtatcgaaaggagagagaaagtaaccaactaaatatgtaacataatacttacactagaatataagctccatgagagcatagagttttatatattgctttagagcaggatttttcaacctctgcactactgacattgtgtgcaagacaattctttgttgtgggggctatcttttttcttgtaggatttttagcagcatccttggcctctacccactggatgccaatagcttcctgctaagttataacaattaaaaatgtctctagacattgctagatatccccagttgagaatctctgctttagagtcatattaggtgctctgaagatatttgttaagtaaatgactggtaatatttatagtaataagtactataaagaaaaataa

SEQ ID NO: 94072 - DNA, 1050 bp, Homo sapiens
ttttttaaaaggatttctgaaacctccattgtcatttaaacacagtggggtgggaagggactactaagggggtaaggaggtagggaagggctggcaattgtccatacctccttcgtgtgcgcctataccctgaattatttccccagcagccaagggtccctggatctccctttcccctactcccataataccatgtaatccaatattgctctcattggtccatagctggttgtttaacaactacccaaaggattcattcttggcccagtgctatcacagacaacctcttggcattgggtccctagagttaaggacctgagttagccttcaacttcatggacagtcaagcgttgtttgaactgtttcttcttcttagtgtctttgaccagcagcagatttagtgaatatttgagaccctgaattccctggctcctcaatggaccgctctccctggattcagtgagttctaactggaaggcatctccaccactcactagttgtgtgactttgagcatgtgacttaggctttttaagcccgtttcttcatctgtaaaatggaaatgtcgtaggtcttgactttcagagttgctatgagaattaaataaggaactataaagcttgtagcaagtggtctggctataatacatttcagcaattttattaatatttgaagagtcatttgtgtgttcatagttttagaatcttaaatcagaacatatggtccagtgaaatatatttttctccttgatttgtgaatgtatttatatgaaaagtcttacatactctaaaaataaatttgacttagttatacttaacaaattgccctttggaagataatagaattacttgaaatgagattgttctggaaagtctagaagctgcggtcattgtagacaaaggttaattatttattgaagaggtatgggtaattggaaatgaggatatttgggagctggtgttttggttttactgtgccaatgtcatctagtttcatggatttaaatacactttcagtgctgttgacactaaattcctaattccagctcatgc

SEQ ID NO: 94073 - DNA, 1047 bp, Homo sapiens
gcccggctaattttttgtatttttagtagagacggggtttcaccttgttagccaggatggtctcgatctcctgacctcatgatccacccgcctcggcctcccaaagcagtgaaggttttttaagcagagaaataacctgatcagattcaaattgtatcaccctgtgggatggactagacatggattagaacattaggaaactgctttaggtatttagcctggtaaagatactctggcttgtggtcgggtgttatttgctgggtgggctctggcttaaaaggcaattgctttagatcgttgtggaaaattctgtttcagagacacaaccgcttcagatgggcagtgaaaaagacgatggaaaggccaggacaccacggaagttctgaaggggtagtgggaaccggtaggagcatatcagtagctttccctgcccttttgtctgccactgtgatgtaaatatcaacttgattttacatggagctgaggaaccttttagaacccaatcgaagaagttggtggttctacaccgagccagggggaaaactttgtggtcacatgggaatttatacttacttggtttctctgcctttctcaccaatttctttttggtttcttgagagctggttgtgtgcatatgtgaatacatattgcatgttgaaattttgggttttcttttttaaacctttaatgttctacccatttcaaatgcattcaggatgtatgatgctgtttttatataatgtaaactattcttacaatgtcttttatttaattaaaagaatcaaagaaaccaaagttaagaatttaaattttattttggcatttgttactggttgtgatatataattttggtaacattagtgagggatcaggtttaaaaaatttctccaatgttgtcttctgcagattgcaattgtcttgcaactgctgttggcaaactaaaaatgcttttgctggttaaggtaaccagtcatttccgaactttttttcagttgtaagggcatagaatgaacgtgcacgcctgatttagtgtattaaaactaatat

SEQ ID NO: 94074 - DNA, 1034 bp, Homo sapiens
tcactttattccacatcaattcacaaatttttatagcatatatactctgtgaaaggtgatactgggctaaagaaaataattctgccctcagtttgcaatctaacagggaaaataaagtccatatatattaaaatctaagtctgtttataataagtgccaagtagacaatatggacaggaagtactgtggatctaaggaggtcaagctcatgggtgtacaggttgtaatagttatgaagccttttcagtagcagtagaacttgaatgatggggtggatcgggataatgcacagagtgggtgcatgtggaacacttacaagaagaggggatatggggagctgatgtccaccaagaacagggagcctgtagtctgcgggtgtatgtggggccctgctgtagtggtgttgattgacctctgtaggcactttgccttccttcttctgtgttccctccagctagggtagagaggactggttcagcttggctcttccgggcctgcccaaaggaccatgcaacatgaaggtgaagtccttgtagagcaaagggcatgagaagtctctcttctaaacctaggctctgccctgtctccataattttatttcatgatgttagatctgggaagagatttagcacatttctgtattagtagagcatttgagggagatgataactattaaacaagagaggtaaagagaaacattcagagatgaacaggtttattgggataaagagtgagggtacagatttgaggctaccattcacagaccagggctagctattctagaaacaatagatgtcattagacaaataatgacatgatggtttgatattggtgttctaaacctccagaggttaataactttgttggatttcagtggtggacaccagcaatcttaggaggtctagcagcaagactggttcttgccaagttaggagatgttagtttgttagtgctgattggatggaataagcatacaaccgctctgtgtgcccccttctttcccctctgcagggtgtgagaatggaaaaagagaa

SEQ ID NO: 94075 - DNA, 1063 bp, Homo sapiens
cctggtgggaagtaattgtgattgagtgtctagggcaatgtagttatcctaaattttaaccaggtgattttaaaatcaccatttggaaaatggtcccattatatctatttgtaaactgagtcatgaaaaagttgtcagagtacccaggtaggcgtttatgatgcacctaagtacaggccagccaaaattgttttggttttggtgcttccacctgtgattaatgtcccacttgactccttgagctgtttcatctgaaattatattcctgaaattcatctggctctgctgattatctctacctgggcctgtggatgagatcagagagaccagagctggggctatttcttggtaatgcaactgccattccccatgcgtggacacaaatagacaatgcctgtgggaatccaaaccccaaggactgtgagaggcatgcatgccctgtattaaagcagcagcctggcttggtgctcactaagtgcatggtcagcagtcactactcctgtgacatgtattgtctgagtcactcatttggcacttattacatcctgtcttgggttattagtaacctttgcatgcatttgtttctcctccccagccacaccgccccagtggtgcagactcagggttctcctcgccattcaaattcttcaccagtgctctttatgggcagtaaacttggtttttattttaattatgaaatggtagtgtttaagcttattaaaatataagtgttgtttatccaaacaatcataaatgaacttattaaattttttacaaacagctttactgagacatctctgacatacaaactgcccatatttaaagtgtagaatttgataagtttgaacttcataatatgatttcttattctttttttcagataacatgatttctaactcattttttacagataacatgatttcttactcattttctttttcaaaatgatgtttgatgagcaccgattttacagagggtgcctgtctgagagtacgaggtaggaacttttgaaataacacactggtggtaagggggtagtttggttcccagataactttgagat

SEQ ID NO: 94076 - DNA, 1044 bp, Homo sapiens
tattatatagtagaacccttcttttttttcccccaaaataaagctctaggggtaccccagcatataaagtgaatctaagaagagcttctgctattgcaagcaggacacgaaccacctctcttttccatttctttccttcactgttcctcagacataccctacaaggagccatttgaacaccttactctgggagtagaagggctaaaagctctgctagaactgaagtttgaaaagagtcattccacagaaagacttctgggcttagtgttccggagatcagctgctaaggccatagctaacagcctcggcagataacagcctttcctattatcaagttttcttgagaaagccttttttccccccccgtcaggaagtcagtccttattcctaactaaaagttgtaaaatttagctgtccttagtaaaggtggaacacatggtcctcagcttctgttttatttattttttttttttgtatttctgatggctgttgttatgtcactcctacctgagttagaggccacagtgctgtttgctttcctcctatattttattctctagcccttaaaggaataatcaaaactccttgggctgggtgtggtggctcacatctgtattcctagcactttgggagcctgaggcaggaggatcacttgaggccaggagttcaagatcagactggtcaacatagtaagacccccatctctaaaaataatttgaaaaatgtagccagacatggtggcatgtacttgtagtcccagctactcgggaggccaaagtgggaggattgtttgaacccctaagtttgaggctgcagtgagctgtgatcacaacactgcactctagcctgggtgacagagtgagaccttgtctctaaaaaaaaaagaataaagaaaagaaaagaaaaaaaaaggaagctcattgacggtagaggcaccttttttttggagtctccagagaaccttgcacttgaaggacaaacatgggctctctgcatggaactgattcttctttggattttcctttattgtcctaaatagacatc

SEQ ID NO: 94077 - DNA, 1052 bp, Homo sapiens
ttgccaactgctgtatagtgtgatcttaagtaattctcagcccctttcctttgtccctcccatcttaccatctatcaggaggggagcctgaatggtcccctcttccttgcaggggagctgtggggcacagatgagataaagcaggtggagtacttcaagaagtttaaaacttacaaatgccagagacttactatcatcactatcatttggacatggaataattcactttcaattccttattcagtatcacttttgtgggcatgtcttttaccaccatatttcatgcatacatgtgcccagttctgtggagctcggttccgagcagcgctaggggcctgaactattgttgccctcttaggacacaattttatgtggggagaagcagcaggctttatttcacctgcttgaaactctagttgcggagaaatttggctcagactttccaaaataaactcacctttgggctgaatccaggagtggaaaattttagctgaaaaggatggcttgtcagaaaacataggagtgactgccagttgggggtatatgtactccagaggaggcggggtgtaaacccagctgtaccattccctgcaccgcatgctccaaccagaccaacccagccctccgtgagtagaggttacaggcttattggaaggagggaggcatgacaaatcttaaggattgtctgtttttttccactgtcagataaacctccacgctttggcttctagagtgatgggtgggcttgctttccttttgtggacttgatggcatttgactgtataattattcttctcagctgaatatccctgagtgtcctttgacatgatggtggtataggtagctttaccaggcataatttctataatccatagagtgtcaagaaggtacttattttcctatcaaatgctgctgacctgattaagccttctgcctggctttgtagctgaagataatgagtttgtccagtgcagtggctgttgggacctggggtctttctgaagatgattgtaacctgggtgtggagtggggccttttgtcagttgctttaa

SEQ ID NO: 94078 - DNA, 1033 bp, Homo sapiens
gcagacgttgcagtgagctgagatcacaccattgcactccagcctgggtgacagaatgagactgtctcaaaacaacaaaaacaaaaagataagttaacagtgtatttgttctctgtttgctaactgtggaaaatagaatatgggaggccacttctgccctcctgggactttcagtccacatggtttacacgtggttattcttcccctagagattcttgtagaaaatgccgtgactcctccctgttaaaatatgcaagggaggaggagaggcccctatgagccagcatccagttcacatgtgtttccaaggtagtcattagagggtgcctgtaataagcctcaggaggcttccagggcctgaggttgaagtgttaattttcaacacagatgtgcttctaggctcctggacattaggttaagtgtgtcctgcttggagctgatctgggacggtgttgcccttttttctaacctgtttgccctgctaatagtcacgatttaccgttccttctgcccagtgtggattctctgctactcaggacagctcactggtttaacattccaatacatgttcttttgttttgttttgttttttgagacggagtttcactcttttgcccaggctggagtgcagtggcgcgatctcggctcactgcaacctccgccttccggtttcaagcgattctcctgcctcagcgtcctgaatagctgggattatgggcgcccaccaccacacccagctaatttttgtatttttagtagagatagggtttcaccatgttgtccaggcttgtctcaaactcctgacctcgtgatctgcctgcctcggcctcccaaagtgctgggattacaaaggtgagccactgcaaccagcccaatacatgttcttttaatttgttcattctgtgatgacatagtctgttcttacattctttgaggagaccctgctttcagctctcattttgagcagctagcagtctagaacctccacttttcacttcctggcttcagactctgggcagtgtgctggcatctt

SEQ ID NO: 94079 - DNA, 1017 bp, Homo sapiens
gctaggtttacagacatgaaccagtgtacctggccaattcctggagctttttactgctacagactgccatgtgattcaaattaggctttcagaatgacctcctactccacagaactccattttcactgtcagccacagtcctagaaattccacccttagaaagtctttcctgtaagttaaaccttgttatgagtagttaaaatacagatgtcctagagaagggccataccatcttatcagtcatgtgaacctcagtataaatgaaatttatgagagcttttttttggaacagactgtcattggagagggaggaaagaatatgggggccctggacatcctagggcaggcaaagggctccatgtcgggaggctagggacagacatgtctcagggactcaggtttttctataggtgagccctgaatgccattttaagtacattctacccaggttgttagtgttaaaatatttggatatgttgaggttcttcatatgttagtatcaactcacagggcagatttatgtttcagagtacctatcatataaccaggagcttactaaataatgaaatacagtattattggtcattacctgtattaaataggtttattcatccattgatatccacctttttgaaaaaaggtttgaagtcagtctataatatatattatatgttttacttatagcttactttgggcagtagtagtagtggtaacaataatcattataatatcttagatgctgcttcctccaggaagtcttcccggatcctccaaatccagctacacatagctttctatgtgcatctgtagtgtgttgcctgcaccttcctcagccagcacctaacacactatttggtattttcctatttgtttatctgtctctttcactatctttctcaaataagattcctcatctgaccacagaacaacaacaacaacaaaaaaccgacatgagtgaactgttttctgagttctcctaaagatggtacatgattggtaattttagataaacaggag

SEQ ID NO: 94080 - DNA, 1102 bp, Homo sapiens
tgcaggctatcaggacttcaaaaacagagagggaacaggatttttttttttttttctcagactgagtcttgctgtgtagcccaggctggagtacagtggtgtgatcttggctcactgcaacctctgcctcttgggttcaagcaattctcctgcctcagcctcctaagtagctggaattataggcatgcaccaccatgcccagctaatttttgtatttttagtagagacggggtttcaccatattgaccaggctggtctagaactcccggcttcaagtgatctgctcacctcagcttctcaaagtgcttggattacaagcgtgagctgagtccctgacctgggaacaggattttaatgggttcttgaaccatcttccctgatccaccatgggtatgtgctcagaaaagccaatctatttaatattaggcagagcaaaacctatttaggaagaataaatgctataagcaaattctgtagtgcagcccatagctgagagatgtgatcttcagctcatacgttattctagctcctgggcctcagtttacttgggaattgaaagagcatcattggcatgtggtttgcagctcatgggtgcagttctgctacaggacacagcccaatctcttggatggatgaatgtctgacataaactaagagaagttattgtaagagggcttcaccagcctcaaagagaattcacagtactaaatatgaaatgacaatcatacaatgtggattgcatgattttaatgttatagcacacataatgaaaattagtgataagcatgttatgaacagtgtctcatttaatttttgaaagaatgctatgaagtgtaggtactatgattagtgaggcaaagtgaattctccagagtttcacagctggtagatgatggaaccagaattgaacatgagtctgcttggtttctaaagtctttgctctcaaatgctgcactaaaccccctgttcattacagctgctacaggaagacaggacataggttgataaactaaagtataaatgccacttatcctggctcacacataacattcttccagaggtatttagaggagtcaagaactgcataaaaggataaggcctt

SEQ ID NO: 94081 - DNA, 1009 bp, Homo sapiens
atcagagtccattgacaatattgatgttagaagaaagttctgatagattatgatctttttaaaacctagaattctatatccagctaaactatcaattatgtgtgagaacaggcatgaaagatttctgattactatttcaatcagaatgtactgtcctagcaaaaacaagggaataactcagaataaggaagataatggatttccaagacagtggctgcacccagcagaacagtgaggagatatgcagtgctacagttgtgcagcagaccagagagcgtcagctcagatcagggagaataggacagtggggtgtcctgataggtacaccctccgagaaaagaatgctgggaagactcaaagatctgagaaaggcaattggtagactgtaagatgaagaatccatttgaattagatgctaggtatattagccattgagtggcatgtgaattgttacattgggcccatgggaaagaaggtgtatgtaacaccatttacaaagtcataataaggaaagacgattagttttcagattttagaactaatgtatacacaaaacatggaaattaactatggttagagaacagaatgtcagtgttgtcaaccttgataggttaagagtaaagacaaaaatttcagaggtggctgggatggagggtggcaggcagaggatggggaatgctggaagcactaatgtcctctgggtacaatgtggagggtcaagggatatattctctacagttgatggcataagaaattggcattttaggtgtgtgagtttttttgtagttgtagagaacagagaataaacagaatttgtgatgtataacttttgtggaggggcaaaagaggagggaagtggtaagtaaactgaatcctcttctatcatagcagcaaggtaagagaatgtctaaaataagaaatcaggaaattgaggcatacacattttatttagggacgcagcagtgaccaccagagaaacctatataaaaattactaaaattggtccctc

SEQ ID NO: 94082 - DNA, 1017 bp, Homo sapiens
actggctcaaatattaatctcctttggcagcaccctcacagacacacccagtaacaatgctttgcatccttcagtccaatcaagttgacactcaatattaaccatcgcaggagccatgagtaagatgtgtctggtgtattgtgggaacacagatgaggggctaattaattctgactgggcatatctggatagatttcagagaggaggtgataattgaccttgactttgaaggaggaggagatatccactagactgactgttctgaagtaattcttgctaaatgcttgcctgctctttgctggggacagtgaaaaaggaaaaggagggggatagtggttcctgccctcaagatattcacagcttgttggggagagagcctggcactatgaaccaatgaaagctctgtgtagacagatgggattgtggaggcggagaggctagcagggggacttggtgatccagggtttccagagttactactctcttatagagagaacacagtttctgtaaggatagttcagtccttgcaaagatgtctttaactacaagaggcccagccctctggcttttgtctcacccaattatttcaccaccttgtctctgtatattataagtagttagctggatttgaggtggggagggaggaagtgagggtgcctgtgctgtttcttacgccttgcataccttcccttccctcttcccttccgtcttctacactgatttcaggttcgtcagatactttatcagttcttctctgtccttcatcattaagctggattcagcattgttccccattttttaactccacaatgagatgataaacgccataaaagcaggagtagtgtcttcctgcttctcttatttcccctgggagcagtttctgtggtataaagaacatgggtttctcaagacaggcttggcattgaatctcagcattaccacttaccttggaatttgggcacaatttccatatctgtaaaatgggataacatagggctttctcaacctcaacatcat

SEQ ID NO: 94083 - DNA, 1102 bp, Homo sapiens
gacatgcatggacatgtcaaatcccctggcagtgcacggagcccagaaaacaacaaaataacaaaatccagatgttcaacaacattgatcttacaatatgcaccccacgttaccacaccccaccccggcataacttcttcctgtggctgattctcagacccagggagcaagcctctgtgtcttgggatttttggctctatttttggtcctgatggaataaattcttgttcccagaagtgactatatgcaccagatgagaccaaggggatcagctggaaaacagtgagcaccaagcccccatcaaggagtttataatgtcacaaagagacatcgctaagatgcttgatgagacataagccaagaaaccctcatttccttccaaatagcctctagatgcacagcagtgcctctgaaatgaatcacccatggttaacaacgccaaatgccaaccattagcagatgagaaacagaactgaatcttgagtgtttggagagcagagctcttttgatcacaactagagcctccttcccctctgccattacaggagcgtagatatatatttccttttgactggtgtgcctgtcttaccaataaaataattgaaggaagaatagttacagtgaagaaataagcttattggaaaggtggatttctaatagatccttggtcaagaagtgggtcccacatgacctctagttctatctccgttgtcttgctgtgtatcatttctgtgtcctataaagaagattgtttctggaaattcctgtttgcagctgagatcatactggcccaaaatgggttctaatttaatcatttattgttgttgatgtcttcatgatttggcttaaaagaaagggtatttccattcatttaacctaatttagagttgtctgtctttcaggacctattactttattcttttatccagttgaaaatggccagtgctaacagttttattgattttccttattacctagctttgttgaaacatgcatgttttcacaagcaagtgcattcaccatttttaatcgagctgttgacactggggcttttatcttcctcctttatttaaacctttggtgtgagctcataggggccagt

SEQ ID NO: 94084 - DNA, 1065 bp, Homo sapiens
gttgagaaggcatcagtgttgttagagagctgggaaatgcccaggccttggttttttcattctggctttcatagtttgcagtttccattctgagaaggtcaaaatggacaacatcagtgttcttccaagatgagaacaagaagcaattataccaggaaaacaaagcactaagtaacccttttaaaagcaaccagtcaggatattgaattttttgtttttgtgtttgtttttctataaatatcctgaagtattgagtggtgcctgaatttgatcccactgtgctaattttttcctggttcctggggctttaattaaaataactcacccagggaccttgctagaacttacctctatgtgatctcccctgaggtaggcaggtcgcacctgctttttatggaaggggaaatgcagagttctggattaggtgctgcgtacacagtaggggcataatttttacttgctggataaatgaatgcatgactaaatgaaaataacaggaaaaactgtcacttctaaaggaaactactgagataaacaaggtgtttggcctgactttgctttggataatcggttctttcatattccactgtacaatcaatttcatgagtgggcatggatctgaatgtttaagcttactgtatcggatacttactagggactttccaatgccactcagggcccgcatgcacaccaagtcctcagttataaaaccctgtcctctccctgtttatttagctacttctttattctcaagtttgccacctcctgggagccttcccacacacgggcccatcccaccagcattcccctggttcatgacactggatttgccccccacactcctctgtgtctttctatacaaccatgtactcacatatttatattgtacctataattggagtccaggttgtgccctgcttgccccatctaagggcacaagtcattcaagggcagaggttcctgtactggtccagaactgagacctggcccggtgcagtgtggctccctgttggccttgcaatgtggcattgctgagccgggagcaccatcctaccattctgacta

SEQ ID NO: 94085 - DNA, 1086 bp, Homo sapiens
ccgatttacaaaaatcaacgtatggctgatagatttttaacttgtcatttagaagatcagtctatttcaccttggaaactaaggctatttaaagctgtgagtgtaaagtttgaaggatttttttataattcacctgagatggaaagaaatatgctgctgggacgatgaagtgtgtgcacagctgattcgtacaatgtgtttacatttcccattatgtatcttagagactctcctgttgttgctcagatttttctttttaactcagtcttggggtagaagattaaagttccctgaagaatatggaaatgcagttgaattcttggaagtctgtaccgtgctggccttggtttgtgatgaagctcacacacgatgtctgtaaaaccctgaagtccagccaggtgcggtaaaagagtatggtgacttcagagtttaagagcaggtcattttgcaataactttttataagagtacatggccatctttgccttaggatagtgaagtggtattttccaggacagaagaactgaaatcatctgaatttctaggttgtagatcccacagtccttgggaattttgacttacaaactaggaaattatttcaccctcataaaaatctccaaccctctcaggtctttcccactcccacttgggtttgaattggagtgtttgcccagccatggtgatgattaggaggtgtagcaatatgggcccagaaggcgactttgggattcatctctcatctctcgtagtgcatgagagaagccagctcacggctctcttagaaaacatccattgttcctgaaacctgcagtaattggaacatgagtgtaatacatacagtaaacagaattctgcctataagctcttaccaaaagcctgccaatgcccagcctgccaatgcccagcccatcttgaactaaggggctgtgatccaacaggaggatattgcccacaggtagctccaagtctgcctgaggagctaagatagaaatgaagtaatcagaaaatactagcaaaagtcaaatcaggatatttggattaacatcctgaggacatgggatgtgtgaaaagctgtgctggggaaaag

SEQ ID NO: 94086 - DNA, 1041 bp, Homo sapiens
ggatttcagtctgaaagcctatgtttcagtttagagaaagccgtaggctttctaatgtacctaaaacaggcaccaagtctaggcagatggccccagcccactgacagtgggtaaggacatagccttaagccatgctggagatgacaacactctaggcttttagaaatttggctctgaaataaaggatgtcttggggcatcccaagagccaagactgcggtctgtgagagtccaaacctgagtacttatacctcaatgttacttgtaaagtagttacagattttccaagcactcacttccatgttatccttagataggggctgtcacctaccccatagggttgtagggaggattaaatgaaataaattgggtaaagcacttacccaacagcaccaggcccatagcaagcatttaataaatgatagtggtgattagggctcttccccctactttcgtaaggagggggctgtgtgcccgtgtttgcatatttggtattgtattcttccttggtcggagtatcttccattccaactcctaattttgaaaacattgcatatagatctctagccaccaatccttcaaacctcaagcaacaccagaattggctgcttccttccgaagatcctccctcccacatctaaggacaccacagtaactcagtctctgtcagcttcccctcctgtagccttgggagcacgccgaggccatgggcttaggagaggcaacctagcatgctggacagaacccagggcggggatcctgtctgggctctgctgcccaaccacagggagtcctttggcaaatcaactgctctgacctcctttggaggcttgttgggaagattagagatattatttctggcatagtgccatgcacgtatcagaggccaaacagtagccagattcattactgatggtatgttctgaggtttgcacctttgcaaaccattctgagactgctagcttgttggcatgcactgcctacaccttagagtgatagccctactatgtgtggtctctgtacatcttggttctgggaaggg

SEQ ID NO: 94087 - DNA, 1053 bp, Homo sapiens
acacggtggagaaagaaactacccaaagttggccaaagagcttgtcactgttctacaatgatctcaaattggtaaaggaggttttcacagcttttccaaaggtttgaaaaagaaaatagctactggtggctgtgaaaacactgcattggctgcaaaaatcagtgtgatctggtatcagaagcaaggtgttaaatattatccaaaaaatgcagacacaatatactcttcatggaaagccttggactaacaaaagagaaaaatggagatgagactattatatgataatcactgcctaacaactggcttcaataaggaggctccccatgctgttgtaaccacagaatacagagcatgaagaaatggacttaagttacagccaaagagatggaggatgagacctaaggaaaaagactttcttacccttcttgaagataaagcataagaatgaagatccctagagatggatgggagtcgctgtggaatctggcagtttgggcgttgacctgtccgatagcaaacccagagcaatggccccagggagtctgggagcctccaagaaagcagagacttcacccaagagtctcattcgaacaacctgactgaatctcagcctgcaacagatggagcaaaagttccatcttaggatgctggagactaaatgggttagaagtagagggggaagtgcacgaactcggctccaggaggaagagagcaaatggcccatggaagttttcctatctctggctccttggaaccatggagtcaacacgataaaattagcagagctaagtaggcagatttgtggggttggaggcataattggtcctgtttttctctagtcttgacctaactgaagttcactgggtatgtaatggaaaaaaaacaaccagcttgatataaaaatacaggaaatgcctgcaatcactgctgattacagtagcagctttccttctgttatttttgtgaaagagaaaaaaaaagggggggttattagggtgtttttttttccctttcctaaactttggaaacaacttgggctattagttcttttta

SEQ ID NO: 94088 - DNA, 1056 bp, Homo sapiens
catgtaagctttagaaaattggaatctaattgatttacagttacacttctctaaatattagtagagaagtctttgggaagagcatttgggaaaatgaattgatggtcagtactatagttcatccagtctgtagagctcagtaatacaaactgataggaagggaaaataggcgtcatccccggtatgtggttgacaaggaggactgtttggttgctgatgtactgtgcctctctagaaactcctttgtacccagccaataacagtgactttggggggacattttaggtaacagtgactggatttaaaataaaagtttgaatttgtgggagtcaatttatctgaaaaagagaaatattttctcaagtcggtatattggacaagaggtggctgttacatgcaggccttaagaagaggctgggggaggatggtcggtttcctagatatggttaaccatacatcatcaggagagaaatgaactggtcattgacttcatctagccaaattcaactgactgatggaatttttccacttttcagtgtctttgaataattttcttctcttaaattcatgcatgccaataaatacaggcataaatataccttcacagtatatacagacacttagtaggtacataagtgagaattctgagaaaaatcagtgttctgcctatgacaatgagtcattcttaattcatattagaattaaataagcatgaaaatcaaagtccattgcatacatgattactgccagagcagaatggagtgtgaatcaaaatccagttgtacgtgtcttcgttctgagtgaagtacctgtttaaaatgattaaaagtgatttaagacaagttaatctgctccaacagcatggcagatgtaagcagcaggcttggaccgccaagccagagccctaatactccaacaggtcagttcttgccgagtgggctcaggcagtgttgttttaccagcctggcatccaagctctggcacaggtaatgctgtttccagaagaaaagtacttattggatgtttctttggtaaatactccaaagtgcctgttgt

SEQ ID NO: 94089 - DNA, 1070 bp, Homo sapiens
acagcacagagaacccccagccaacctatggtagatgtgcagagtgagcaagaaataaacctctgaagtttgaaatcattgatgttggggattgttcattaccatgacaaaaccttgcctctacagatgggttcatgacaaatacaaatcgattaaacataaatcaggtaggaagatatcacagaaccaaggaacacttacagcgtgggctgagtgccctcaggaaggtggtcaaggaagatggagaaggagcatgcatctcccaggttacatctgagcctggagtcgccaggcttcaaggacctgagggaagcttgtcttgtctctgggacattgagataatcttcaacgaaaccttgttaatagtttcccccaaatggacacaagtggtaagttttcctttctgcactctgacctttcccaactcctgtcaatctctatctatggactaagcataaactgatactcagcctggtgccactgccttccagaacaaggtgtattccagacctagatcacgtgaaacctgtgggaagaaaaatctaacctgcgagaaatatgtaaaagtgagatagtgcagagctgagtgataaactgtgcagtctttttttctttttaaaattgtgataggatacttgtaaaattaccatttttaccattctaagtgtataattcagtgacattaagaatatttacattgttgcacaacatcaccagcatctatccacagaacgcttttcatcctgcaaaactgagactctttactccttgaacaatacttccccattctctcctcccccagcccctggagccactatttcactttctgtttgtatgtgagcttgactacactaggcatctctagaacttcttgctcgtgctgaagaagagtggtctccaaacctttttaaccatgaactcccactgttaaatatcttagcacacataccaccagtatgtcatagttattactttataaattaatacatttataccactttactaacatatgatgtatatttgaaaaacatacagagagcagcaaagcatttattccttctttttaaaac

SEQ ID NO: 94090 - DNA, 1023 bp, Homo sapiens
cacagtcgatgtggtggtcatccatgggatgcccctaatagcatctgtaattttcaagtagatgttgggtgtaatttggtgacccttgtctgttcccactgttggaagccccataactgatctgatgaaagcataaagtgaagaagagtggcgagaccctttgtgagatacctggagctgaagagtcaggtgtggaatggacaagaatgttatccacttctaagtgaccttgttttttctaatttcttaagaaatacctgtttgcttgactgccttaggctgtttgcaggggccacttgtacgtcagcaaaactcttactagatgacatcactgccagaagttccacatgtttccaggaggcacatttcccactgcccccactcccccgaacttggaaagattcctcagttttaaagttataagtaatttccatgccagataatgatcctgtgaacagatccttttctcatgtggaaaaatatttcagaaagggtgtcttgtcaatgagaaaaatgaccccattgaaacatatgtttatttgccatgtactcatctgacgttttgtgaattctataaagccatggaagtggattgttagaagtgtctcatacacccctagtgacttcttgaactatccccccatccccagccatggaactctcctattaaaaaaactaagagataagtggtagcaatcttaacaaattagtgattttatctggttaggccgtgtaatcaaacacgtgggcaggaaagtggatccattatgttgtactcatgattgtggtgctgaaggtaacccccattgccctgtaggctgcccccagaagcagggggtacagccaatagtattcttagaagttaatcaattctgtaacgggttgagtgttttggtctcatttttagtccgaggtgccctgatgctggcctgtgactaaggggagtcagtggcttgttatgaataagaggacacatgagctgaatctgagaaagttcagaagcattttataagttgtttaaaa

SEQ ID NO: 94091 - DNA, 1035 bp, Homo sapiens
aacaatatagcatgttcctgaaggccaaggatgtctgattttctgatgtgccctaataccttgcttgcttttttttgggggggggggctctgaaatcatgcttagttttttaaaaaaaataatagaattgctttgttcatgtcccttgggttacttggaaagcctgcctcacaagctctgctttctttattcatgtagatttgacccctttacttatttccctttaaaaagaaagaaaaaggaaaagaaaaaatttgggggaccacagtcaggtcttattgatacataactttatatcagatgcaaacgtcaggctagtattatatcagtgcttcacttcaagaatgccttatacactaatgtgagtacagccaaacagaatactccagcttaatctcaacgttaaaagcaagatggggaagttgtgcaagagggcactagctctcagttcagagatcatcttccctgggaagccttccctgattaactgcacattggttacccctgtgtttatagatggtcttcagtctgtattttgttatttgtatgatgcttttacaacttgcttttgaaggttgggggtggcgtatgtccctgatcaccactcaagtggtaagcccttcaagagcaaagacccagtcattttttcctgttcttttttccccacagaagtcagaatagaggtctcttgaggtgctcagtaattatttgtagactgagtaattctgtctatgtcaggaactttgggagtttggtgtagagaactggaagcacaggtagacactttgctcacatcaacctaacttatcctcattgcttatccaccatgcgtagagcagggtttgtgggaatcatcactgtgtgtagatgtttataggttccctcccaaattcaggtgctatgctgtacggtgaggttacaaagaggcattagatggaccctgcactcaggatgtcctaaaatgatttgtttaagcaatataagatgatttatgttaatggatgtccaagctgcctttacaatgttgccatcttg

SEQ ID NO: 94092 - DNA, 1032 bp, Homo sapiens
tcttttctatatttctgaccagtgtgttagctatggtgccccagaaatagctgcaaaataaaaggttaagtgccatgtaggcctttctctaggcttagaataattcacttgattacataggaagaggctgcaatgatgacagcttccagggctgggccagaccttaccctgggtaaaatgatcctccagtgtggcccatatgtatgctttgagccaggagctgctagctgggagaacaagtttttcttcagtggtattcctgtgaccaagatttcaaataagctccatttttaattttaattggttattgtcctcctgaaattttatgacacaatctatatctttaaaaaggcactctttcttctttatacagttgttttcatgatgttaaaaactttaaagaaagtatcattcagatttgctgacagttggaagattattttaaaaatccaactagtttagctgaaaaaggtgctatcagtgtttctgtctcatccttggaaattgtatatttttaaggcttgtgattagctttttctcctccattgctgatcgtggttggaagtgtggcatagatttacagtaaactttgatataatggtgattcctctttgttttggagccaggtgcctgcggtatttgcttattttctttgattcatttttaaattgagttgaatgtttgatttaatcagaagtgatagtatgaggctggggatgattgcttgtggttgggaattgcttgtaaagtttactgtttagtcaagacaaatcgtttcctaaagctctctttttcagatttcttgtctatgtgggaaagcatgataatgccagtcagtttaaacatatttaagagttcccaggcatcttcgaacagaaaaatttgcaacaaaatttggcaacggcagaatgcgaggatttttgcctcattttgtttatagttgtctgctcttcaggcaaatgatctattacaacaatctgaataattacagtctctccttcaatttattcaccctggactcctttttctaga

SEQ ID NO: 94093 - DNA, 1003 bp, Homo sapiens
gctaaaaattagaaaccataacgaaaagcaataagggaatagtaaaatgcattgtggttcagccacatgatgtgatattgctggctattatgaatattttgaaagaattcttaatgggatatcctgttaagtaaaaagagcaaagtattaatttataaatccaatgagatctcagctcgttttcttcatacctttttgtatttttgaagttgcttatactaaatatgcattacccttatcttcaccacggcatttttaaaaaggaaattatgtgttgggaaaagctaggttatatgatggacagataatgaaggtctgtttctaatcgtgccacatggccagtgctgcttgtcagcaggcgctctgttcacagggccttgaaaaagccagaactcggggcttttgttccagttccacatactcccattacctttctaaacctcagtttttccttatctctaaaatgggaatgatggtagctgctcttcctagcctactgtgtgaaatttacaaatttagttacagatttccagattcactcacgagtgttttagactgtagtgtgtgatccaaatgtaaagtggtattattcactaatatgtagaataaagaatgccccactgtcttagcccatttgggcagctacaacaagataccgtaaactgagtggcttataaacaacagagtttcatttctcatggttctggatgctgggaagtccagtgtccaggtgccagcagattcagtgtctggtaagggcccactttctggttcatagctgtgtctccacatggtggaaggggtgagagggttcccctgggcctcctttgcgagtgcactaatcccattcatgaggacttcactgtcatgagttaatcacctcccaacggttccaccttcagataccatcacattgggagtggggatttcaacataagtattttgaggggacgtaaacattcagaccttggcacccactaaggcttgggcttgatgaagctaa

SEQ ID NO: 94094 - DNA, 1063 bp, Homo sapiens
tgacccaagatggcgacatgatctttctgtcagaaaacatcagcaagttcatgggacttacacaggtgacaccctcctctatctctttcaaaagaagaaatgtttccatttgggggtagaaatgagtggaaggtgctagccacaatcccacttgacctctccctgcaaatgcccacggtgaccctcgctgacctcaggccacacgcctcaggccacgctcccacccccaagcattgggtttggctttgctcatgtccatcctggtagacagctctctactgactcattaacagaccaagtctctgtcatcatcagtagtccccgattacatctttctgtctgtggacctgacactggactgggattatgagaaaacccaattcagtctcctccctgcctccaaatctggaaggtggctcagcttactcttggagtcttttacttcactgttaggaataatgatgcctaaccttgtttttgaaacaggtggagctaacaggacatagtatctttgacttcactcatccctgcgaccatgaggagattcgtgagaacctgagtctcaaaaatggtatccttaattgtgtttacttccttcttgcccccactgggtgggaatctgcctcccctttgtctacgggtataagggagatagctcatggcccttgtgatgcaggaaaaatggatgtccttaaaaaatttaagtatgtagcctgtgagatgagattggggcattgagaggatccagtactcagaaatatctcctgctggccctgcatggtgcctggtgtcccactactaggggacacctttgggttaggacactgtctctaggaggtttcatcacccaagagtcaagcatctctgccaaatgacaccacccaaaccaatgaggaactagtctgtgccaaagtgctcatagtaactactgtagttatctattgctgtctaacaaaccacctataacatagggctttgatgattatctcccagggttctgtgggttcagtgggtgggtcttgtactccatgtgatgtcagctgggctgcagtcatctgggggc

SEQ ID NO: 94095 - DNA, 1050 bp, Homo sapiens
tgtcggagagacatttctaacctgtgaggaaggcttacacccttggagtaactgtggcctcactcagactgtcccttggaatttctgcgagaagacctgggcctgccccaggaaagggtggctgagttagtggctgataggcagtcgttgtgtcgctgctctgaaggcaccactgaccatgttccagatgcaatgggaaatcaaatgatggagcagctcctcccttgtgggagtttatgctccagttgaggagataagcttgagagtgggaaccattagttcacaggccatgatggagctcagtgttgatggcagaccacaggtgctaagagagcagatatttggaaaatataaacaataggctgccaagaaaaactgcagctgggcccctctcatgaatatccatataaaactgacttcagctggttcttcccatccttccacatccaggctctggttttgggaaaaaaagcaaagacatgtccacagagcgggacttcttcatgaggatgaagtgcacggtcaccaacagaggccgtactgtcaacctcaagtcagccacctggaaggtagggcaacatcaggcctgggttggagtcccaggtgtagggtaacggcggtgcaggggatgcctaaggccctacccccacccccagcactctcggctccatgtctgacccttccacgcctgtctcaggtcttgcactgcacgggccaggtgaaagtctacaacaactgccctcctcacaatagtctgtgtggctacaaggagcccctgctgtcctgcctcatcatcatgtgtgaaccaatccagcacccatcccacatggacatccccctggatagcaagaccttcctgagccgccacagcatggacatgaagttcacctactgtgatgacaggtagggggccatgggtgtgtatgctgtgggcagagatgggtcttacctgtgtgtgtggggagttgtgcctgtattaaaggtgtggaactgaacatagacgtggtattgccgggtgcatgttcgtggacctgtgccactgtttcattg

SEQ ID NO: 94096 - DNA, 1154 bp, Homo sapiens
gccctgagctcagaaacccatagctagcaaagggacaaacccatagctagccaagggaaatctgcttgggttggaaattggattaatgacagttatgacacgagcttgccccttgcccccgacccctgtctctcattcgtccttgaggttttgcaagtcaagtttcactacagactgacacacatgctctagactaactggaggctcaggtttgagacaggtccagattcacacactgggatcccccatttacacacatgtatgtcttagcctgtaaaggtttaccgttgaaatgcctggagaagctcaactagatttagatcattgaaagctgtaatttccaaatggattaataatttatacactgttactctgggcgtgaggttaggggtcagtctccctttgttatatgaggatattatgtgcttttaggctttttatggcctttaatcttattttcctatctattaagtagcaggcccttcaccaaggctggcattaatgaccagatgattagaaagctggcgttaattatattctactgacagagcaggcccttgcctgcaattgttagaaatgcacttaaaacctttgcttgctgcactgtttgatcaaaaagagtaagagccctgaatttggtttgcattaaggaccatctaaataagttaaatacaggcacttgaaattgtgcaagaatcattttactgcagcagaggagcctcagtggcacagataaagggagagcagagaggacaaaagttatttccttggttgagtccatgatggtttaggacagcggcaacagcaagtttggtcttcccagtgatttgtggacccaggtaataaagagaccattgtattaggagccaccagacatgttgtgtagctcagactctgtcactattgtcttgtaagctgtgaagcaaatcataaccctctggccttagtttcctcatgttaaaagaaaatacttatcctccctgtggcacagggttttgtttaaaagattagacaagatgatacaaccattttggaaataatttggcagcttcttataaacatatactttacaggtaagccagcaattgcactcctagctgcacccacgagaaatgaaaatatgtccatacaaagatttatacacaaatgtttat

SEQ ID NO: 94097 - DNA, 1059 bp, Homo sapiens
aatgctttgcagaaacgaattcatcttatcagatagttctgaacactgcaaagcactatacaaatgtaagttacaggaattcttgcactttgcaggtgcttgttaaattgtgaagaagaaagcaaaacataagtgtaaaggattaccaaactgcactagtatgaagagagccatgttcctcagctgtacagggctgatgaatggggaggaggcctgcgagcctaccaggagaaccggggagactctctgtctaccgagagcctggatatcctcccgagtggcccctcatgagactatctaccaacgtgtaacagactgtctgtgacaggccatgggcataatatgtattagtatctctaagaaagaggtggcttttcctatacaaaatttgttggtgacagttggtcaacacttatgtacctgataagccatgtgggtacagtcgatcctcagtacaaatggcagtggtatgctgggtagctaatgatgacagttattaccgttactactattattatcaatatcctgttttgcagaggaggaaaccaaaaccaagaaggattgttcctttccccaaatcccaagctagcaagatttcccgatcctccctccatgccctttcctaacgtctctgtgatttgggagcttctgagctggagttctgtaaattcccaaggaatgggcagttcagaaaaataccaaaaattctaacattattagactttaaagagatttattgattccttttgaatggcagcagatggaacattctggactggggaaggacagtctgtgatgtgaaacccttccccaaggtagacaacaaaagcgttttttaaatgaacacttagtagaacaatctagaagaggaaaaacctcataagtaggaagcctagctgggcggttgggagaaggagtataagtgatttattacagcttatgaagagactgtgtgtgggctgccagggtcccagctctttctcagccccaactgagaaagggtggggtggtttgcctctgcctttgctgtgggtcacaaaccttcagtggcccaaaagg

SEQ ID NO: 94098 - DNA, 1037 bp, Homo sapiens
ttctgcgctttccctggcatctgtcatttatgccatgcatctgacccaggtggggaggcagatagcacacaatagtcaatattttctgaatggggaaaaaggaaagagaatcgcttatgcttttgggaaaaaaaaaagatgtcatgccttcactctatagtacctggaaagaaagctagaggaagtcatttctagttgtttctacagacagagaaaaacaaaagcatcaggcctcatatataccaccccactcaagtgcaataatatttaataaaacaggatccgaaacagacatacattcagaggatacctctgttgtcactacctccatggctcacacacttctattgtatggttctttataagacgccaatgcctggagtcctacccattttttgtcggagagcttagctatgagggtttccatgcatctaggggagcagaatttttctagaaaatgtggaaagtctgaatggctctttcccccccattagtgagattgagaagaatgacgtggtgttctccatggaccagactgaatccctgttcaagccccacctgatggccatgaacagcatctttgatagcagtggcaagggggctgtgtctgagaagagtaacttcctattcaccaagctaaaggaggagcccgaggagctggcccagctggctcccaccccaggagacgccatcatctctctggatttcggtgggtgcttcttagctaagccaggcccctggaaccccgttggggctgggaagagttcttactataacaggcctccctggctgcagctttttcttaaccagagctaccccagccccccaagtcttgttaatcacctgttagaggccaggccctgctgagcacaaaagaacaccacacgctcctgccctgataagaccatcccatatccgacctcaccaagtgctgtacgaggaggggttaagagaggacacccccctgagggtcgattctccaccatgggtggtgagagtctgagatgagagggaggggagaggtgagggatctgctc

SEQ ID NO: 94099 - DNA, 1050 bp, Homo sapiens
agagccccctagagtggccgtgacacttacctaccaggtatcagagctgttttcttccttttagtgttcatcccccaactccattgaaataagctccttgaagggctttgagcccccagctcagtccccatacagggcagtaacatcccgtatgtggcacagagctgcacagtttgcacagccctgctggccacagcctgtatcctgtttggtcctcaagacaggacaacctgtgaagcgacagtagcctcattttatgatgaggagactggaatttagagaggttgatgaattgacctaattcatacagcttgttaattagcagcccctctacaaatagttgtgtggtggaatggaattgaacctttgggtccaggaaggtatttcttcttccatgctggacttctggggagaccagtgccatatctttgactctgtccccctccttcctggcccctagcccaatagccctgaagactattacacatctttggataacgacctgaagattgaagtgattgagaagctcttcgccatggacacagaggccaaggaccaatgcagtacccaggtagatggctgtggagatcaggctagggtgtgtgcctgctgtctggtggacagcaaaggctcacatccattcttgtagcctcatccctttgttgtaaagagcagtggagacgtttggccaaggcccaggtcccctaaagaggtaggggtacagggtaatggagcctgtggtcaccccctcctcccactgtcaaatccagctcttccagcatatgtgtctcctacttagatagctttcttagcacacatgaaaaccgaaatgataccactgcacctttctttaaacaggccctacatttaacaagcatagccagatgtataaaacatgtataaacataggggacaattaatccctttataaacacattcatcttgtgattttaaaaaaataatcatttttatatgaaatgcactttaaaataaataacatctgtttgacaatttttcatttacataaaacttttcaggaacacatttatt

SEQ ID NO: 94100 - DNA, 1042 bp, Homo sapiens
caaagagaaacaaaaatgattttgctttccaagcttggtttgtggcgtctccctcgcagagcccttctcgtttcttttttaaactaatcaccatattgtaaatttcagggtttttttttttttgtttaagctgactctttgctctaattttggaaaaaaagaaatgtgaagggtcaactccaacgtatgtggttatctgtgaaagttgcacagcgtggcttttcctaaactggtgtttttcccccgcatttggtggattttttattattattcaaaaacataactgagttttttaaaagaggagaaaatttatatctgggttaagtgtttatcatatatatgggtactttgtaatatctaaaaacttagaaacggaaatggaatcctgctcacaaaatcactttaagatcttttcgaagctgttaatttttcttagtgttgtggacactgcagacttgtccagtgctcccacggcctgtacggacactgtggaaggcctccctctgtcggctttttgccatctgtgatatgccataggtgtgacaatccgagcagtggagtcattcagcgggagcactgcgcgctatcccctcacattctctatgtactatgtatgtatgtattattattattgctgccaagagggtctgatggcacgttgtggggtcggggggtggggcggggaagtgctctaacttttcttaaggttttgttgctagcccttcaagtgcactgagctatgtgactcggatggtctttcacacggcacatttggacatttccagaactaccatgagatggtttagacgggaattcatgcaaatgaggggtcaaaaatggtatagtgaccccgtccacgtcctccaagctcacgaccttggagccccgtggagctggactgaggaggaggctgcacagcgggagagcagctggtccagaccagccctgcagcccccactcagccggcagccagatggccccgcaaggcctccagggatggcccctagccacaggccctggctgaggtctctgggtcggtcag

SEQ ID NO: 94101 - DNA, 2450 bp, Homo sapiens
ccaccgtcttcgaccactacgcaggtaagcctcggaactgctgactaaggggccgctccccgggccgggaactttggagcaactttggcggagccccctcgccgcctccccagagcgcactcctctcccctcccccgccgcgccctctgccaggcggccggccccacccccgaagcttcgctcctggcaacccctcgcccgctgatccaccccctctcccacccgccccctacgcggctcctgctccccgcacttcctacccctcggcgccctgggccgtcctccttgaccttcccacatcccctttcctactgccccaaggccccgggggaaatattcgaggggaccgagcgagacgtggctacgggacttgggagaagggggtggacggctggggaccacatcacaccccggccctttgccggttcacagtgagctggccgcacgggaaaagggggtgacatctcgcggggagcgcccccacgcctctagctgggttgggagaggagggtccgggtggggagcgaaattgccccagagcccaggtcactgtgagcttctctccccgcccccacttctgtccttgcagtcagcgtcaccgtggggggcaagcagtacctcctaggactctatgacacggccggacaggtgagtgtcttggcctctggccgacgcccccctcctgttccccagttctttgtggctgcgaagggcctttggaaaccgaggtgtctaggtgggagggtgtgtctgcgacgggcttcccctggattaggtctttatttcttgtaacaagtcagcaaattaggaaaacaaacaaaacaaacagagccggataagccccccccatgtgaacccctgggctgtgaaagtttttgcctgtgtgggtcgttctgtgtggcgcctggtgtgtgggtcccaactcctgttgcaaagtggcagcagccaatcatgaagcgcccttatttttagttgcagatgaccaggtctcccccccacagcctctgtctggtccctcattggtgagtggtctgcctgcccaaggagcctgattggtgggaaatggcatcatctaatatgatgggaaggcatttggtcctggttatgtttattacaacatcattgcactctgggactccagtccctgaaaacgtaatttgtggtgttaccaaaggaccacagggaaaaaagaaaagaaacaacaaccatgtagccactccctggggtggggaggaagggttaggagtttagagtgaatcttggaggaggaggggttccccccggccctacttcagaagggccaggtgactttgtctgggttttctttgggagagattaattgtgcagaaagaagatgcacactttgccctgcagcctctggccagggtttgcacatcagaggtggccaggctgtgcttctaaagggccaaggtcttctctctgtctccctgtcccagcttcagcctcttcccaaacccacttttgctctggggataagttgtgtgtgatgaattttgtagaatccagcactatgattagagttgaagactctggcagaagtttccacatgtcatacagacttacatccttgagaacacaggagcagctgaaagtcttagagaatgtctttgggggaagtccagtagtagaatttccttatctgcaaaatggggtttaaaaaaataagatgatcccctggtgcagatattgtatggcaaatgtttagcattgaacctggcacacactaggtgctcaataaagggagtgatgtactttgaagcttgtctagatttggatttcagaactgtgattagagtttaggttggattctgaaacatgccttattgagggggagtgccttgatgtgacctctggtttctaaactgttagaggaacgtctgaagatagagaactgctggcagttcaaggtccctgagaccaccccctttcaccaaaatggcccaggtcagtacagccagttctcagctctcctgggcccccattggttgcctgccctgtagtcgttattccttctaccttcattggaggatgtggagggcaaggggcagagcttgctcaatcaactaagactgacttttaagtcgtattattgataaacaagaggttgaccttattggttgaaaagaggaagcttttaaaaaatcgcctctaatttgaacttctcactaccttcctttctcttatctcctttacttgtgaccatgataatttttgaccgcactccctgttcaacaggatgtgtgtagtcagagctgttctgagtatgtttaaaccctgctagtatttactgagttttttcctacatatggggccagaggcagacacatgcaaatattattttatttagtccataaaacaaccccatgagataggtggtatttcatctttgcggtgaggaaacaggctcagagaagctaggttgcttgcct

SEQ ID NO: 94102 - DNA, 1033 bp, Homo sapiens
aaatatcttttactctggtgtcccttggtgttgctttttcaatgacaagtgagatttgttttacacttgatataacccagcagctgtggctgccctgcatgccctctgggtgcccacaaggcacttcccctacagaagggaatctccaccggaggcaggcttggcatgccccaccttctgcattttagcagaagggcctggcatgatgagaaaagggaaggagaaagggccatgggatcaccactcaccaggctcctcccacctccaggcaagtcatcctcacaacacccttcaaggtagacttctcccagatgaggaaattgggaacaagtgggcttatgggaaccagacagagatgtgattaggaaaaaggttttctactttggagaaggcctgcagggaacattagtagggtttaggaaatgccactcacaacatcagactctgggtccttgtagccccgtgttccatccttgctcagcccggtgagcagagcctgggaggagccccagggttccttccaggcatcagctgcaacaggtgagatgctggcactgagcatcctggtttcccttagtaacctactgtagatttgtcatgtgtgcattttgctaacctttttagaagctatttatatctctagcccacaccgcatcacacgggaatgctggtttcctcctctgcgttgggaaggtggatagcctttgttgactccaaagcctttgctgtgttcgctccaaagtctgaatgccctgtgttcccctccttgggactctgatgtgggtttgggttatgccagcttagactgtgggctggcaggcagggactttagggtgggggcagtccccaccagctctcgttggtctacaattatgcctcataatcgggcacataatctgtgccccatccccatcctggacctttgatctgtttggcttctccacttccatcatgattctcctgaggtttggtgacattcccacgctttgaacgacagcttccccgcaggtatctcaagcatgagtgttacagg

SEQ ID NO: 94103 - DNA, 1652 bp, Homo sapiens
cttcagctctgccacttcccagcaaggggcttaaccttcggaaacctgtttccttatctgtcagatggagattatgatagtacctccttgtggggttgttagatatgttggagcttcccagctcccagataagggatttcctcagccctcagggcagctgggtagggcctgggacaagccatggctcaggttgtcctagcttgagcagtctcacctcaggcatgcagcagtggctcctctactccacccgatgtgtgctgaacacatcatctcattttctctgtgtgccatgaggtgaagatttgggaagcattgacctaaatgagttccagcaggcagaggggtgtggagagctcatattctgagtgggaagaatagtgtagggaggaacggcagagggggtgaccccaaagcgtctttttatggaccccagatccctgctatcagtgtcaacatgtggagcagggttgataactaaattatggagtttttcacctggtgactgacaacttggtaattaaagagatattaatctggtgctgtgttgctggttgattttaatagaaagaaaagaatgtggggaaaggggtctttattgctgtctctgttcctttttgagtgaatggtgagagcactgaagcagccgcctctccagatccctagattttcctgctctactcaggctcagggtagactgaggggcttaaaagtggcaggctcatcatcaaatgacatttttacagcacataaagcatgtcgcacctggtaccgccttgagttccctcacctgctctgtgagtaaaggaagccagtggtggctgtctcattttgcagatctggggaggttaaatgactcgctccaggccacacggttggtaaaaggcaaagccgagatcaccaggcaggctgtcggactttaagccctgggttcttgatgttaagtcactctccctaatcatctggcccatgttaaatgcctcttttatcacatgcactgttgttcagcgtttcatgtaaaaggtacattccaagcgtatcgcttttctagctagaagagatggtggaacattgtgtataggtggaacacgtagggacggctgctaaaacggctcctacaaagacttctgccccacgtgacgttacgggtgttttgtcactttgtccctaaaccaccatgcttcctcaaaaaggagcaggcccgaggtggcgctgatggccccattgctcaagtacgtgtggaagaagctcatgccatttgcctaaagctgtggccccttcccagaagagagggacagggaaatgctgtttggggggctgccaggcgggccagctttagcctgcaaatgacgggtgtcgtttgtgtcccatgggggctacctcaggcctttcctttctcccttcaaggattttcttattcaggggaagcctacctctgcaaaactgtttgtccctccttcatctgaatattctctaaatatggcgcaaaacttcctctgccacctgctgctcatattgtttgccctcttgggccatccccattgccaccacctctgcatgggctcccaaatcctgcctggctgcttcctgtggtggctggcaagcctagaagagaacattcatccagtcagtcaacatacatttcctgagcacca

SEQ ID NO: 94104 - DNA, 1037 bp, Homo sapiens
atgtcaggtgtgcttccagagtggcctgtggccctctgtgataagtcggtaggagggggacatggtgaggatgctgacctgctcacttgtgtcttgactgggagaccggaatgcctcctgttgtctgaacaagctagtatggaagtagcatctaggcaagctggtgttaagacgcaagtaattactcagagaaattgctggtgtgtcaaactgcttgatatgtaagtttcctcctctttcctttgttttattttttgaggcataattcagagaacactttcatcaccccagaacgaaaccccatacccaccgacagtcactccccaccattcctcctcccccgtctcctggcaaccactaatctgtctttctgtttctatggatttacctattctggacatttcatattaatggaatcctgcaatgtttgccctttgtgtctggcttctttcacttagcataacgttttctaaggttcatccatgttgtagaaggtatcaacattccattcctttttatggctctgtgatctttctctttccattttattcctgcccccgctctttttcagttgttcttccatggccattctttcccgggctctggggactattttcagggtttcaaggtacaaagtgaagttctgctagttgtgcacttgtggtgctgccttcgcccctggctcaggtagaggcgagggctgatctcttctctacccttctgatattctttttcttaaaaaatttttttaatttttttttttttgttccttttaatgcttgggtctggaccttccagtgttcttgttttctctgtgcctctgttcatatactctcccaccccaaccacaccctaatagctttatttatcaaacatataaatatccattaaacataagagtgaggtgaggaacacaaaattccatccgatcgggttcttcccccgtaggagtttacagtccagttggaagatgaatagagctggccagaatgcaagtagaaaatgggatgtgcatataaatcatgaaatgtgagtga

SEQ ID NO: 94105 - DNA, 1050 bp, Homo sapiens
ccacctagaaccaaccactttaacattttgactattttgttctgatttttcctctgcatattatacatgtgcattttctttaaagttttaatcatactatacatatatatatggttttgattcctgctttttcacacttaacacatcattagccttttcacatttctttaaatatttgttgaaggcagtttttaatggctgtgattattctaatataaatcattctgtgatttagcaactccctttttactatgcatcaatgtgtttataatttatcactattataaataacattgtgaagaatatcattttatgtaaatctctgggtacactgaatgttttctaggcataaattcataaaatcagatcactgcaaaccaaagagtctttggcaaattaacctccaaactggttgtttcagttttcattcccaaaaatggggcagagagtatttactttcctttctccttttcaacttgataggttgaaaaacaaagtttttattcacatgtctttacagagtgtgttttcattggctatttgtttttcttctcttgtgagctattggtttatgtcttgtccatttttccactggggctacatggtagattaactctttggcaacctcatttataggctgatctcttacgagttaacataaatcagacccatgtacctgatggtccttgaaagccccaataaaattgtttctgaatctaaacggccccacagaaaccttgcctatctgggaagctcaggtcaaacagccgggtagttgggcacctttctaacactcctcactcacatttcatgatttatatgcacatcccattttctacttgcattctggccagctctattcatcttccaactggactgtaaactcctacgggggaagaacccgatcggatggaattttgtgttcctcacctcactcttatgtttaatggatatttatatgtttgataaataaagctattagggtgtggttggggtgggagagtatatgaacagaggcacagagaaaacaagaacactggaaggtccaga

SEQ ID NO: 94106 - DNA, 1115 bp, Homo sapiens
agtttggaggttaatttgccaaagactctttggtttgcagtgatctgattttatgaatttatgcctagaaaacattcagtgtacccagagatttacataaaatgatattcttcacaatgttatttataatagtgataaattataaacacattgatgcatagtaaaaagggagttgctaaatcacagaatgatttatattagaataatcacagccattaaaaactgccttcaacaaatatttaaagaaatgtgaaaaggctaatgatgtgttaagtgtgaaaaagcaggaatcaaaaccatatatatatgtatagtatgattaaaactttaaagaaaatgcacatgtataatatgcagaggaaaaatcagaacaaaatagtcaaaatgttaaagtggttggttctaggtggtgaccatgaataattttagaaatttacttctttatactttattgtgttccctaatttttttaaaaaaactcatttttatcaaacttctatatgcagatggtttaaagagtcagcagttctggaaggagttattatgaagaaataaaatattcctctttacttctcctgcagaaaagacatttcccactaccctgagacaaccactttcaactctgctgtttattttgataacaaatattctctgttgaattcacatgatgactgatgaggcctgagctccctttcacacatatcttccacttcctatccacctttctgtaggagctatattgtaatttcagtttgaccactgatcagtgtttatatttttatgactattcacagctgagccatgtagtgtactatgattatattttttttcttgtaccactttctgtttctcaagtgaacaattatcttgttgcttctcttacttggttttcactgtatgtctcagctatttcatgcaaaattcaccctcccatgcagcaagtcatatcaagtattctgtcagtttcttcttttgcagccatccctcctgcaccttctaacctgctgtagctgggctggtgcctcttgcctgctgcacagctgttatcctgggatttcccttcaggtttattaggattctctttgcctctatctcttgtattagatccctgtttc

SEQ ID NO: 94107 - DNA, 1070 bp, Homo sapiens
gacaggatttcaccacattgggaagactggtcttgaactcctggactcaagcaatctccccacctcggcctcccaaagtgctgggattacaggtgtgagccaccgcacctggccatgtgtgatatttttaaagtaaggttgtcattatcacatatcgaggactcttcaacaagggacagcctgaacactaagctgccagaacacacttaaaaacttgatacttctggtacttagccaattggtaagaagctaaagagtctgccatgcagtccaacagccatgctgactaaactcaccagttctttcattgttttgatgttgaacagctgtctttaatacacttttctgtactcctgagaatgttctagttaccatgctgaaatgtttaaatacctacattttaaaattagaactaaaatataatgggtttgttaattaggaggacactggagagttggctgtgagaagttgtgactttgataagtcgatcttttaaaagtaagggcagttgctctacatttgacttctttgtgttctcaaatttaaaatatatggctgaagatgaaagattctgcacacctccacttattcattcccaaatcccacatttcatattaaattcacacaggatactatgtgatgcatatgaaccattttatatgatgcagggtacagtatgcacaggggataatttattttctaaatttgctattattagacttctaattactcagctggatagaagcagaaaggtctcattcttgtactaactgccgattttttttttttttttgagacggagtttagctctgttgcccaggctgtagtgcagtggtacaatctctgctcactgcagcctccacctcctgggttcaagtgattctcctgcctcagccttccgaatagctgggattacaggtgtgcaccaccacggccagataatttttgtatttttagtagagatggtgtttcaccacattggccaggctgatcttggactcctgacctcaagagtcccacctcggcctcccaaagtgctgggattacaggtgtgggccatcatgcccggc

SEQ ID NO: 94108 - DNA, 1242 bp, Homo sapiens
agtgccttatatgtactttctgggctctactgcctgtttcaaactgcaagtccataaaagaaaaaaaaaaaaaagaaacagtatgtcatcttagcatcccacccagcaactccacacttctgagcaaacatgcagttgtcatggccgggaaatggggtgttctcattaaaaagcactcctcatccatatttagatttccaattttcacagaaataggaatggggatactatcccttaggattatgaggaataaatgaaatagtgcaactaaagcactccgcataacacctcgcacatcgaagaactctttcaatgcttaaacataaattctctatcccatgggaaaccaagtctcttattcctctgcaaatccacgcagggtcccctgagtcccacacttgcctcagctttgcagctccctccaatcacagagaagtcttttagtaagaaataaaatcaaaacacacaaaactcaggtctctcgagacagtataattttcagatgaataaaagagaatgatatattattactgtactcattagtcacttagccttaagactatttaaaatgtaacaaaaatagatttatatttaagaaagccaaattagagattttaatggaaattttacttttcaagcaagtttacctcctcagggaaacagaagtgtgcgctctttctctagtgagagatgacaagaaataaaaactaattgaatgccatgttccctagagatgcttaacaatattaatccaagtattttacagaaggtaaatatattgtacagattcctttcataaccacagtgaatcctgactttcctccatgagagacgtgagcacaaaggaggacaattggaccaatcatttctagatatttcttaaattgcaggttttgtttgattaattaaaatgtgaagaactggggctattaaaaaataaaacacacatatgtttagacctccttggaaagaaatgttacttcttaagtctgaacaatctaaaatgaattccttctgcctgtcatctctggctaaataattggcagttagtggccgggcatgatggcccacacctgtaatcccagcactttgggaggccgaggtgggactcttgaggtcaggagtccaagatcagcctggccaatgtggtgaaacaccatctctactaaaaatacaaaaattatctggccgtggtggtgcacacctgtaatcccagctattcggaaggctgaggcaggagaa

SEQ ID NO: 94109 - DNA, 1036 bp, Homo sapiens
gaaagtttcttgtggtttggtcagcatacacacttctcatttcatttgatgtacacagccaaagtgggaattaaaaaaaaaaaattaccaactagttcagagagctaaattgagtctatcattatggcaaagtctgacccaaaattttaatttgtaattttagcatgtgtctcatgcactttggggagcgtcaaactaaatctacaattgccagaagccttgttacagtttaatgcacattaactaaaatgtgtacatttttagtgttcatgataaatgcagttatgaccttattacacttttggcattctttaagaaagcacattaagctttaatatagaaatatttaggttacacttgtgctcaagtaataataaaacatttgttcttttttgatctcatacattctctcctcaggtatggcccatctcctgtacgcttggagcgacctttggctacgtggctggccttgttatttcaccactctggatatactggaatagaaagcaacttacatacaagaacaattaactggagcaaagggagatatttctttgtgcagattctgtaagggctgggcagaaatgtgtatggtcaaagccaagcagttccatttacagctctgttttttacgtagttacaacatgatgtgattgtagctttttaaactatgaaacccctgagagattgtaccttctagttgaaataaagtatttataatagattgtggcttcagatgctgcttactgcttcttaaacctttaaggaacattcttaatacactttatagaattctgaggacaggttttgttttctttcaagttttgaactgcttcattacctataaaaggtctgggtatagctgtagcatttcatttgctttctgagagaaatggacagtttccttggccactgaagatgtttctcacgtaattaaacaacagtttatacatcttgatcctattcttttttttacagtgtgtttctttggagttaaaatggctatgatagcctcatcaaaaacagtcttcaatcc

SEQ ID NO: 94110 - DNA, 3349 bp, Homo sapiens
agtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgccaaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaatttagctctctgaactagttggtaattttttttttttaattcccactttggctgtgtacatcaaatgaaatgagaagtgtgtatgctgaccaaaccacaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttgaaaaaaaaaagaaaaaaaagttggaggaaaattttcatgttcttctgtgaagcttatttggtacactggagccatttctaatctttctctggggggaacaggccacagaactgtgttagaggtgaaccatcttaattactagttctattacctaattcagcttccttgtttggtctgctgtggatctgccttattgcatatgccatgcatcagataatggatgcatcagataatggtgttagacaaagcttcattgtgaacaacctaatgcattttagagaaacaatctcatcacattttttctagcctttcctacatttaaacttgctgttgcccaaattataattttttaaatgtctttggtgggcttctgttaattcacatgacttgagcttatagctatgtctactgcacagattgggtaatggaacactaaacttttatacttgaaaatgacagccttaaatgctcatatcagtcacaaatctaggatgtactgtcttgttgtatgtgagctttgtagagatttttaaaaatataagcatcaccttcccattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgcttatttttagataaaattgaaaggaattgtataaatcaattaacatattagctgagttgtccaacacatggtataaacgaattacaacagtaaactattacacatttccaacttgcctttggggatttatgaggattttttttggtggggggagggggctccaattcatatctctgaaacccttcacacttggtttactaattcaaagttagaagtctagaatttgccctgccctaacagaaacagattaggaatttgtctacacaaactggtgtcacctgtttcttgactgggatttggtttcctcattataaatatgggaggtagaacagagatctccaacgtctctcccatttatcacagtaattttcttattcacagtaatcattgttggatgttaccttttcagcttcacattctcaagatggtaaaaatcatgtatatagattatcagaactctaagcaaagatgactgtcacatctgaagctgaggtgccttaggtactctactgaccttgatgggtttggagttccccattgcttatcaagagctttttaattgctttggttctttagtttttctttttgcaaaaatccttcctgtcactttaactaaaaaccaaagatttgttttctattgataagcagactagagaaaaactgccttattttcagaagcatgtcttcattcaaagcttaggcttcaatagaaattcagactaatcactgaaatgactatttcaaactagtgaaatatctgggaaataaactgcttcaaaaatattttactgacatgaattttgctagtgaatacaaatacactgcctcaaataaggccatgtatgaatgaacttacaagatatttgagttaatcagtgtttgcatatagagaattagttctaaagttcttaaaaataaatttaggggctccctgaaattttatttaatactttgctaacttacactcttgttttatctccacaggtacattttaggttagctcatggtgaattctatttacaataagtggagcttggattaatgggttttgttatgaattatcttagtgactttagacactgtttccatttgatttttaactatttaaaataccaaattaaataccagtttgttggttgttacttttaaatgattgttactttaacagtgtcccttcttaacacatggggttacaaataaaatactatgcatagtttactatctacgtaaagcactgaactttttaccttagtagtttttatttattaccctatgtaaacatttaggataatactctttcctctatttatgctgagagtctactaatcattggcaaagtatgagtccctatactctgttaaaaaaagctcactgttaaagtatagggagaatagtaatccctcatgaatcccagctagattccaatttgggttactaaattgtattttaatcattttgtaatttcagtatggctctttgttctcaaacacatacataccaccacgcacattcttttaaacagctgccacacctcacctccaacagaatgccaaaaatgaaatgttaaa

SEQ ID NO: 94111 - DNA, 1046 bp, Homo sapiens
gataaggaaatagttttaaaggaaaaccttaggatctaattatgaaaatacctgattaagctaggatttacaaatgaattctgttgccatagtgtagtttaaaaatttttagaataattataagaaaatcagtaggaaacttgcttgaggaatagttcttagtgggcagcctccctccttttgctgttccctattttgataatctattttgatcttcaaaaatcatgaaaacggcccttaaagaaattctcttttaaaaaaatgacagggttacgattaagaaatgcttatttcaggaaagccaaggaggtactcttgtaagtacaaagcctgacccatcattaacagtcttcaaagccagtccacattttaatttgctgatggcatgcacttcttgatttacataacatgaataaccaagtgttccaagccgtaacccttcattagacaaaattttttaacatttcatttttggcattctgttggaggtgaggtgtggcagctgtttaaaagaatgtgcgtggtggtatgtatgtgtttgagaacaaagagccatactgaaattacaaaatgattaaaatacaatttagtaacccaaattggaatctagctgggattcatgagggattactattctccctatactttaacagtgagctttttttaacagagtatagggactcatactttgccaatgattagtagactctcagcataaatagaggaaagagtattatcctaaatgtttacatagggtaataaataaaaactactaaggtaaaaagttcagtgctttacgtagatagtaaactatgcatagtattttatttgtaaccccatgtgttaagaagggacactgttaaagtaacaatcatttaaaagtaacaaccaacaaactggtatttaatttggtattttaaatagttaaaaatcaaatggaaacagtgtctaaagtcactaagataattcataacaaaacccattaatccaagctccacttattgtaaatagaattcaccatgagctaacctaaaatgtacctgtgg

SEQ ID NO: 94112 - DNA, 1011 bp, Homo sapiens
cttaacccagcagttaaaggtgtaaactaagattaaattatttaattttggatacattttagtataaattcttaaaaatgtgttccaatataataaatattacttataattttgggggagatttacactgtcacagataacatggagaaactgacctatctgcaaatcagaacacctacagacatttagaacaactcacaaccattaggattactgtctctctcgagataaaaaggaagataaaatccagttctcaatctctcatgagctacttttcaatatgtttgttttgttaattgtgcttatcacaaatttgcatttgcatgactgagagagttcatctttcaaagcctgctgacctactggttataaataatcatttatattctcctccaaaattggtcttgaacagtatgtttttccagatattcctaaagtaaatgttattgtctgatacaggaatacatgcacaaatgaatctactcattgggatacatttctctagttaaaaatctacactcatccatgtatacactctcctgtgactaagaatactactttaggaagagttatttgcgaaggggtgtgtagttcctggtctggaattcttgtcaaaatgacactaaaaggttctggtcacaactcgtgcaaacgagttaacttggccagcattattctctctaacatgaaagtcctgttagcagagcattatcaacatgattaccctacgatgaacacgccttttcaatccaaaaccatttcatgccagttcaatgttaacacatttttctcatgcttgaaacatacaaaccatattcatataaatgagtattttattttggtctaaaacacagtatcatccctttggtaatggaaataccaattaacgtaaaaacctgcagctcttcaatcaatcaaatccataatcttagttttaatctccctccagcattttgcagtaattcatgtagttataatcctatgattcctagtttcaacttatgaaagaat

SEQ ID NO: 94113 - DNA, 1022 bp, Homo sapiens
accatgaggtttttaaactcacgttttattaatgggtaggcaggtaacatgatgattaggagttctggcatcagattactgggttgaaatcctggctttgtcacttgctagtgaggatgaaataataaaatccctctaaaatacctagctcagcacctgacacatggttattacttaattaatgttacaggcatttgtgacctagaaaagacatagtttaatgactatatttttagccttcaaaaaatgcaaattccatgatttatttgagttctcatatattagagaatatgttaattgtctcagtttgttgttttattttttctgcccagcagtctttcagttggtagagtggactgttaatttatctatttctctggtatttagttatgccaatttagggtatttggatttcacataattttcaatcctgtctgacatttcagatgacagtagaaagaaaacgtagcacttatagatctctccatgtaccctgcagggggcttggtactgtgaaatgagtaacttaatcctgacaaccgtagtgcaaggtaggttttactcccattttatacactagaaagtccaagtgtgagaggggaggagtacacatcttgcttagcattactcaggtgggaagagggagacttaagattcacatgagagccccactacaccatgattcttttcattgctggaaactaaaacatagcttttctttttaaaaaatggtcatagcttaggtctctttggaatagctaaattacttattatatttcatttctttccccacattgttttcattacatgccttgaccgttgtggtggtgtctgtattttaggccgtaatttatttgtaggagaatatttaaagctaatatgcaatgattttgtccctaacaaatccacacatgcctttaaactatggacttcagtgctacaatctttaaaaatatttgaaccaaataatcaagtctcggctaggatgcttatttcttacgaaggtaaaaaggaaaattgat

SEQ ID NO: 94114 - DNA, 1026 bp, Homo sapiens
caggttctcactctcttgcccaggctgtcctctaatgcttgggcctaaacgatcttcctgcttcagcctcccaagtggctgggactacaggtgtgtgccaccgagcccagccagtataggaatttttaaaaactaggttaatagctgcagaaatttcctattttcaactttgatatttattgcccttgtggtcttatattcatattttctgaacttgattgatggccaaattgaatgttcctcttgaaatttttagaagcagatagcaaggtaatttttgcagcagcggcctgtgttatcaagaaagctcacaaacatcagatttttcgtcttgtatcacaataagataaagctgatatgctaggtaaagcactgtgaggtaagtgctctttttatacccattttacagatgaggaaactgacacctagagggtatgtaacattcccaaggtcactgaacttacagtgatgactgtatctttatcttaatattaatgactttgtagtatgccattatatactttataacttatttaacaaattcactattgatcatttagattattgccagtattttgtgataataaacactgctgtgataaaatctttgaatctatagcttcttgaatttttctaattaggttcacagagtaattactcccaaaaagaattatggtattaaaaaataaatgtgctttctttttccaacatgaagataatttttttctgatcacgaagataatgtatatttatttagaaaattaaagcaatattagtaattctaaggaagaaagtaaaaattactttcctccccaaccacccagaggaaacctccatttgcttttggtgataatttttgcagctgtctctctccatgcctgtaactataatattcatgttgtttttaatctgctttttcccctcagcagtatattatggagctcattctatgtcaatgaaaacttacatatatgtaatattcgattatttgtgtaaaatattgtaccagttttttattaaagaaca

SEQ ID NO: 94115 - DNA, 1049 bp, Homo sapiens
tagaaagatacatacatcaatctttttttttttttttttgagatggggtctcgctctgtcgccaggctggagtataatggcatcgtctcggctcacgacaacctccgcctcccgggttcaagcgattctccgttctcagcctcccgagtagctgggattacaggtgcctgacgctgcgcccagctaattttttgtatttttagtagagatggggtttcatcatgttggccaggctggtctcgaactcctgaccttgtgatccgcccgcctctgcgtcctgaagtgttgggatttcaggcgagagccaccgcacccagccacataaatcttattgaaacatctctgatcgtaaagttgcgttgattgaaaaccttcatggttccttagtttgatatttaagaattttctaaaatcctaaccctaaatctatcaccatgataccatttcacaccaattacgatgactgtaataaaaaaaagataatgacaagtgtcaggagggtgtggaaaaattggaatcctcatacactgctggtgggaatataaaatggttcagccattttggaagagtctggtagttagttcctcaagtgattaaatataagagtttccataggacctaacaattccactcctaggtgtaatcccaagagagatgaaaacatatgctcacacagaaacttgtgcataaatgttcatagcaacattattcataataaccaaaaagtagaagcaacccaaatatccatcagctgttgaatagataaaatgtggaatatcccttgaagggaatatgattgagccataaaaaggaatgaaatattgatacatgctgcaacatggatgaaccttgaaaacattatgctaggaaaaagaagccagtcatacatgctttatgattccatttatatgaaatgtccagaataggcaaatccagagagacagaaagtagcttagtggttgcctagggctgggaggaaggagaaatggagagtgattggtaatggttaaagagtctggggatgatgaaaatgttctaaaacttacagt

SEQ ID NO: 94116 - DNA, 1187 bp, Homo sapiens
cttattagaaaataacatccagtcctcaaaaggcagcttcaagacagggaaaattggggctagttaagataggatgtgtgcccatgtgaagtgtgagcaagagaaaagaaacggcatgacaaccctaaaaatgcactatagaagaaggaaaaggggtgtgcagaagatgaagaatctggcctgaaagaaagtgctaccctagaagcaaaaataaacaaaaaaacctccacacagtttaccatgaaaaatagtactaaggatatgaattgaataaattaagagcaaagatgagatcatgaaacaaaatgacgtggagaagaagattgcagaattagtgaaataaattgagaatgcaaaggtcactattacaggacataaattaaaaatatcaagaaacagacaaattagaaagtcaggttttagcatggaagaaaggtttgagctaatcaaaatgaatgcggggtagggagggggttgggaagaataaagcatttagagaagatgtgataaatatagaggagaaatgaaagggatgcaaacaagactagttagtgcctctaaaatacccaacaaaaaatgattcaaagatgtgatagaagacagttttcacaaatgaagggattctccagtttgtacatcaaagggactcactatatcaagaaaataattgaatgaattggagttgtagaacaatgtaaataaaaactaatacaagcaatggaagttgaacagtgcagggaggagaagtgaagaaaatataattgtacccttcatatcccagctattctagctgtccccagatactgagcctgttgggtacaatctctttggggaataagttttaaacgaaatcctacatctcaaaccatgagttcccaccttacacctagcccctttcccctggttggcccaaagtactgggagccaggcttataccatctaggcagaatattgaaatatttctttcgagggaaaatggtactgacattttgggattctctaaaggaaagtcaggttcctaccccgtccctagttctgtgcatccccgtgcttgaattataagcatccagtcagctgttttaatgtttcattttgttgttgctgttgtttaaaaatagtgttattgagatataactgtataccatagaattcactcaaagtgtataattcagtggtttttagtatag

SEQ ID NO: 94117 - DNA, 1043 bp, Homo sapiens
caggaggcagaggttgcagcgagccgagattgtgccactgcactccagcctgggcgatagagcgagactcagtcttaaaaaaaaaaaagaaaagaaatttccacagcctccccaaccaccaccctgatcagtcagcagccgtcaacatcaaggccacatcttccaccagcaaaaagattacaacttgctgaaggctcagataattattaacatttcttagtaataaagtatttttaaatcatgtgcatttaaaaaactaatgctattgcccacttaatagactatgatacagtagaaatataacttttatatgcactgggaaaccagaaaatacatatgactcactttattgtacaatttgctttattctggtggtctggaaccaaatctgcagtatctaaaaggtatgcctgcacccaaatattacaataaacatagcacttttccttggaaaaggtttccttggtaaaggtttgcttctggaaatagacatgagaagggttgcctattgtgagttattgcgaagtgatgagatggttgttggaaatctgagggaaaattaacaccagatgtgcgtatgtgtggctcatgacacgtagtaaactgaggtagctgggaggtggttattttttaaaacagtattgagatataattcacacaccgtacacatcatctatttaaaatatacaattcaatgactttttgcaaccaccaatctacttactgtctctatagatttgcctatcctggaaatttgttataaattgggtcttatgtgatcttttgtgactgcctttttttacttagcataatgttttcaaggtttatctatgttgtagcatgcttcagtacttcattcctttttgtggctgaataatattccattgtatggatatatatcaaattttgtttacccatttatcagttgatggacatctaggttctttccacattttgcattttggttgttgtgaataagctgcatcaaacatttgtgtataggtttttttatggacatatgtgtttatttatcttgggtatgc

SEQ ID NO: 94118 - DNA, 1626 bp, Homo sapiens
tgagcacttagtctgtgctctgtgttattgtgttatgctaagctgtgtgtggtttctgaagtattaggaggaatctttttttttttttttgagatggaacctcgctctgtcgccaggctggagtgcagtggcatgatttcggctcactgcaacctccatctcccaggttcaagtgattctcctgcctcagcctcccaagtagctgggactacaggtgcatgccaccatgcccagctaatttttctatttttagtagagacagggtttcaccacactggccaggatggtcttgatctcgacctcatgatccgcccgcctcgcctcccaaagtgctgggattacaggtatgagccaccacacccggccttattaggaggattcttttgctgaggagcttatctgttcaagggacaaaaatgagcaaataacatcagattacaaatgtgtaaatccagcaataagtggtgtaggaactcaaagggacagagcatcagtaaagaatggagggggagatgggaatgatctatgatggacttaagtcaagagtatatgatttggtgagaccaagaaggaagagaaaggcacctcgtgcaaggagaatggataaaagcattgaaactgaaatgaacagggtatttttgtgtgatttgaaaggtaacagcccaatgagagcaaaagatgcatgctgagtagcttggcttcataaattaccgacttattccctttgaaatcagtactgtttgggacgagtgtggtggctcacgcctgtaatctcagcactttgggaggccaaggcgggtggatcacctgaggtcaggagttcaagaccagcctggccaacatggtgaaaccccatctctactaaaaatacaaaaattagctgggtgtggtggcgggtgcctgtagtcccagctacttgggaagctgaggcaggagaattgcttgaacccaggaggcggaggttgcagtgagccgagatcgcaccactggactccagcctgggcaacatagtgagaatctgtctcaaaaaaaaaaaaaaaaaaaaaggaatcagtactgttttcccttggaaccgtcttctaatattcataaagtctctagaaaacagaagtgtaacaactgaaagcattttctacattattaccataatatcccaaatggtattaattgcttttagccttttagtttgaaatttttaaatagtgaaattggattgaaatcttattactttggattagtgatttctccagttttcaagtctatgtctaataatgggtgtatttgggggaaatactgtcatgtgattttacaattagttctgctataatgtggcctgtgtgttcctaaaaatcactacgctgtacaaaatgggcagtaaaaaccacagagcttatgggaaagatggggttaggtcataacactaaaacaattcatcagtgacatgtagagagaagatgggaacttaataaaaatggtagcacagttttacacgtttaaaatggttacaaaatacaggcatacctcattttattgttcctcactttattgtacttctcagatattgctcagatcagatactgttttttataaattgaaggtttgtggcaaccctgcatcaagcaaatg

SEQ ID NO: 94119 - DNA, 1100 bp, Homo sapiens
gtacacacactaaactgacaggttattcttttctagatgggagagaacaagacctttgtaatggaaaatggtggttcctgtctaatccattttaaagcagaatgaatgtgtctggcacagtggttctcaaaatgtggttttcaaaccagcagcatcagcattttatcaaaatgcaaatactcaagcttcagtcagaaactctaggggtagagcccccaccaatctttagtttatccagctctccaggtgtttccaatatatgttaaccactagttgtagagaaccactacaactagtattcaatagtggttcaatagtggttcaatagtgtattgaaccactagttgtagagaaagttccagagagactattgagcagaaagctaactatctagaaatggattttgtttgtttgtttgtgtttgcagtgaaagtctcagcatggatcctagggtctttaacacttctgaaatctatcattaaagcgaaatacttgctagattgttttttaaagctacatgttggtggtaaaattatttatagtcatcattttggtggcattcatgttacctttcaaagtaaagcataggaagatatttcacattttatttatataataaagattatgtatgtgtatgtttacctttaacacttttttaaaaagtaatctttttttttttctaggttggcattggaaacatttttatttgcagttattttgtctacttttactactgtgccttgcttatgtttgttaggaccaaacctcaaagcatggctaagagtgttcagtagaaatgggtaagttttaattttatattataatgatattgaaattaaaaaataattaatgaagtatttttctattcatggcagtttgctgattattctgagtgcttctcattgctgatggtgctcagagatgccttaaggggtcactgcaattagggactggggacagggcaggcagaactacaagcccctccctccacgttagcaagatcagctctccttttttctgtatggtagaattccacctagccttttgtttgtttaaaaaaaaaaagaagaagaagaaataaaaaaaaattctactattaa

SEQ ID NO: 94120 - DNA, 1016 bp, Homo sapiens
gttcaggtcttttttcatacgggttgtgtaatatgagtgtgatttcaagaattatttagtattttgctttttcagtgcagttttcccaggaattttgttttaaaatgaaaaaaattgttattttctgcagatatttcctctatcatcgcataatactgtattttttgtatcctagctctctgatgtcaatcagtatttgataaatattgattaatgacatagctctatattaccatggaaacagaacctcttttcgactcatgtaggtcggatgggtagaatatgggcggaaggtggtatttgccttttaggcttttttagtctgtatcgaaggctgtgtatgtgacggtacaggacatgtgatctgatttgagtatacccaagaacatttgaactgttttacacattatgggaacaagttgtgtttgtagatgaaatggaagaatttattgtcctttaagcattatcttgaatcttcaggttattcatttctcttttaggtaactggatttttgaaatgctgtatctactttcttatgtcttgtttctcctttcatgtaatttttgttctgtatggagcaccactgatagagtaagtttgaaatttttaccctaaatttatattttaaaacattcatttaccaaactgtgtgctaattcttagcaactagagaaaaaccatgatgtgcatcattaatagatcaagtaaggacaccaacatcattagcagtgttattcttttttaaaaaaaacagcagaataacttaatttattaaatactcttgttacctagccttctagtatccaattgcatgttgagagaagggagagtagagaaactatactataccaataagtatttggcccttagaacctctgaaagaacttactatgattatatgtgtaagttataattagcatatcagttcttataaatgtgattctaaagtacttgaatggagtttttcttaacaaaagtcaatagattcctgtattcaaatactgaataagctggt

SEQ ID NO: 94121 - DNA, 1221 bp, Homo sapiens
aaaaaaataccaacaattcagcctaagtatatttgtggagttgttggaattataacctatgcattctagaaaccgcataaataaactttggttataattgcaacaggcagtagataatttaatccacacagttgatttcatctctttgatattggccaaaaaagtttaaatgaattgctttattggtcctaggacatgacccttttgcagaaaccagtcacaatatttaagaaattagtaaatttgttctttttaggctctgagagatgtttgtaccatattaagaaaatcaaaggtagaatagaaagctaagtctgtatgtgcatctacacgtctgcatcttttgtgttttgaaacaaatacattgctcatagaaaattgactttatgacctatttttaggggtcaaaacatttaagacaatggaaaaagtcgttattgcatatgctcttcttttcttgttttttgttagctagccatccaagaaaacaccatgaaagataacgatatcaagagactactgtatacccatcttttatgcatattttcaattatcctaagtgtcttcattccatcactcttcttggagaacttctcaatattggaaacacacttgacatggttgtgcatctgttctggttttgtaactgctgtcaatctagtactatatttagtagtgaaaccaaatacatcctctaaaagaagttcattatcacacaaggtaaggcttatgtctcaataactgatttttggatggagctagtgtttcttttaatggaagaataaagtattcatcaagtctttattagcttatttatagtgagcaaagggaacctgatatttttccccccaaattggtaggctgttacttggtggaaggctgcccacaatgtttgattgatccttgccttgcattaattatggaattatgacttcttcagagcatattataatattgtgagcctatatagtcattgttttatgtcaccattgaaaataaatacgtgtgacagtctatctttaaaccttactcaataagacattgcagtttatttttattatttttgcatttctgaaagccacttagtgggattttcagaaattgcaatataagcctgtggtaatgcttgtttccaacatggccttccttgactaaacaattttcagatattagaatcaattttccagaatattcactgcagtagatattcacttggctatt

SEQ ID NO: 94122 - DNA, 1065 bp, Homo sapiens
tagagtctgtatttaatttctgcactcttctgaggagaaatttttttaatcttctgatttttatattcttgaataaatgctttaacccattttaccttcattatcattaattacttatgatgaagtatttaccttcattattattaaatacatatagtaaagtatgttttcaatgggtagaaaaataaacattttcattatattcaaggtctatgacactgatatagtggcttctagattttatgctatatagagtaaatatagacccattcctaaagtactcccttgagtctgagaaataaaatgattgtattttatacaaatttttactgtttccctaataaatattttctttttaagcagtatcttaataacctattaaatgaggatttaaaaattagatatagactactattttggtagaaagtcaaggaatgaacttcttaatattatatgttaaatgtatagaaataacccactaaaatatcttttattctgatacagaaagtggtggaagaaagctgaatgaaaataaagctttgacttcaaaaaaagcaaggtgggtaagaggatccatcgatgggtcacataaatttccttcttttagtattaagtctgctggagtgaatttgatgtgcatcattccatttgcaataaaacagagttaggtggttcctagcactcagaaccaagctatctgttataatcctgctggttttaccttattcctcctcactgtatcaatatatgaagatattagtgttattctcttacagtttcaccagaaaacatgacttttattttatctccttcttaattatcttatgaatcagagacagcaggcaaatgtggaaagatcataagctttggagtcagacctaaatttgaatctagactcactgtctagccttatgaccttaagcaagttaagcatgtttcgtgacctttctaaactttactttttcctgagaattgcgtaaaaagtgtcccatcttaaaaacaagtgtttgataccacactttattatatccagcttaaaaattcggctgggtaaggtgactcaca

SEQ ID NO: 94123 - DNA, 1084 bp, Homo sapiens
ggtgccccagtgcccgcgcccggcgcattccgcccccggctgtcgcccccgcaccgcggcggaggcagcgccggcctctggctgggatgggctggccgggaaaaggactgctagcccgggccgcgagccccgtgcagaccacgccgctcacagtgggagcttgcgcttagtaggctctcgatgcatttctgtggaattgtttttctggttggaggaacgtggggttcctaaggggaagggggtcgtccggggccagtaggagggcatccgtgatcggggtcgtggtgggtcgcggggaggccaccggagactgaagcagttacacaggctgcagggaagggagcaccgaccaagtcacttggggctccaagagcccgatctgggggtcttcaaggtcgaggagaaaagatcctcttggggatgagggagggaaccaatgagtacatatgtgggaaatgaattgagtgccccgggaggtttaactaaccaaggtgggtaagggatgcggaggcgggagctggaagacccctctgcaactacttgggctcctaagagtctttgatgtggggtttgggcatccgagtagcagaagcggagtgatttttgtggagagggaattgcatttaaagaaggatgctaaaaaaacagtgtaaatacatcttggtttggttccgaactttgaaaggcttgagggattggagtcacaaggaaattttgacattttcttgtggcattccaactaaagggtgcctggctgctggactttgtcagttatcttttattgaaaaatatatgtgtatgtttgatggtattctatcagtcacaagtttttctggaaattatcataactacaccttgaaattcttgtagcaacctctctatccatagtggtggcttacttcttccctatttaacgtttagaatggattgtgctattatgtactactgacttttattctagaagactaataagtaattcacattctttcttttccttactttcgtttctctacaagatgatgcaaaattgaactacggattctatataagttttaaaatattttaacttgtgttgactgggaag

SEQ ID NO: 94124 - DNA, 1145 bp, Homo sapiens
aggagaaaagattggagacatttaccaaataattactgagcaaatacaaatgctcctcgacttacaatggggttagtcctgataaacccatcctaagttgaaaatatcattaggtcagaaatgcatttaatatgcctaacctaccaaacaacatagcttagcctagcctaccttaaatgtgctcagagcacttgcattagcctatagttgggcaaaatcatctaacacgaagtctgttttataataaagtgttgaatatcttatataatttaatgaatactgtactgaaaatgaaaaatagaatggttgtgagtttaaccaaattgtaagtcagagactgtttgtaatacacatggcaaggtgagtgaatgaagcaattctctttggcttgtggtagatagatgacagtcaaggatgacatttaaggctctgctctagttcaagaaagagactaattatatgatggtctgaattaaggaatttgtagtggggttggaaacaagagcactgctgatttcagagatacttaaaagtttgagtcctccagattttgttaatgttagaaggtgttagaagttgagtatgagtctaaggttcctggcttggcaatagaataatatatgcaagtttgggagagagagaatactgagtttaatttcagataagtaataatgctttttaggtaagtaatgataccacaatatcagttggaaatacgggtctggatcaggagcgtggtcaggattatagatatgattttgaaggcatatattttgtagctgaaaattatgaaaatagatgagtaatgcccataatatctaaatgataatgcgttcagaacaaaaagtaactgccattgctggtacttagttcaagagtttcataatatttacctattacccattgccaccccaaactctgttacaaaaaatgtagaaaaatatttgctgccagaaagccagaaatatttgagtgtccttgaaacactgtaccagttgggatctttcttcctgccttcggaatcctggctagccatccagtacaacacaggattcttaggcaaatgcacttccttatccctcaactagagtttctttttggaatccatgtttgcttctttgggctggtgaagtggtctctgaaca

SEQ ID NO: 94125 - DNA, 1778 bp, Homo sapiens
tccagtgaacatttcctttgagcattatgtaggcactcaaaaagtttcagagtttggaccattttgaatttcagatttttggatttagggatgctcaacctgtactcacatagcttcttgaaaggaaatttaagaaaagtacactcacctatattaagaacttatttttctagcaagtaatttatcacctctcccaatcttagcttctgaaatgtaaactaagaaagttatgaagaacattatccaggtgttaaatcttaaaagtagatccaagagtggaattagagaaatacagtggcctttcacaataaaagactagattttaagagtctcttaattatttggtgagagacacaggacagtacaatctgtgaatttctattcttttgaactatggagattttatcatgactggacaatgagaagaaatgttatagctgtagcttgatggttttgcttttataaaattcttctggtattgaagagaaaaagattattaatgggtaaagtaagaaaaattaactccattcctactgggtgacttttattatcagatagcaatctgataactgattattattagtttggtgacaataattatttttggatgcttggttgctaataatttgcctgatgcctagaaaattctgatttggggtctgtattctagtgggcatatagcccaaattagcaatcagattcttctactaaaattatctgatcaagctttcagataattcatgcatttacatagaatacatatcagtggtttaaacagaatttcacagacgctttcccattgaagctgattgtttggcaaaatggtgagtcatgctttactggccaactcacacaccagttgttgatataatcagttacctgagccaagatcaaagcagcagaatagaagatagtaccttggctctgatacctttctgtcctttctaaaaaaaaaaaaaattgggatgtaaatttccatccctctcctatgtgctttgggttttaagaagcaatataagaccattttttatctttagaatcttacagttgtagagataaaattgatatgcttgaaatgatctgaaaaggtgagaacaaattgtggtgttaactataaacccttttagagaaatcaacagggagacatttgaacttgatgtagatgttaaaattagaattgaatggtagagggccaactaagggaggtatttcagagtaaggagaaattagtttggataaagcagggcctgattatgggtggtaatgagtgaatgtgaggcgcaagatgctcaaactgttgaatgttcctaaaagaaacagaatctggcagtataatgagtccaggaagacaggagagagactaaggtgttgtagaaatctaggaatgagacaaaaatctggacaaagttactggcagtgaaagtagacagaaaaggtacactggagggacatcttgaaaaaagaaactgttgaactaggtaacattaaatatggtggtattaagtggaggaagagcaagatactctaagattttcccaagaaatcaagtacaatcctggtaaataacatttcaagtacaaacctggggagacatattgttaattttggatatagttaatttgaggtccgatggagaatagccagattgggacagacttttaggctgttagtggactgaagagtgtgtgttgaatgtgtggacccaagtgtgtttcccatacacatccagttgtatttgaggaggtgaaaattggtcctagagaatatttgtttataac

SEQ ID NO: 94126 - DNA, 1060 bp, Homo sapiens
tcctgggctcaagcgatcctcctgcctcagcctccaaaagtgttgggattataagcatgagccactgtgtctggacaaattttcctttttcttatggtgtcagggagggtagatccaaaaaggggcacgcattgtcctgatcagtttctttctttgtttctttcttggattcattacaagttgtcaaattattttccattagttttttttagagctaaaatttggcataggagacagtagtatcttttaagtttgttaaagattagtaaatgtattctaagcagttttagataaaaagtaaaaaagttgttattatcaaaacattattttatttattttagtccttagagtcttcatatttcttgtgatacttgatctaaactgctggggttataaagtggttatcctccctagagaaggaaatggtgcagattccatttgctcacttaccattggtaactgaatattatttgtaaattattagcagaatcataatgagctcactgttaagtagttcccctaatcagagactcttttctggattaagctgtctgctaaattcctcaactgagagttgttttactttgttggtatttttgtttatatttaaccaccttttatattaagggagatttgtgggaagcattgatgccctgtgctctagtaagcatgatcagtagaggcagtgctgacagtactagtcacatgtggttataatgctgagtaaaatgttatttactttactaagttggtttgcctaacggaagtagtctccctggagatgggatatcaatgcagaactgactcagcaataatctctccctagtcataaaacagccttactttttgttactgtcactaacatgaactaacatgctttggattggttgtatatcagaagctatgatttttgtcgccctattatatacttagttgtttttaccttatgtcatgttatcctggaaaggccgagacttaggtctctaacacagctagtgggagcttgaatttgattttaggtcctgctaaatctaaggcttatgttgtttgtgttatacca

SEQ ID NO: 94127 - DNA, 1043 bp, Homo sapiens
ttatttcgtgttttctctctgaaacagcatctctattcatgcatttgcctaagcaagactcctagtgtcattttcaataccactctctcctcatttcccattttcaattgatcttcaatcctatagatttgacatctgaacatctcatagccatctctcctatcaccatcctagtcaggtgcttgcttggactcctgcagtagtcttcagtgccatatcagcatccacccttgctctcttatcatggattatgaggcttacctctccaacttcatcttgacacacttcccttcactcactgggttgtgttaacttcagccattgttcatgtcatgctcatttctgcttcaggacttttgcaaatgctgttccctctgcctatagtacattgtcctgattcatttcttcttatccttcaggataaaattttgaaacatcacctcctcagaaaagtcttccttgctccccaaccccgaaactaggtcacgtttccctgttatctttaggactttgttacttgctactcaatcctggtactactacaaattttaattatgattgttaaggaaggcttatctgattcagtcagaaccagttgtctgtaaagtctaataaagcaatacatcatagaagggatacataccttaagtagtttattctaattttaagaatataactatgttcatttgccagtcttttgattaagaagctgttatcagaaaggggttcgatccagaccccaagagagggttcttggaccttgcgcaacaaagaattcagggtgagtcaatacagaaaagagaaagcaagtttattaagaaagcacaggaataaaataatggttactccataggcagagcagcagcatggactgcttgactgagtatacttatggtatttcttgattatatgctaaacaaggggtgggttattcatgagttttccgggaaaggggtgggcaattcctggaactgaaggttcctccccttttcagaccatgtaaggtaacttcctgacattgctgtggcatttataagctgtca

SEQ ID NO: 94128 - DNA, 1045 bp, Homo sapiens
cctctacctaattcagcagcagaagtatttcacttttattgagtatttcagagtcattcaactttataaaactccccactcttccatacttcattaggttagttgacatttaattaaatcacatagttacactaatataaatggcatgaacaggtttggaacctaacataactaaaagtgtaactcactgctgggaactggaagtgtctgggtatactagattagaggactgcacctctttttgagtgtacatggtctactgtattaatatatcatgtacactgtaatagtgtaactctaaggttgaattatatgtttattttttacccacaaaatagcaattttatatggttcaacctaatattaaataacagtataaaggataaatggccatccaattagataataatagatcctgtcacaatatgacgtgtaaataacaattaaaaataaatcatttttaaaaggccagaggattcttagattattttaagaagctgtagttatgacagccacacattcctgaaattctgggtcagttttactgtcaaacgtattatctttttctaaaaattattgaaatgccaccaaaatatcaatcaaaacttgtctcctaaactgcctcttgtgcctgaatttgatacagaaatacttttaatcagtctacctgtcccaatttttgttactgtaactgaaggactttctattggaaaggtgttacagctgagaagtctagatagactgaagaagaggaaggatttgagttgtcacattcttcgtctttatggcattcagcattaagaatataactgttatgttataactgtatattttaacaatataacataattaggtaagtataatagttctctctcaatgtattcttaaaacatgttaaacttaatttatttctcataaagcatgggttaagtcccattgaaataaactcctgggaattatttcaattattttgttttgtgtaaattttgtaatagatactagttggcattaagaaggaccattgactgtactatttcatttttat

SEQ ID NO: 94129 - DNA, 1032 bp, Homo sapiens
ttttgaaaagttgaatacaaatgtgtttcaacaatatggaacatattttgcctttgtaatattcaaattaaggaaacaggttgaagcacgggaaaaagaaaccagagtttaagagcgtttattttctttcacctgagttcagaatattctgcctgaaaggacttgggaagtaatgactggcttgaacaaggtcagtgcctaaaaggcccggtggccttcctgctgcccaacagaacacacggcctcatcacttcagcagggcagcgtaggtgaacgcttggccagtatcactgaaattctggacgggaaggggtgtgggcactgccttagctaccttcacatgctactttgattaatttatttttctctttttgctgttttgtctttagattttataatcaatggataaagtgggaaaaatgtggaataacttcaaatacaggtgtcagaatctcttcggtcatgagggaggaagccgtagtgaaaatgtggacatgaactccaacagatgtttgtctgtcaaagagaaaaacatcagcataggagactcaactcctcagcaacaaagcagtcccttaagagaaaatattgccttacaactgggattaagcccttcgaagaattcttcaaggagaaatcaaaattgtgccacagaaatccctcaaattgttgaaataagcatcgaaaaggataatgattcttgtgttaccccaggaacaagacttgcacgaagagattcctactctcgacatgctccatggggtgggaagaaaaaacattcctgttctacaaagacccagagttcattggatgctgataaaaagtttggtagaactcgaagtggacttcaaaggagagagaggcgctacggcgtaagttctgtacacgacatggacagtgtttccagcagaactgtaggaagtcgctctctaagacagaggttgcaggatactgtgggcttgtgttttcccatgagaacttacagcaagcagtcaaagcctctcttttccaataaaagaaaaatccatctct

SEQ ID NO: 94130 - DNA, 1014 bp, Homo sapiens
caaattacagggaatccctgttactggggagtgatggaccgttatgaagcagaagcccttctcgaagggaaacctgaaggcacgtttttgctcagggactctgcgcaagaggactacctcttctctgtgagcttccgccgctacaacagatccctgcatgcccgaattgagcagtggaatcacaactttagtttcgacgcccatgacccgtgtgtatttcactcctccactgtaacgggacttttagaacattataaagatcccagttcgtgcatgttttttgaaccattgcttactatatcactaaataggactttcccttttagcctgcagtatatctgtcgcgcggtaatctgcaggtgcactacgtatgatggaattgatgggctccctctaccctcaatgttacaggattttttaaaagagtatcattataaacaaaaagttagagttcgctggttggaacgagaaccagtcaaggcaaagtaaactctccggtccccaaaggttgttaactaggtccgctttcatgtgcatcagacagtacacctatagcaagcacacgtagcagtgttaggctttttcatacagtatgtaagcttagtgttagtatctgtcagatgctacctgctgttacttattcagataaacatggtgcctattggaacaatagcggatagagctacaggtgttcagtaagactacaaaaacattttgcctatttcgctaacagtttggtttttaatggctgtggtatttgagtgaggcaactctggggcatttgttatgaagaattctatttcttactgaagaacaaattattaatattggatgagtatttcaacagtgtgactaatgtttgaaattattttttctaagagtttttctataaccttccaaaagtcgtgatgtttgtagttactataaatcaagctttggaagtccaaaaagaataaaagactgccttccttttagaaaaaaatgcaattttctggccacaagggcatagtgcag

SEQ ID NO: 94131 - DNA, 1046 bp, Homo sapiens
aataagctaactctaaatttaatgctctacatcttatcagtcataattatatatactgtggaacagtatctgtagttactgcaaattactgtacagtttaggttataacagaaaactgacagagaagtaataaacctattgatttctctgcttataaatgaaagattgaaactatccaatgacatattatagtaaatgagtatctgtaacctcccactgcatcagaagcaggttaaatgaagtcttgtgaatttgtaatagatcagtaccatttattggtttggggaccatcttaattaaaaataaatgcccaaaatgtagaactttaaccaaagacttgtcccttttaaagcaaaatggggattgaagggacttataatttctgttgtttctaattaaagtccctgaagatcatataccaaagtgtttgagaacttcatccaaacctactttaaagcattatgtgcaattaagttgttatgacataattatattgcctaattgttgggtcttttttcttgagcttataatgtacctggaaaataaacctcttgagaaaaagaaaagttcatactgattattggaaaaggactatatatgtgagcaagattgtgttttagagaggaaacttgaaactccaagaaagcacttgatgtttttatatgcttgtagcaaattgatgttctaactgtagttttatagaaagtattaatgcttttatgtatttcaaaactttcatatgttaaatggaaattgttttaaatgtgtttgagtttatgtaagcatgtatacactgtgctaaaagtcacatgtttcagtttgtgtataatattaatatgcaatttttggtttaaatttttgtcttaaaatattagtggcttacattttaaaaaagaaaaatcaccagcatgaacttgcacctaagtctatattcactgtgtccttttctgaatcccattgtagcctgtcaactaaatttgagtgttaacggtctttttaaagtgcatttaaatacaaaccaggaatttctttagaagttgagatac

SEQ ID NO: 94132 - DNA, 1328 bp, Homo sapiens
gctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagcaaaacctcgagcagttgattttgttcacatcagcttctcctgccacatgcagggtgtgtttactacaaatgttcacatgtgcctgctcttatcatagttcctgtgactatcttcggctataccctgctccttttgcaggagtcaattctcagaattcaaagttactttccccttttaggcattttttcttctgaatgaaatcacttttggatcttcattctctggtcaaatttaaattatgacaccattctctaggagactgcatagcgttttcccctggtctggcgactgttttttaatttgatagcattattgaaaacataccagacccaagcaaaaaaagtctcccctggcattttgagaagacacacttttttctgccttttaaaaggaaattatcattgcctccctccgtaccctctgagaccctcggaccttgcactgacccttcttcatccagaactacccctctgga

SEQ ID NO: 94133 - DNA, 1093 bp, Homo sapiens
tcgtcactgtttctattttatcaggcaaatttgtgcacagagctgaccctcaggaggactggcacttttccaattaaagaagaatgagccataatgaaacaaataagcaaaagcctattttgaagggccttcttttaactggcaaatgtaatttctaaactggattatgataaattgactcaataatacatattctctctctatatatctagattcctagaagtagccccatactccattgaaagtttttggacacatatgagcgtggatattttgttgttttgtttttccttttttttttttttttttttaataaacagtgccatgaaagaacatggatattttggacgttagttaagcacttcttccggtaaaatgcgcaactcatcattgtctaatttgtattttgtaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagggcttgcttcaagcatctgtattagtctgtattaatgctgctgataaagacgtacccgagactgggaagaaaaagaggtttacttggacttacagttccacatggctggggaggcctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctccccttgggtctctcccacaacacgtgggaattctggtagataca

SEQ ID NO: 94134 - DNA, 1043 bp, Homo sapiens
gcgcgcgaaacgcaccgcctcctccaggaagcgcgcccagacagtcctcggccgacagcgggcgcctgccagcccaccgtgctagtcttaagagcagccagggcagttaggaaggtccttctgccgcgagagaaaaatcacatgtggtttgggggcttggagggaagagaaacggcttttgctctgtgtcctttaggataatgtggctaactctgtctaccgtgaaatggtggtatctgcatatcatgagatcagtgcattggctggactctgccccccaccgcggtccgagggtggggtgtccctaaactccatcaggtgaagtgtgtctgtgtcgtctttgtccatagttctcgcaagtgacgttgaaaacggagctccgtccgaagcagacaggggcgagggtttgacgagctccagggtggggtggtggagaaatggggaagaggcttggccagcctcagtttcctcatctgtggcgatctcgggacacatccagctctagcagtcggtggctttagcagtagggctggtttggctgggccgggctcttgtgctggggcgggaaagcaccctgatgtggcagcggggaacaccccgccccagtctctaacctcaaatcctgttcctggggccttcagcttaccctccctgagtcctctctgtgggcacaatcacttaggaggctttgtggaaggaggcagggaataaatgaatacagatataaataatttttaaagactgctcagcctgttgaaggctctgagagggacagatcgtgatagtaatagtaatagtcaacgcttacttcgtgcttcctgtgtgccagacactgtcctgagcactttaatcaaccccgtgaagcaggtactcttgtttgtcccactttacagataaggaaactgaggcacagagcaactaaataacttgatcagctagccaataagttgtggaaccaggatttgtgcccaggtttctgagtacatcctttaaatcacttgcactattacctctcaaagatgtacagcacaaaatccttgccc

SEQ ID NO: 94135 - DNA, 1216 bp, Homo sapiens
tcagaactcacgtgccagggtggcacagcccagggccagcacagcctccctcaggcaacagcacaggatcccaagccacagtaggggtgatcatggctgacaagaccactgcaggccctaagggaggccctgagagttcctctgtgggatggagattgagatgtaagcaacttttgaaaaaggaggggaaagaaaacacgtttaaattcagccactcttggcctccgtgattctgcactttgacccatttctgataggaagaggatggtgacgcagcaggccctctcctcctcaatctgtccctctgccactgtagggggaggcataagctttagggtcctcacaggctgtttctaaggcctttcacctaattatgatttgcatatacatgtacacaagaggactcccaaaatgagaagcctggggctccacaaaacttaactccatctctgactccccacttgtgtttagaataaatgcctgagcttctgagtgccccctggggctgcagtctttggggggattcaggagagggaagacagggcctagtctgcaaggtctctggagtcttgctgggggcataaaacgcacacacatgaaacaattagggactcataggagaattttattgagaaccacaatgtaggctgcagaccatgggtgagagcggggagctgtcggcatgtgcttgagcatcaaagaaggctttctggaggaggaggggagttctgagcaaggtctgaggcaaacaaggtccaggttcagtgggggtgttcaccccaaggtaactttggggcaggcgctggtaacatgtccttgtcatttcagccacagtacatgtgtgaggccatgctgatcctgggcaaactgcattacgtggagggctcataccgagatgccatcagcatgtacgcacgggccgggattgatgacatgtccatggagaacaagcccctgtatcagatgcggctgctgtcggaggcttttgtcatcaaaggtagctgtgggcaccagcctgggctcccctccactgtgtgcagctcgttgcactctgactcccagggccctgctgggctcgtgtccagattcttcacccctggtagtgcccatgccctggcactggtgtctaaggtggatgccggtggcaaccggccatgttgacattgcctggtgcctgggacgttaggagactcagattctcgccctggctctgtca

SEQ ID NO: 94136 - DNA, 1042 bp, Homo sapiens
gctaagggcatggagagtgactgccatttctccagccattcattctaccttgagcctggcagaccttagtcattggtgcctaatttagggttcactgtggctccatggatggagcacaggccccttgagaatgggtcctgcccccagcgtcagcctggccggctcgcgttctccttcacctcacacccagcgccagggaggtcctgatgccctgaccgtggtgcacatgaactgtgcagtgcagtgacatgctaggttgtgaagctgctgtgcaaagtcaaaaggtgaaatgccctcagcagccagaaggattatgatctgcagattctcctctccccgcccgttgaagatgggcttctttttttactgttctcttttggtcagtgcaaccccaaggtattctgctgtcacctggaattgtgtggctgattaaaactttttaaaaagaaagaacactacgctgcttccaggacaggatatgatagcatacttggtttttgtgtttttagccctggtatggcgggaattcactgttgattttggcttccctctccaaggggtgtgggctgtgtgcctcacatggacaggagctcagtccctgtggcactgctgtcttggccccaggtgagaggctggcttccagatggagaaggaggagcaggctgctaggggatcaggcctcatccagccagagacctggagctagtcgacactgatgcttttagctgaggggtcttggaattaatccgttttccctggattcattttttttttttttttttgagacagtctcactctgttgcccaggctggagtgcagtgatgcgatctcggctcactgcaacctctgcctcctggcttcaaatgattctcctgtctcagcctccagaatagctggaattacaggcacgtactaccataccctgctaattttttgtattttcagtagagatggggtttcgcaatgttagccaggctgttcttgaactcctgacctcaagtgatccgcctgcctcagcctccaggagtactggagttacagg

SEQ ID NO: 94137 - DNA, 1108 bp, Homo sapiens
gggttctgttgctgaggatgttttctgttttctacctctgcatccagggcccaaggctccagggttccaagggtggggcttcttggaagggcggctgccttggatgtgatgagtcattcagactgaaggagttgggaccagcctggtgttgggcctgaggctgtgccaggatcagcttggctccaaatcgaaagttctgagttaatgaaaaagcaagtcctcctcttgcaagggacctttcctagagctgggtattggcacagaaaggcccttgccggtgggaatcacaaggcagtgcctgccctgcagggctgtgttacaaccctccgatgcctcaaggactgggcgcagggcagcccaccttcatcctggattgagcactgtagtctggccgtttgtgcagaagcgctcacggggcagaaggtaaagaaaagaaacccaagcctgcagcacctgggtgggcttccagtcagatgtttgtggacaggaaaatagaccttatcaaccaggggacaaatacaaggttcccggcccctttttatgggcagaactgggtgactggactgtgaccttgcttaggaaaagccactgccagctccagaaactttttggccctgtgtatattggaaattgctttatagaggaccgcctccgtgaatgtacccctctactttgaacttttatttctctgaatcatgacagctcccttcaaaaaggcattatctccattatttttagataaattttcatatggtgacatgtacaaatcttaactgtataatttcatgaattaggccagtgtaaatatccatgtgaccagtaccctaataaagatacagaacatttctatcaccacagaaagtccccttgggctcttttctaattggtctccaccccaggcaacctctgttttgtttttgtgttttttttttttttttaagagataaagtctcgctatgttgcccaggctggtctcgaacttctgggctcaattgatcccctgcctcagctcccacagtgctgggattacagacgtgggccaccactcctggccttattttctattgatatagattaatttgcttttttgaataaatgaaatcataca

SEQ ID NO: 94138 - DNA, 1337 bp, Homo sapiens
ttctgtgcacagggcccggctgactttcttagctggcggtcttatctgataggctacactgcccacagcaggaatcctgttactgagctgagcccctggggatgctcacgccctgcaggtgctgtgtcccagcttctggtttgaaaactttggtgggtgccctcaccatctggaggaagtaagggtgaggccctggggttggaggccactctgtggccctgaacaggttccccctctgcccctctagttggctttctcccctctaagatggggcttctgtttgtccatgtcccagagggtgtgagggtccaatgagagggaaggaatgcaaaacacctggagtattttcacagctgttaacttcctctccattgagagccccccgacagccacctctaggggctgcctgctccccttccccacaactgaattttctgcaggtatgactttaatgtgaacatcaaggacagccaggagggaaagagggagagagaccagtggcagtcatgctttgcttctgctgggggcctggctgaaccatgtgcttggtgtacagtgctctgggaaggccaggtgaccccattcactagtgagggaggcttggagaggttgagtcacttgcccgagcttacccactgtgattccagcttcgggcctgagcggcctggaaactcatgccatttccaaattttggggcgtggaaggacagcctgggcagcccgtgggtgtgtgggagaagccagggcctagtgacagcggggagcatagagctgatgcacggtgcgctgactcccacccctctgggaccctgaatcaccattctcaaaggatgtctccttgcaggtggtcccaccctccctagagcctgcttccccctgtctgcactctgtgctgaggccacgcatgagggttgtgggtcagtgggtatgcagtgctgcagtgggtggaggtgttgactgaccgtcaccccccagaaagcccaagtgctttcagtcactttctgttcctgtagctccaccccctcccttcctcttctttcttcctgaggcacatgttttggtccttacagccaggatcctggctccaccctgccccaacctcaccaccctgaagaggggtagaaattgagtcatcatttcttttcaaggaaacagcccaaacatttgaaagtcttgaaagtcttggcgtgtaagtagcagtcccaggacacgtggcagttactcagcccctgtgtctgtttcctgtggcccatccagcccagaggagctggagttgcagcctgtgtggctggactgtaaataatttctgtgcacctttcctcataattgtggctaata

SEQ ID NO: 94139 - DNA, 1053 bp, Homo sapiens
ctcaaacccagtcttccccaaatatttttttaacacttactgtgtgcagaatacttggctaatctctattgtgaacagagctgatgaccaggcacttggtaggcagctggcactttgtaaagacttagcaaattgagtcccaggagttctggagttcacatggccaggaaaagaaaatgtaaccatgctgggtcaagagacaggtgttgtctttctcaggggtctcagggtgaaaagagaggaaaatctgaacccttttgtgcttgccgtaagcctgcctctcccttttggtaagtgacagcctggaaaggcaggcatcttccaggctctttttcctgttggaacatagggatttatttattcagtgatcatttcttgagcaccttctatgcaccacacattgtgctggtacagggataatgaagcctgtctccctcaccagcctcattagaagctgcacggactgagtaaggtaaaggaagggctccgcgaaacgtgtagcactgcctgctgccacctaggggactggggagcttgccagccgcttgcacatcccacccagaggctcccctaagatgaaccgtgtccttgacccatcatcacacccacatctgtctttctgttcctggccaaccaggctttacttgacttggaataaatggcttcctggcttctccccacgcaggctgtttctgggccagggtttgtttgaggccctgtttggatattgttaaaagtgggcagctttgctcagaaaggtcagcatgagagacaagaacaaagagatctttcaagctggcctctggcagggcagccagcaatggctcggaaaagccccagctccacctggcactggcagcttcagagctgggacgggattgctcaggctcatggccatctgcagagccctggagaagccccgtgtgctttctcatttctcagaggagtaagctgaggcagaggggcattctcaggtcagtgttagctgggaccccagatctctccctgtacagccctggccactgggacctctctattttttttttttttttt

SEQ ID NO: 94140 - DNA, 1139 bp, Homo sapiens
cagtggtttcatccctgcccagggttactgtgaggccagatgagacggtggatgtgacaattcagcttctaaaggagtaatgcaggccgggagcggtggctcacgcctgtaatcccagcactttgggaggccgaggcgggcggatcacttgaggtcaggggttcaagaccaacctagccaacatggtgaagccccgtctctactagaaatacaaaaaaattagccaggcgtggtggtgggtgcctgtaatcccaactacttgggaggctgaggcaggaaaattgcttgaacccaggaggcggaggttgcagtgagccgagaccacaccactgctctccaacctgggcaacaagagcgagactctgtctcaaaaaaaaaaaaaaaaaaaagagtaatgcatgtcacacgcatagggctggctgtttgaccaagagtagtccctgccttgggtttctcatgggccagcctgcctgaggcctttccctaaggtcccatgtttgcttcatggatacttggtcaaagaccagaaatgtgttatgctagcagtgctgagctgttgggtgatgggtgtatggggactagcgttgtttctttggcttctcctcttctgacctgccagaaggcttgcagtgaatgttctttaattgaggaggggctaccctaggagaacagccggaaggacaaaggctaggagcaggacaactacacaagccctaggtttaaatcctgggattaaatgcatggattaaacggagcagtgcatccccagcgctgggcagccttggggtgggtgtgggggttatggcagtgcacactaggcagggagaaaccagaggagaacattctgccattattctaagaacagtgaggaagagacggtgagaagatttaatgttcatgtattactttaagggtcacaagtgcattcacatctgttactgcatttgatctagaggattttctaatgaaagaaagcaggattctgaggccacttcaatggtggaagggaaagagtgtggctgggactaggtcagagctactcccagagcatgggggtacaccatgtggcctgagggcagtgagccagggaggagggagcaggacagctgggggtgctgggaaggaactgatgctcccat

SEQ ID NO: 94141 - DNA, 1016 bp, Homo sapiens
tgagggcctatcaccagcctgaggatttgtgctgctgctgctgccgctgctgctagtatgctcctctcttctgttcctattcttctgacctaattaacgcccggttctgaaaatccacccctccctctgccagacacaaattcagacactgttctcttaaaggtcaaggtctagggtggacagggggaggtttccactccaggcccagagtctttctctcctgagtgtcacaccctgcaggttgagtcaagttctgtgcgtgaggctgtgcctggggccaggagtctagccatgagcaagaactggtgaaccagacgggggcatgtgagctgaggcatgggctgggttgggggaggacaggagaggcctgacctctcctggtgagatgagttagggatggtgctgtaagagggtggtcctgaatggggttgtgaggaggtagaaggtgtccaggttgatagagggaactgcagcatgaccgaagatgggccatggtgactgtagggaccagcaaggggttccatgtcactggagagaagcccgccagttaggctgccccagaaaggagtttagattttatcctgatggccatagtgatggctcgcagcccactatcccctgaacaagattggtctgcacagacaggcaggagggtccccagaccctggatgtgcccagccaagcttcttcccacccctgcagactgcctggctccacccgctcccatcataacctcttgcttccaccagaattccaggtcagcctccactcggggatgtgcatcctataatgctgctccttcctgttctccccatgggcagggcctctgtgcccccgtcctctcacacccgagccactcttgcctgttggaggccgcccctgtgggtccccaccctgggtggccagagctggggagctgctggaggtggtggagtgggtcagtacatcgccggggacagaacgagggctgtattcctagttggctcaggggactagctcctgccaaccctctccct

SEQ ID NO: 94142 - DNA, 1001 bp, Homo sapiens
agattgttccaggagctgtaaatatccagagccctttcatggggctgagggaattcctcgcccccctggcccatctgtgccacgttccatttctggccccgcagccgtctctgaggagggccctcctggcttgccagtgcctcctccacgcatcaagggcgtgccagccagctcggggcctcggcagccgaggcaggccaggccctggcagggagggggaagaggagcaggtgctgcagcctgagtgcggggagaggcttgctggggagccttccctacccccatctgctgggcatgtgtctttccaaacctctctcctctcccccatcacatcggacacctcacagagcatcttgaagtcacagcatgatctccttggctctgtgctcagcagggtcttgtcaaggctcagggagaattcagaacacagggcaaggccctggccctccaagggttagagagtgagagaaaccctcctacagaactgcaggcaaaggagacaatgtgggcaacggtgaaggggctggaaaagacgagctggccgtggggatggggacaggaaggtgttgaaggcaccggtcagcctggggtagtagggacagggccgggaggaggtggggctggatcttccatggagcctggggagacagctcacagtggcatgggcaggttcttcctacctctgggaaacacagaaagcccgtctaatcttgggacagtgagtacaggtgggagaggcctagggccagagcagtggttcgcacccttctgtgggtcctggactcctttcaggaggtaagggaagctgaggactcctgctcagaaaaattcactgcacgtgcaagttagctttaaatccgagagaggctcctagacgctctccaggctcagtcaaaggtgtcgtgatagcctgggaggtaaggagtcttctgcctctgactagctggactcagagagatccagacacagcctggcaccatcccagcatccagggagctggt

SEQ ID NO: 94143 - DNA, 1038 bp, Homo sapiens
cccctacctggagcaccccattttcatcatctcctcctggaaggcagggtctcctgatacatcagcagaactccagggtgacgtttccacacatggctgcctcaccctgtggcttccactcctcccatttaggaagtgcttcctggtggctgccatggtcctttgtgccacaccacaaacctgcttctcttcattcctgagtgtggcagcagacccctcctcgccaggccatctggggcaggtgttttctcacagcagcctccctgcccccagtgcctggggctcccttgagttgagtgtgagtgcccttgttgactggcacgtggctcctgagtcccagggcagcatgtgcctggggaaggctaacctggcgggttccttcaacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaagtgagtgccctgggaacactctggcagtgggggagctggctggcctctgcagcaggcgcccatgcacacctgccctgccatggtgtcagccaacacacatgaagtaagcacccgctgcatgcacaatccctggtggagagacaggggtgaggacaggtggggtcagcagacagctgtggtgctctgcaccaggaggtgcctggtgggtaatggggtgcacatgctgctcctcagcccccatgaggtggggtctgcatgggccacaaaggagactgcttgaatgcatgtgtttgggctgcttctgcctgccctgggctctgcatcagcctcaggatgacagtaacttgtgtaagttaatcatagccctgacacagtcagccaaggatgggattctaacatgagctgggctggcagctggagacgggttatggccctccaaggtggtcctgctccttcatacctccccacctccctcatttactgcatcagc

SEQ ID NO: 94144 - DNA, 1051 bp, Homo sapiens
aaggtacagcctgcctttggtagaacttactgtgatgccagctcagttttcatccacttctttgccaggcacatggtgtggtcgggtctgccctagacccattccggccctcaaagatgaagaaaatgagaagggggctctggcagagagaagtgtgatgcctgcagagggcccggggaatgcagcagggctggcctgcccagggagctgtccccagggagctgtccccaggaaccagcccagcccaggggacttggctgactgagggaggggctttcccacctcactgacacctgctgcttcaaccagctgccccaccctccacaccggagcctcttctctctccctgactcccagccaagtcccactccaccctgcttttcaccaaacaccagctccagcaagacccctttcctgtttcttcccctgtactgagtctgatccaaaaattcagcccttgattctctgggcagtgtgtcatttatagcgctctaattgttgtctcgaaggcagccattgtgttttcttcttcatattcccgaaagcacaggcccctgatacttatggagtgttggatcctttgcaaacctgcggaaggagagtacagtggcaagaccagttgtccccagcagttgcccactggggtcattcctactcagggctgtgtcctgccagctgtgcactcaggtccgtgcagtccatgctagggggatcccggtttctgcccttgggacctgataggcaagccaggtggtcgttagttctatgttccaagatgggtgcagggcatcctaagaattgagagaggtgggatttaaagccaggcttgggatggatgaaaatgaagaggagagttggtatctggggggcaacccgtgtgcagggtcaggaaaggcattttggggatgcagtgaggaagaaaaatacttgtccagaaatcccctcttctgaaaatcctggggcaaattccaccctcttcattctctaccaagttgcaatctaagagacaaagtatggaaagatgggcagagagtaaggacatcagagggct

SEQ ID NO: 94145 - DNA, 1066 bp, Homo sapiens
ggccagaacttagttatttgactgcccctaactgccgagggctctggcagatgtcattattctgggtgtcccattaaaagtcaggggatcaggccgggtgcggtggctcatgcccgtaatccgagcactttgggaggccgaggcaggcagacgacttgagcccaggagttcaagaccaacccaggcaacatggtaaaaccccatctctactaaaaatacaaaaaaattatctgggcatggtggtgcatgcctgtagtcccagctgctctggaggctgaggtgggaggatcacttgagcctaggaagtcgaggctgcagtgaactgagactgtgccactgcatgccagcctgggcaatgggagtgagaccctgtctcaaaaaaaaaaaaaaagtcaggggatctatcctgctagaagaaggggagaatacactggtgactggtgcacaaccgccacggccaggaaaggaacatgagaaggtgtcctagttctttcattctgagcatgagagaattccagggtaatttgcaccccctgagccctctcccctcccctggctgccatcatcactagcaagcatctaccaagcacctgttgaatggagggctgccaggaccagatcaccagggcaatgatctccctaaaccgcctcccccacctgacccaggctaagaatacaatcagcatccccccgccaaaccctgcctaatgactccaccagctgcagcaaatttgcaggaagggaaaaagatgccttgatcattttggaaggagctaatccccctggtttggttcaagataaattgcatcccaatctgtatggcagtaagttccatcgtgaattcactctttggttgaattcaaagagactgtcgtagccttcctctctcaactcttgccctcctctcctcccttcttcaagcctccttccaattccagtccagtgcgagaagctgatgaatggtacccacttgagagacgggctgcagggcaatgcctcttgggcagcgggtctgtgtgagagtgggagaggcacagagtcccatagatgctccaggatctgagtg

SEQ ID NO: 94146 - DNA, 1036 bp, Homo sapiens
tcaggaagacttccctgaccacaccagcagcatcgacctagcccctcttgagtgcccataacactcagatgtggcacttgtcattccactgtcctggtctctgaagtggtttagtggctcagctgctcccactcctgtccccactctttctcctccttgtggggagaccaggcacatagtcagtactcaaaagttgtatgttaagcactcagttatgagggcagcctgttcagatgccccagcagcagctcaacagcaaagcggagagggagagctgaggctgagagagccaaatctctgacccctccccctaccagccatctgcccctgggttcaaagaccccatttcctctgctctctgccttgggaatctccatttcaggctgtccccagggactagagcccgcatttctctcccatatccaggaagcctggcttctctgtgtttaattctctgatcctcccaagttctcatctccactagagaaaaaccagagtcctctcactcagaaagcgttgtattttaggatgtggcaggctactcgggttgcacaatgaaccttaggcaatgctcgtgctaagtaccccagtgcctgtgttgcagtcaaggttttagttaggcctctcctgctgcctactgggacaggaagagggaatgtctgggcctggtttctccacctctttctgggagcttcccttgggcatctctgttctctatcccaccccagacataatctgaactagggtaacctcagctgtcagcttttgctaggcagggttcttggcaaaaccacaagtcagactctgctggcccttctgcgttcctcatctgtgtcttgatccttctgtgccttcagcataggctcagccccaggagtgggcagccaagcctgggggctgctttggacaaaggctgagtgcccagtgaggccgaagagccgcgtctcctaaagtgcctaccgtggggtgtgcctgtgccacgtgggtctgaaatgtgtgtgtgtgggggctggcctgggttggagaaactgcccca

SEQ ID NO: 94147 - DNA, 1083 bp, Homo sapiens
cggaatgccagagagcctggagctgggctggaatgccagcctccctggaagggtgtgtctatgttccagggtggcgttagggagggccctttctgtagagcaggctcctcccagcagccctggtgtccccaaacgcaggctccagggaccagaaggctcctgcagcttccagctgattcctggcttcccagctggaaaggctgttacagaatcccaggaatgtgccctgagctcagaaagaaaattcccaaaataacttctataaatacttgagggcaggggtggggagggagggctcagcctggcccacagctggcctagcgccaaggctgcttcccagggcaggcccccctcaaaggaagaagaagcatgcacacccctagacctttgtgctgctctgcccttggagggcatcatcaggcactgaacttatgggctgggatggtgtgcagtggaattctgaaaaggcaaggcccttttcccctcatcccctcccaggccacagcccctggccacacactgtgcctctgcagatgacctgggtcccacagggaggctccccactgagtgtgagcccagaccctagcaagaccttaggccccttaggttctgcacctgcgtggccgtaagaggcagggcttgccaagctccacgtgggcagcatccctgatcggaggtccacatctgtgtgtgtgtgggtgtctctgggttccctggctctgcatttgggctacatcctgagctctgagccttgttgagctgctgtcctttggggaataacaaagcaggcaggaggctggggcgctgtccctctcagcctggggaggggcaggacagggatcacatccatgagccccacagtaactaagcgtgaccttgaggcggttgtgtggtcaggaggagctccgccctcagggaaggcttcctgggagagcagagtctcgagcacttgagatgtggccacacatccccactccctgagatccaggaagggagagaaggagggtcctgaggtgggaatttctggggacttcccccagagccctgcacctccctggaatcatgtctgtggctataaccagc

SEQ ID NO: 94148 - DNA, 1094 bp, Homo sapiens
ctgttgtctgccttatttatcaatgcccactacctcatatagtgctgaaaaaatgtgttgaattaatgaatgagatctatgtatctttcccttatttatttcttctactacttaaaaaattccctccagagacatattcactttaatttcttctaatttttacttgtgattttttttttttttttttttttttgagatagtcttgctctgtcgcccaggctggagcgcagtgacataatcttggctcactgcaggctccacctcccgggctcaagcaatcctcccacctcagcttcctgagtaactaataggtgtgtgtcatcatgcctggataatttttttggtagagacaggatctcactatgttgcccaggctggtacttttgattttcaaaaaagttttaattctctaattcttctgaaatgtgttttgcattctaaggtggtagtgtcatttgagccctgttgacttagaataggctgcctcaatgttgatatatgtgaaacctacaatcaccagaaatctgagctgtagatctggtgcaatatagtagatacctatagacattcacctagtctcttcaaatacttttgagaatgaggctagttataaaagatacaaacaggcacccatctttcctttcttaacatgatcagtgaaaatgagctcgctgaaatactttagtcacttatacatacaatctcaaaggttaggccaggcacagtggctcacgcctgtaatccagcactttgggaggccgaggtgggcagatcacttgaggtcaggagtttgagaccagcttggccaacatggtgaaactgcatctctactaaaaaaaaaaacaaaaattagctgggtgtggtggtgcacacctgtaatcccagctacttgggagaatgaagcccaagaatagcttgaacctgagaggcagagtttgcagtgagcggagatcatgccactgcaccccagcctgggtgacagagcaagactccgtctcaaaaacaaacaacaaaacaacaacaacaaaatctcaaaggttaacctatgaaaaaatgaataatgaccatatgaaggcatatcagattactactta

SEQ ID NO: 94149 - DNA, 1031 bp, Homo sapiens
caaaaaactagccgggcgtagtggctgatgcctgtagtcccagctacttgggaggctgaggcaggagaatggcatgaacctgggaggcggagcttgcagtgagcctagattgtgccactgcactccagcctgggtgacagagtgggactctgtctcaaaaaaaaaaaaaagttaaatttcaactctaacccgtttgctttaattcagcaattatttcagaaaggaaataatcatgattttgaaatactcttctgtcaagagtgtttactgtatttgatataatttcattaaacttgaaaacaaagagagatgttacttgggagcttcccatccaagaatggtgttttaggagaagttacatgtttacacaatcttaaaactgatgtcaattttccacaggatactcctatacctggcacttaccacttgaaaacttttattgaagaatccctattaaatccagtgatagcaacctacaattttaaaaacgaaggaaggaaaaagccacctcttgtgcaaagaaacaatccagtcctaaatgatcttccgcagtatatgcctcctgacttcctggacctgttaaagaagcaagtggctacttactcattcaaagacaaaccacggccaagccccagcacactagttgacaaagatcaggtaaagcgctactggcagattgctttgtgtgggaaagctactaagagcccctgaggaaagtatttttatacgtagagtatatcttcccccaggagaaatggaaaacctttaagatgtcttatttcccgtagaaatcaaacaaggactgcctgatttgcaaatgtttccagtaagatttttccctataacatcttcttaacctaaggggagtacatggggagaaatgttttcctcttgggcaactcttggtgggattcccctagcctggagagcacctgggatcttatctgtcattgggctatgctcttatctcttcaagcagtatatgtggtgaaccctcttcttttaaagagaaaaccctgcctctcggggag

SEQ ID NO: 94150 - DNA, 1061 bp, Homo sapiens
agtcttggcattttgattttacaggaaacgagtagaatgattgtataatttaactgtggtcataatgagctgggttcaaatctgttccaatgcttcctacaacataatcctattggaacccaggactgtgatatcaccttcaagttgtgtttttgtttttgtttttgttttttttagatggactctagcactgttgtctgggctggagtgcagtggcgcaatctcggctcactgcagcttctgcctcccaggttcaagcaattctgcgtcagcctcccgagtagctgggattacaggcgcccgccaccacgcccagttaattttttgtatttttagaagagacagggttttactatgttggccaggctggtctcaaactcctgaccttgtgatccgcccacctcggcctcccaaagtactgagattacaggtgtgagccacctcgcccagccccaccttcaagtcttaaccatactattagtgttatattaataggattttggtaattgtaccaaccataatactgtctggcatgtttgctctcagatgattctcccaataaacaactattgcagttaaatatcacccttggtgtaacgtattttcctaaaatttttagaagacggcaacaattttaaagatctgatatgtaacagaggcactgttgagctcaattatagatatgtattctcaagagaaatgcctctccccctttttgaaacttacaataatctggaaataaatctcagtgatactatataagataatgttttcttaaaggaacactatgtttatcctacgtgcttaatctgctttgtggatagtccttgaaatcattgacccatgctgtttctatttttgagatacttaaactattttctcatctagatgttcccatctctaatgtcacaccttgtatgggtttctggacttctctgtacctttcatattcttttagtctcgagggtaccagtccctagtctgctgagccagttttacaggctcagccaaaataagaaaatgaaatgaggcacagggaatggacttgattaatctcttaa

SEQ ID NO: 94151 - DNA, 3363 bp, Homo sapiens
agaaacagtttaattactctgtagaaatacgtatttgggtaccagtagtcttatttttgttttgtgagtgtaggttaggtctgtaattttgaattatgttccacagagcagcttcagtgacagaggagccagtcatttggggatttggttcttttcctctgtaaacctaggataattttacttaggtcagcatgaaagtacagtggtatgattggtcaaagatatatttgaaatattatcataaggtatcataaagattggttaatctttaggagtcaaagtcacatttcaattgctacctccattggtatttttccgttaaaagtttttgggtttttctgagacgtggggtcttacagtttggccaggctgaagtgcagtggctgttcactggcacgatcccaccactgagtaggctttaagagttaatacgtttcatttaggttacattttattattaatctgtgtatttggattgtggtctttctttcaaacagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaagtcttcaattttgtggggctgggaggggttgaagaagtgatacttagatgtttccactaaacctttgctgtttgcttatatgtttccactaaagctttgatgtttccactaaaccatttcaggtaatggcacaattgacttccctgaatttctgacaatgatggcaagaaaaatgaaagacacagacagtgaagaagaaattagagaagcattccgtgtgtttgataaggtacgtcaaggactggatatgttaaattttgaggatgaaatgaagataccaggactcattatgaagacttgtgtttttttggttgtttttttttttttttttttttttttttttgatgatttaccaacatattttaattaccaagcaaaagctttttaagaattcagtatagactttctaatatatgtattgcgttcatcttgtcaaaggaggtgtcacttgactttgggactaggaaataatgatttcaatgtaggacattttgcttggctcttaatgacatttgtaggtcaactgtgtagatttgtatgcatttctaaagtatgtttttcccccaatgtgaaatttagtagtaaacttaataaatttccattccaactctcaagtctgtaatttgactcagaaactatactaaattttttgctaggatggcaatggctatattagtgctgcagaacttcgccatgtgatgacaaaccttggagagaagttaacagatgaagaagttgatgaaatgatcagggaagcagatattgatggtgatggtcaagtaaactatgaaggtaaatgtttcagtctcacgcctcattcttcactttgatttttaagataagaggctctttgttagggaactgatcgaaattagtgacccttcccctgaaattaggttgctaaaacagttacttacatttaaccttcttaaaattcagagtgttgtctgcagactaggtaacattgctctgacttgagaacttaatttagaaatatttactatcaggttctatccctacacctggaatcagcattttaataggattcttgggtgattcatgtataaagtttgagaagcactgttcagtgtttgtgtgattgtggaacaatgtggaaagcaaacttattccaagtttcctaaaatgaaattaatgtgactttctttccccgcactgtattgtcttttttctttaattggctttagtctgaaactgaagtttacatgtgcttcaaaagtatcgtatctactaacttttaagatggccatatcaggaagcaaggcatatgaaactgaaggattttgagtaaaactctgtatttttttcatgatgtaactacttaacttagaaaagagcataaaatgtaatgttataaaaattaaacctagcccatagcattgaatttacaatattgtcttgtaatccagcagacttaaaattcaagtctaaactaagagccaagaatgctcttttttatattggcctatctaaagcgttaatttggctcttactaataaacctgaatagttatggttaatgaagttccagcctgggcaataaactagcttccctctgtacttaatggtaattctgaggaaagagaggaatggaaagagtactcagtaattgagtaaatgtgattttttttttttttttttttttttggtcttttgctattgactcattttttgtgtacttcttctttttcagagtttgtacaaatgatgacagcaaagtgaagaccttgtacagaatgtgttaaatttcttgtacaaaattgtttatttgccttttctttgtttgtaacttatctgtaaaaggtttctccctactgtcaaaaaaatatgcatgtatagtaattaggacttcattcctccatgttttcttcccttatcttactgtcattgtcctaaaaccttattttagaaaattgatcaagtaacatgttgcatgtggcttactctggatatatctaagcccttctgcacatctaaacttagatggagttggtcaaatgagggaacatctgggttatgccttttttaaagtagttttctttaggaactgtcagcatgttgttgttgaagtgtggagttgtaactctgcgtggactatggacagtcaacaatatgtacttaaaagttgcactattgcaaaacgggtgtattatccaggtactcgtacactatttttttgtactgctggtcctgtaccagaaacattttcttttattgttacttgctttttaaactttgtttagccacttaaaatctgcttatggcacaatttgcctcaaaatccattccaagttgtatatttgttttccaataaaaaaattacaatttacccaatggttgctctgcatctgagtcatttaactgttgaagtctaataattttgaaaataaaatatggcattggtttctgcttggtatagtctagataattttttctcgtgtggggaagcatatggagatgggtggcagaaatagtgaaggtgggaaaggaaggagaaaaggattggaaaagtgagaaaagagggagagaagcacagaaaataagaggaacaaaataaggggtgtaactaaggagagattgaagaggaaggccgaaaagatggggatctatgggggctggcttagtgtagtcaccttttgggggccaccatcatgcgtgcccacaacattcctccaccaccatgtgtgtcgtactgtgctac

SEQ ID NO: 94152 - DNA, 1494 bp, Homo sapiens
tagattcttattataaattgaatagccaacgtcagaataagagacttgtatgaaataattgactttggtatatgtcatggatactaacatatgggtataatataatacagtaattcaacctgctttggcaagtgggattgtaaacttgccgatggaagatgtgcagggctaattgtagttaaagacatgtattttagtctgcgtggatatactttggagccttgtggtgtagtggtggtctttgttttgttttctgaagactaccttagtataaaacaggaattctgggctagctaacacgctagaaaaggaggccaagaagtaactaaggcaacttgaaatggagaatcaaaaaaggaacaattgaatttaccctagttaaaattagctaacattttaacctaagaattgcatatataatcagtcagggaataaccatttctcaagtgaaaaaatttaagaagttggcattctattctataaatgtcactgtagcaatgtggatttttctcttaaaaaacagtgacagctgttgaaatgaagccgcttaaatcttgtcccttttagtttgctatggaagtatgcaaaattattacataaaacctgatgtcatgttctctttatgccatgccatagaacattaatacttttgatttatccttgtacattgagatggctggttaatgtcaatgttggggaaacttttttttccccccttgccggagttgttttttttttttattgtagtgttgaaatgctttgcaaactattcctttgttttcattagacacttttattagcatgagcaccaagcagtttatttgccacagttttcacagtaagcaggaagggtttgataagagctcaaaagcacttgagcactttttcttaggctggagaaaactgagaagcccagttggaactatatagcccatttaaagcaagctccccacttccataagcatatagaagtttgggggataccagaattacactagtcacctcaaatactatttgataggactgtaggtagaaagctattagtattaaagacaaatttaagcaggttttatttttatttattgtgtaatttgacttaaacttagtttttactttctgaggttggtaaattacatgtattgactgttatgaacaaaaagcaaacagttttgggaataattttttttttgttgagttacactgttttaaaggtatcacctatttgatctcatgtctcctcaaaaaaaatagactgggcctgatggctggtaatcttatcactttgggaggctgaggcagcaggatcacttgagcccaggagtttgagaccagcctgggcaacatagtgagaccccatctctacaaagtaaatgtatcgtcaaaatgtttttctgaagtagttttttttataaatatactgtctccttcccaaattgtctcaggctgtctaatactttcactcttaaactctgaccttctgtaatacatttctta

SEQ ID NO: 94153 - DNA, 2474 bp, Homo sapiens
aaacctccagcctgtatgggtgtggggagacgatttcaccttaaataaaactagcgttcattgacgtttgatggatttgcttcatcttgatgcttcaaatgttattctgaatttgaatgtgctggttacatttgctttcttaaagatgtagttacaggcatatgtaataaacattacaagttgtggagtaagcttttttttttaaataaacgaagggtaaagttttctttaatcagttttgataattgaatcagtaattcgaatagattttttcttggtagagttggtatctacgcatttgtggtcccttgcccagtgttaagcttttgtagttactgtttgcatcactggtgctttgggggttttctgttaaattgacagctcttactataagagacaaagtcgaaaaaaaaaatcttaataaaaattgacagatatcattatttgtgacagatacagtaaatttgaaaattgccttcacataactttataattagaggactgagattttacattaggaatccaattaaaaaaaattagccggacataatggcctgtgcgtgtagtcctggctagtcaatgggctgaggcaggaggatcatcttgggcccgggagttggagactgtagtgagctatgatcacaccactgcactccctgggcaacagagtgagaccctgtctctcaaaaaataaaaaaaattaggaccccaagttaaagtataaaaaattttatacggaagtaaagtaagattgctcatgtaactcttgagtttacatgtaatcaacatatgctcattgaaaacgggattgcttcaagaggactttgagtgcagggtgattaggtaagtaaaagatgtaaaaaggtagaaaatttttgtcacttgagtctaaataattgttcttataagtgccaacgcctgtttctgttaggctcagaagatcaaaggatttggctcttttaaaatatagaaagctctagcttcagctagaatttaggcctttagtaatagccctaatttttatgaagccattttgttccagtgatcttttggtgagagatgctatgtaagtactattcttcagaattaggtgtctttttaccctaatgaaataatttagattgcttttgatacaggtaaaacaaatatcctggcttccataattgtagaaaaaacttcatataggaatccttgttgtatcaaagtagcacctgatgggaatgaacagacaggaatggatgaaggatagcagtttgcgttccatttcaagcctatgggctcacacatttattcagataagaacaccacctttcactagataaactccaacagtattcatgcatacttttgaatggcatgtaggaaatgtttgataggtacataatgtattcacttcaggtcactaatgtaatacggggtcgtgctccttagtgttgacagatcacctatggttctccaaaatgaacattctagtacaggaggtctagggaggaacctgagagtatactaatgcctaggaactttctctggagtggcaagagcagtgggaagaattatgtcaatagctacagaaataagggagtaagaacaagtcatctctctagtgaattcttcttcactttactgagataaacatacatgttaatgagcttgagttttcccaaaagtataattcttctggttcttctaagaaaatggcactccctggaaacaaggaagaaccaaatttattcgcctttgtagcagttgggaaagttagtgctaggaagtcttcttgatttatagtaggctttaatctggatattgctggtaaaagtttattctaaaacctgaactctggataagtaatacaaaaagcttctcaaccttccaagcaaaattgagagctttcaggttatgtgagtaatttggtctcttgggtgcttaattcattccttgaagctcatttttgtgatctcttccaagattgcatttgcttggaggtagggagttagacaagatggtatgaggtccctaaattttgactttccaagcaaaattggacagtggttcctaaattgctaacatcctcgtttcttcctaaggcttctcatgtttcatatatagtagccttcccaaagtcccatttcccaccccccccccccccccaacccatgtagagagaacgaacctgtctcccttcctgtacagagtacgggatccttcaactttcacacaggctgcagtgtctgccacacatttagctcaacttttttttagccttaaagtgatgtccgctgcatctgtcgctgggttgcaccttgtggatttagtttgcataaattttctcagcttaaacaaagttaacattgaatagagtaagcttaccataaagggcttaataaatgccatgcatgtctacattcggtgtggaaattgagctagtcaggttgatatttaacattgtaggttctttgttaatttatatgaaataa

SEQ ID NO: 94154 - DNA, 1019 bp, Homo sapiens
accgcgtcccggcggcggctgcgagtcccagtgacgcattgcaggtacaaaccagccaatcagaggcaggctcaacgaccaacgggggacgcatcgccgccacgatgctcctccgcgccgcaaagtagcgcccctcaggggccgctccaccggccttttaacggctcgctggaaatgaaacccacttacgtcatccgttcgcccactttccttgatctcttgcctcatcgaccaaataactgtgaagaaaggggtcccgagaagagtttgaggggagggggttggccgggactcgtttgcgatgttccgttatctggatgcggcggagggatctggcggagggaggtgtttatgaggcgctgggggcggaggaggcgaattagtccgagtggagagagcgagctgagtggttgtgtggtcgcgtctcggaaaccggtagcgcttgcagcatggtgagtgcatcgctgagctgccggcgctgggcctgtggggggaagagactggagcgaactgactaaacaaaggaaactcgcctcccttacaccttcaaggagtggtttctgccagagggatggcgcgaaagaggccagggatgccggcgacggttgtgtcgcaggtgctcccccacccccattctcttcaggggggcttcctctagtgagttgagggccggacgcacagttcccgaggtggtgaagctcctcgggggcttggctggaggaggatgggtccgggatgagggacagcccagtgcacgggaaggagagaaagtgaaggaagggagagagggagcgtagagagccttctgtcgggcgtctggaaaggtcaagcagggggcgaattcaatccacccgaccgacggttagtgcgggcgccaggaagcgcctttgtccgcttgcggccgccatgcgcccagggggcgggaggagcgcgcggggccctggggcgagcgtcggcgtcgcagttagcccgcgtcctccgcgtgccgggatccagggggcgcgcgggcgggcgggcgg

SEQ ID NO: 94155 - DNA, 1251 bp, Homo sapiens
atttcaaaggagtataattaaattgccaggtaaaagctcaaaggtcttttttatagtgttctggaaggttctctgcctgtgtttgtatttcctttagcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagaggtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaaggtgaggcgcggattggagcagagttgtggagctgggctgggctggggggcagcggcccccggccctcggcccccgaaacgggcataatagggaggggaccaagaggccgcgctttccagcgtggagaccggacggtgcggccgtgctccggctcaggccctccgcgcggtaggaaacggcgagggccgtcccggggagcagcctcacttcgcagctttgctcgccttggtagggaaatggccttgggcggaggcgggggacaggcagggaacggagtggccacgtccaggtttcctgcggccaccgaaccggtgcctcgcgccctggcgcacccacgtcctcggttcggggtggacttggggttccaaaacagccccagccggtggcggagtctttacgacagggaccagcgggctcgcccttgtccttgcagcgggccccggatgtgggcctcaggcggggacaggcgcccgcagggaggcctccagggccgctatgca

SEQ ID NO: 94156 - DNA, 1596 bp, Homo sapiens
cccagcactttgggaggctgaggcaggaggattgcttgaggccaggagttcaaaaccagcctgggcaacatggcgaaaccccgtatctacaaaaagttaaaaattagccaggcatggtggtgcatggctgtagtcccagctacttgggaggctgagacaggaggatcacttgagccctgtaggtccatgctgcagtaaaccaagattgtgccactgcattccagcctgggccacagagtgagaccctatctttaaaaaaaaaaaaaaaaaaaaaaaaaaaaaacaggaatgcatgcagattaaactatgtgtctgtatacagtatgcaaactttagcaagtgccaggcacttaggcagtagtctatagctgaaaaataaaacattcagaaccactttttaaggttttgtgtccttgtaactttaggcattattattacaatataacttagctgggacatgagagttaatagatccacattttaaagtagattttttttttaattttctagaatgtgtctgtgaaaactacaagctggccgtaaactgctttgtgaataataatcgtcaatgccagtgtacttcagttggtgcacaaaatactgtcatttgctcaaagcgtgagtaaaatatcctaattacctgtaagctttattttgacttaatacttctttaattgatgtgccttgagttggaaagagttttattggcttaaatctgaatcatgttacaaagtaagtgtgggaacacataaatttcaaataatctttgaccctggaactttagagttaattttttttttcccgtaatcatgaaatcagttatttttcagtttggcattaaggtttctttttcagtggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctagtgagtggggctgcctatactacttgttttcatgctgttcagattcatttaattaaatttatttttgattatgtaatatgatttcatggtttagaattcagaagatatgagtgtccagtgaaaagcttccttctcattccagtccccctcgctacccattggacctccacagaattgatgttattgattattctataaccttccagagatagttgatgaatttgttatatatctgttttattatttttacataaatgatagcatactaggtataatttttcttttatatctttacttaacattattcagtatttcattgttgcattagtagtaaatgtatgtaatttaacctatgtatttgcttattgattgtgttttaaaagtgagatatgcttgttttagggattgtttaatgaaaaggcacagaaacccactcaagctagcttaagcaaaaaaagacttcattggaagggactagaaactggaaaggatgtcaggac

SEQ ID NO: 94157 - DNA, 1049 bp, Homo sapiens
ctcccgggttcaagcaactctcctgccttagcctcctgagtagctgggactacagctataccacacctgactaatttttgtattttagtagagatggggtttcaccatgttggccaggctggtctccaactcctgacctcaggcaatccacccacctccacctcccaaagtgttggattacagttgtgagccaccatgcccgggcctttcatgccttttcatctttttagttgaacagggcatgacactgccagctaaactttgacttaatgtgactttatgtattgtgtccagagaacagagggtcaatattagaaaaggtgttccctcctgggtgtgtcctttatgaaggatgtgtaagggaagaaattataggaatagctactgcataaattttttttctcttagtccttataattcgagaattttaggattagcttattaggaaaatagtatggaagactgagttatagtcaactgacattgtctttttactttatagctggatcatcattgaactaaaacacaaagcaagagaaaaaccttatgatagtaaaagtttgcggacgtaagtgcaattaaatgcatcatattcttgcacagttggtggctcaaatcttccatcctacaccattagaaaaagcaagtctaaatgcttttttatatttctgaaaaataaagttacttgaaatagagttgcaagaatagcacagagattctgggaatacacttcactcagattcaccaattaacattttggcacatttgctttttatatgtgtatgtgtggatgaatatgtgtgtgtgctttacatcagtgtatctatgcatgtataaatatttttcccagaagcacatgagagcaagttgtagacatcaggcccctttacccctaagtacttcagtgtatgttttcctaagaacaaaaggcattcttttatataaaccactatacaacgatcaaatttaggaaaaatttttttttttttttttagacggagtctcgctctgtcacccaggctggcgtgcagtggcgtgatctcagctca

SEQ ID NO: 94158 - DNA, 2038 bp, Homo sapiens
aggctggagtgcaatggcgccatctcggctcaccacgacttttgcctcccaggttcaagcgattctcctgcctcagcttccctggtagctgggattacaggcaatgtgtcaccacgcctggctaattttgtatttttagtagagatggggtttctccatgttggtcaggctggtcttgaactccggacctcaggtgatccgcccacctcagcctcccaaagtgctgggattacaggcatgagccactgcacccggccttacctttcatttctttagtaatttagttttaaagtagttctaatccaaataaaatactttcatatcttatttaaaaatcttttcaatataagaaaatcctcttaggaaaaattgtacattgtaattatgtttggttgcatggctgtcttatttccctttgatagatttagagacctcccaaagatttcttgattagtgataaacttagttatccactaatggaaaggaacagtgatgcatgtagattatagaaaatcaaacactgaatattctgattctcaattaatgttattttcaaatgattttgattatattagtattaatttgtattattcaatttttttccccagtatgagaataatgttatcactattgatctggttcaaaattcttctcaaaaaactcagaatgatgtggacatagctgatgtggcttattattttgaaaaagatgtgagtatcatcttctttattcctgtgttcaggaatgtagtctatcatgcctcaatgaattaaatatatttcatcacctttttatccacttacagatcaaccaaatggttcgctgctgccgttaattttgtcctccctgtcactcacatgcatcttgcttgtttgtatatttatgcctcttatcaaattgttctgcctaaaatatctcccctctttcttataattcttatttattatctacttggtggttacttagtttgtgcatatatgctcccctatgatatttataatttacacaaataaaagtctgttaaaaaagactgtaactgatatgattaaaatattttgttgaaactttaatatattatagtgaggtattttctgctgaaatatgaggtttgcttcaaaataatctgggcgggggtgaaaggatgaaaggaagaaaagatgaagtaagagaggctatgtgttgttggccttgcatctgggtgataggtacatgggcatcattgcactactctttctactttcgtgtatgttgaaaggttcctgtaataaacagttttttaaagttccaataaattagattgttatcactaaaaccataaagattcttggcagcggttcttttggcatacaatttgtatgtaattatatgtggccatggttggtttccttaaatatttttaattccttttctccttttcaatacaggttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggtgagtacagaacaagtaaaatttcatttaagggtatattttttcaagaaaaagtaatagtggctgggcgcggtggctcaccacacctgttatccctacactttgggaggctgagacaggtggatcacttgagcccaggagtttgagaccacactgggcaacatggtgaaaccttatctgtagtaaaaatacaaaaattagtcagatgtgatggcttgcacctgtggtcccatctacttaggaggctgatgtgggagtggtcagttgagtccaggaggtcaaagctgcagtgagccatgatcacaccactgcactccagcctgggcaacacagcaggaccctgtctcaaaaagaagaaaaaaggaaatatgaaaaagtaacatccatattccaaaacattcagggaaaaaaat

SEQ ID NO: 94159 - DNA, 1127 bp, Homo sapiens
aaaaatagtatgcatttaataaaaatcttattcttaatgatctagcttacctccaacttgccctagtcactttggcgatcttgtctctaaatagaaccttgaaaacacttaaatgtgtgtttccttgcaatataactttttctttttttatttaaataagtcttataaatgtgggaaaaaattatcttgtgttcctttaatttcatttttatttaatactattttcagaatgaacaaaagattgaaaaattatttagaatttttttctgtgctttttcctgtttcagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaatttcttaactttgacatttcaaatttcttcttctttttcttttcttttttttttttttttgagatggagtcccactctgttgccaggctggagtgcagtggcacaatctcggctcactgcaacttctgcctcctaggttcaagcgattcttctgcctcagcctcccgagtagctgactacaggcgcccaccaccattcctggctaatttttgtatttttagtagagacaaagtttcaccatattggccacgctagtctcgaactcctgacctcacgatccacccacctctacctcccatagtgctggggttacaggcgtgagccaccgcgcccggcctctttttttctttttgttttgttttttctttttttttttgagacaggatcttgc

SEQ ID NO: 94160 - DNA, 1026 bp, Homo sapiens
ccacctaaatcccatcttgaattcccatgtattgtgggagggacctggtgggagatagttgaatcatggggatggatctttcccatgctgttgtgatagtgaataagcctcatgagatctgatggttttaaaaacggaagtctacctgcacaagctctttctttgcctgctgccatccatgtaagacatgacttgttcctccttgccttctgccatgattgtgagacctccccagccatgtggaactataagtccagtaagcctctttttcttcccagtctcgggtatgtctttatcagcagcatgaagtccagctaatacagtgcttgaacatgtaatatctcaaatctgtaatgtactttttttttttttaaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggtaattatcttcctttttaatttacttatttttttaagagtagaaaaataaaaatgtgaagaatttaattgtgttttagtattttaagtagattgtgatagtagaatggtttgagacactttaatagcaattagcatgtggtttttaaaaagttgcagtttggctggtcgcagtggctcatgcttgtaatcccagtattttgggaggctgaggcaggtaggttgcctgagcccaggagttcaagaccagcctgcccaacgtggtaaagccccatctctactgaagataaaaaaatttaaaaaaattagctggggctattggcacacacctgtggtcccagctaatcaagaggatgaggttagaggatcacttgagcccaggaggttgaggttacagtttaactttcagaggccaaggcaggaggattgcttgagtccaggagtttgagaccaccctggggaatgtagggagatcccatctctatagagggatagat

SEQ ID NO: 94161 - DNA, 1055 bp, Homo sapiens
tcgagaccagcctggccaacatggtgaaaccccatctctactaaaaatacaaaaattagccaggcgtggtggtgtgcgcctgtattcccagctactggggaggctgaagcaggagaatcgattgaacccttgaggcagaggttgcagtgagttgagatcgcaccattgcactctagcctgggtgacagagcaagacttcatctcaaaaaaaagagaaaacattttattaataaggttcatagagtttggatttttcctttttgcttataaaattttaaagtatgttcaagagtttgttaaatttttaaaattttatttttacttaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacaggtaagcaaattgagtctagtgatagaggagattccaggcctaggaaaggctctttaattgacatgatactgtttcatttaaggaaaaataataaaaaaactcttttttttgtatctaattaaaataatgttctgatgtttacagaaactttgtatatttaattggacattagaacaagctgtttgttgtgtaagatttattttacctcagatcttttctcccccctttcctttctgtcttgtgttccaaaagagtaattattacggtaaatattactgtaattatggatttatcaaataagatgcagttctttagcattttttgataaatcgagtggaactttagcctgttattttactatttgttttattttaactaaattctgattgtgtcattttttttttttttttttgggaccgagtctcgctctgtcgcccaggctggagtgca

SEQ ID NO: 94162 - DNA, 1004 bp, Homo sapiens
tcacaaggttgaaagggcctaatttttgtgtttttagtagagacggggtttcactatgttggctaggctggtctcaaactcctagcctcgagtcatccacccgcctcgtcctcccggagtgcttggattacagcatgagccactgcgcccggcccccattttagttttgatggacatttgggtaattttcttttttggctattctaaataatgctgcaattactgttaattttcaccttgtaaaaaccattttcaaatctcaagagattaacctttagttttcttggtttggattgggaaggaacaccaaggaaaatgagggacttcagaatttattttcattttgcatttgttttttaaaatctttagaactggatccagtggtatagaaatcttcgatttttaaattcttaattttaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcaggtaaaaaaaaaaaaaaaaaaaaaaaaaaagggttaaaaatgttgaatggttaaaaaatgttttcattgacatatactgaagaagcttataaaggagctaaaatattttgaaatattattatacttggattagataactagctttaaatggctgtatttttctctcccctcctccactccactttttaacttttttttttttaagtcagagtctcacttgttccctaggccagagtgcagtggcacaatctcagcccactctaacctccacctcccaagtagttgggattacagttgcctgccaccatgcctggttaatttttatatttttagtagggttgcggggacagggtttcaccatgttggccaggttggtctcaaacttctgaccttaggtgatcctcccacctcggcttcccaaagtgctgggattac

SEQ ID NO: 94163 - DNA, 1077 bp, Homo sapiens
ggagttgagaccagcctgggcaacatagtgagactctgtctctacaaaagaaaaaattagcggggcttagtggcgtgcgcctgtagtctcagctactcgaaaggctgaagtgggaggattctttgagccccaagggttctggcttgccgtgagccaggatggcaccactgcactccagtctgggcaatagagtcagaccctgtctcaacaaataaaataaaactgtagtaattataaagtggttttggctgggggagaaatgtacagttgaacatacggattaagaggttgaaagttggtcttaggaagaggaactttttgtggaaatttcttaatatttgaagaatattatgttattgttcctctgtttttcatggcgtagtaaggttttcactaatgagcttgccattctttctattttattttttgtttactagggttctgttgaagataccactggctctcagtctctggctgccttgctgaataagtgtaaaacccctcaaggacaaagacttgttaaccagtggattaagcagcctctcatggataagaacagaatagaggagaggtatgttattagtttatactttcgttagttttatgtaacctgcagttacccacatgattataccacttattgtaatatgcagttttggaagtatatgttaccatttaactgtacagagtacatagtaatagagtggtaattatttagattgattaaagaactcatttttttaaataagttttttttttttcactataaaagtttattttatttgagatggtatggtatcgaacatgttcatattgtgtgtaatcgtgggtaaattactcaacctttatgtcatagtttcttcacctttaaaatgacattaataaaagagctacttaataggattataagcatgagatgatttaatatacataaaatacttacagtctgatatataggaagcacttaactctttatcctagaaaagatttaaggtgaccttaacatatatgtcagaaaatctttaaaattgtggaaataaaaggttgtataattctgctatcctaaaattactagta

SEQ ID NO: 94164 - DNA, 1118 bp, Homo sapiens
gtgtgagctcaggagttcgagaccagcctgggcaacacggtgaaaccccttctctagtaaaatacaaaaaattagctgcatgtggcggcgtgcacctgtggtcccagttacttgggaggctgaggcaggagaattgcttgaacctgggaggcagaggttgcagtgagctgagattgcgccactgcactccagcctgggcaacagagtgagactctgtctccaaaaaaaaaaaaccccaagaatttgattaattctgttggaattttaagagttaactgatccccaaaatgactcagctgtatgcaatttaatgcaatattaattcgcatgttgactctcagaattgcatacagctgagtcattttattgagtaggattgataagtatactatgttatgccaacagtaactgtgatgcttctaaaattgtgatttttaaattggcattgtcacagaaacagcagagtagttgtttttttctttaagcttcttttagccagaaacataaactgaaactgtaattattactgcaatcgtatgttgaatagacttgtgaaactagcaatttattaggcttttaatgatatctggaccaaaggctgagggagctgtgctgtgtgtatgttgctttgtgctttgttttttagaagcttgtcgtttctttgccattttacttctttctttttttttgagacggagtcttgctctgtcccccaggctggagtgcagtggcgcagtttccgctcactgcaagctccgcctcctgggttcactccattctcctgcttcagcctcccaagtagctgggactacaggcgcccaccaccacgcccggctaattttctgtattttttagtagagatggggtttcaccatgttacccaggatggtcttgatcttctgaccttgtgatccgcccgcctcggcctcccaaagtgctgggattacaggcttgagccaccacgcctggcccattacccattacttgtttcttaatgttacattctctttccctctttttttttttttgttttttgagatggagtttcgctcttgttgcccaggctggagtgcaacggtgccattttggcccactgcaacctctgcctcccaggttca

SEQ ID NO: 94165 - DNA, 1169 bp, Homo sapiens
gatctgcccaccgtggcttcccaaaatgctgggattataggcgtgagccaccgcacctagcctagattcaggctgcttctttttttttttttttttgagacagagtcttgctcttgttgcccaggctggagtgccatggcatgatctcagtgcaccacaatctctgcttcccaggtttaagcgattctcctgcctcagcctcccaagtagatgggatcacaggcatgagccaccatgcctggctaattttgtattttttgtacagacggggtttctccatgttggtcaggccagtctcgaactccctacctcaggtgatctgcctgcctcggcctctcaaagtgctgggattacaggtgtgagccactgcgcccagcagattcaagctttttaaatggaattttgagctgatttagttgagacttacgtgcttagttgataaattttaattttatactaaaatattttacattaattcaagttaatttatttcagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggtaacaagtgattttgtttttttgttttccttcaactcatacaatatatacttggcaatgtgctgtcctcataaagttggtggtggtgactcactcttaggacacattcagatttcttttttttttttttttgagaaggagtcttgctccgttgccaaggctagagtgcagtggcacaatctcagctcactgcaacctctgcctcctgggttcaagcgattctcctgcctcagcttcctgagtggctgggattacaggcatgtgccaccatgcccggctaatttttgtacttttagttttaccatgttggccaggttcgtctggaactcccaatctcaggtgacccacctgcctcggcctcccaaagtgctgggagtacaggcgtgagccacagagcctggccatgttcagacttctaataacaggtttgtattgactcttagcctcatggcagaagccaagagacatgagaca

SEQ ID NO: 94166 - DNA, 1273 bp, Homo sapiens
gcagttctcctgcttcaacctcctgagtagctgagattataagcctatgctaccacgcctggctaatttttgtatttttagcagagatgaggtttcgccttgttggccaggctggtctcaaactcctgaactcaagtgatctgcccacctcagcctccgaaagtgctgggattataggcatgagccatcatgtccggcctccccatcatgtacccttaaataccatcaagcacagttccattgtgtaaaaacttggcttgatttaacctgttaattggaacactgtcattaatggaaattaggaatatgaggtaagctagaggttttattttaatgactttgggttattaaatctataagaaatgaaattcatttagtcataattaatgtcatgtttctgcatctatattacttgttgggtttacagacgaggtagtgtattattagtgggaagctttgagtgctacatcatctccctttctataaaataaattgagtacgaaacaatttgaattaaaacacctgagtaaatagtaactttggagacctgctgtactatttgtaccttttggatcaaatgatgcttgtttatctcagtcaaaattttatgatttgtattctgtaaaatgagatctttttatttgtttgttttactactttcttttaggaaaacaccagaaattattgttggcagtttttgtgactcctcttactgatcttcgttctgacttctccaagtttcaggaaatgatagaaacaactttagatatggatcaggtatgcaatatactttttaatttaagcagtagttatttttaaaaagcaaaggccactttaagaaagtttgtagatttttctttttagtatctaattgtagcacctttgtggacagtggatgtaatattaagtgacagatgggaaaaggatttttaaaaaaatagcaactgtttcagtggatgaaataaagattattagcagagaaaatgaatattgggcataactgtcctggtgaaagacaatctcataaatgaacaatttcataatttcgtaaatgcaactgcattttattttcaaagagaaggaaaattatagtcactggaaacggaaagagaagttagaggtaaacataggacacacaagaaaactttcattttgtttattttcttgtttttcttttgagacagggtttccctctgttacccaggcttaagtgcagtgacactatcatagttcactaacccctcaaattcctgggttcaagtaatcctcctgc

SEQ ID NO: 94167 - DNA, 1029 bp, Homo sapiens
taaggctgtcttttaaataaatcagattccctgttaaagatctgttctagattccctagggggttgacctcatatagtatcttctttttctttggttacaaacttttaaacttgtctgaggttataaggtgaattcaactgtccactgtcaatgtagatatttttaatggatttagggatttaaattacatgattcagaaccactttgaggaagtctagggaatatcagttgtttctgtataatttctgaaagcttcactgttttctaggtgtgcacttaattcatgtgatgaagggaacagtatttacatgagtggtttggttaatttttcccctcctaagcttagctttgtgtatcgtgcgtgcttccagtgtttttgtggctgctttacataagtcttttagaagtattttctatttttgaagtaaatgtggatcaaaaccaccccaagacaggattgaaaaaaagacagtttttcgcaagaaagtaaataattttatttagcttgggactttaaatgatatgtcttaaatgtaaacatttctatactgcattttggccatcttttgatactagttttcagatgcatattgttatttcatttattattggaaaagtagtaactttaaacaaatttttattgaaaatgctgacagaggccgagtgtagtagctcacacctgtaatgtcagcactttgggaggccgaggcgggcggatcacgagctcaggagatcaagaccatcctggctaacacggtgaaaccccgtctgtactaaaaatacaaaaaaattagccgggcatggtggcaggtccctgtagtcccagctactcaggaggctgaggcaggagcatggcatgaatctgggaggcggagcttgcagtgagccaagatcgcgctactgcactccagcctgggcaacagagcaagactccatctcaaaaaaaaaaaaaaaaagaaagaaaatgctgaccaaaaaaaatgaaatagttttaaagaagccacagttgtgtgatcctgatacaacta

SEQ ID NO: 94168 - DNA, 1062 bp, Homo sapiens
tacaagtatgagccacgatgccagtccaattcttgtgtagttttttaatcagctgaatttaacattcaaattcttcttttaaatcttccaataggcagttatctttataaagatcctatataatcaagactttgtttctgaatattttatgtatgtttttgctactgtaaatgagatctatttctcattgtggtttcttgctgttattactggtaagaatttagtgaaacaaagtacttaagagtatgtctttaaattgtgagattttgatgaacttttaagaaataaaattctttagtttcttagagctttttgagatttctaaggtagatccttggtttgggcaacatataactattacaagttttgcacattgaacgttatttggtaatttttagagaggacattttaaatgtttaggaaaaatataaataaaatgtagaatactattgggggcatatacatcatcagcactgtaactgtttcatatgaatcatttttgtacatatagaactctaaagtcctaatgaacagaattttacatttctataaatagaaagtccttaatagttgtgactgaataacttatggatagcaaattatttaactgaaaacagtaaaatttaagtgggaggaaatatttgctttataatttctgtctttacccattatttataggattttgtcactttgttctgtttgcaggtggaaaaccatgaattccttgtaaaaccttcatttgatcctaatctcagtgaattaagagaaataatgaatgacttggaaaagaagatgcagtcaacattaataagtgcagccagagatcttggtaagaatgggtcattggaggttggaataattcttttgtctatacactgtatagacaaaatattgatgccagaattattttataagttccctgtccccaagatgatgacttcacatctctgtcaaacagaaatcgcccaacaggcccttgtatgatgtcatttaaacaagccctattttaaatgtcacctccactggtaacaggatactcctaggaggatcaccaagcccaat

SEQ ID NO: 94169 - DNA, 1050 bp, Homo sapiens
tccaaagaaatacctttggttaagaaaagaattctcatgcataactcctcgagggtggggttacaccttaatccatcctcaggtgctcatggtaattggggcaaatatgttgcccagtgctggtgctctgcagccttggatgggtttacccagaaagcagctttcaagtcagaaactaacattcataagggagttaaggattttataaatagatatccataattcatgtagttttcaagtaagtagtatttgaatcttttctggttagataataattgtgagtatgttgtcatataataacagtatgtttttcactatttaaataattttagaattacattgaaaaatggtagtaggtatttatggaatactttttcttttcttcttgattatcaaggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacaggtttgcaagtcgttattatatttttaaccctttattaattccctaaatgctctaacatgatgtgaatgttctatgataagttttactaatgtagtcatcaggtaagagtcaagctttcttccatagagcagtcagctgtcgcaacaccatttgttaaatagtccgtctgttctccattgactgaagtggtactttgggtctattttaaagactctacttttacctcgtctcaccattcttttgtctacacaaaatatattttatcgcttattctgtgttaccatatctattagagctagttccccctcatatctctgctttagttattttcacatgtttcttttatcttttttttttttggagatggagtctcgctctgttgcccaggctggagtgcagtggcatgatctcggctcactgcaagctccgccttccgggttcacgccattctcctgcctcagcctcccgagtagctgggactacaggcgcccgccactgcgcc

SEQ ID NO: 94170 - DNA, 1047 bp, Homo sapiens
gcttcctgagtagctaggattataggcatgcaccaccacgcctagttcatttttgtatttttagtagagatgggttttcaccatgttggacaggctggtctcggactcctggcctcaagtgatccacctgcctcagcttcccaaagtgctgagattacaggtgtgagccaccgtgcctgacccacatgtttattttttctaagaaaactttactatcatttatcaagttaagaaaattattctgatatttcaattgggtgtttaaattagttgagggaaatatgaggccattcactagatgataggttttttttgttttaatcatgtttcatgttgaaacaaaaaagttttttcctgccagttttctggctaatctcaggaagtccctgaaacaaattattgataagtaaaaaaaattatttaaaaaattttaaattatatttaaaatcttctgtgacttatggtggggggaggctaaagcctttctccttctgtactgttctggaaactatggcctgttctactccctcccctcctgaattttcccagaactttacaggtagcttttatatatatgatcccctgtcgtctgtttaacaagtactttgagtgtctattatatgcagacattctaggtgttcagacaccctagtaattagtttgttcctcataattctcagtaaagaagacatgtatatttctcattttataggtgaagaagctaagactttacttttcctcagttagacagctagtgctggtgggtgcctaaacttagatcttccattgccaaatctaggtgtgttgtttttccagcacactagaatcctcctggttcaagaaatgtatatattttagcttggataagatacaacttttggagtgttctaatcatcttcaagtttttcgtggattagttataacatatgaaaaaagatagggctgaatgggccacatgatgccaaaagtgaaaaagtcactcactagattatgacctgcagaatctggtccttgcctgcctctgcttttatattttgcagcttgtcc

SEQ ID NO: 94171 - DNA, 1333 bp, Homo sapiens
cacattgcttctagtacacattttaatatttttaataaaactgttatttcgatttgcagcaaattgacttctttaaatgaagagtataccaaaaataaaacagaatatgaagaagcccaggatgccattgttaaagaaattgtcaatatttcttcaggtaaacttaatagaactaataatgttctgaatgtcacctggcttttggtaacagaagaaaaatcatgatatttgaagtgtgttttgttattttcgcaagccattacattctgactatttaatatgttaggtttcctatataaaataaggcatggtatgttacagtaggacacataactggaagttactcttgcacatagaaacaaaaaatggcagaaaagcacaaaacttactatagttgtaacagggaaaggaaacactagggcctacaacgtactaatgtcttgggtcatctatgggctcatgaggctctaggttatggaagtaaataccactgaaaagcaaatattaattacacatgaggcaagcctttttgagttctgtatgtcattttgtagattttgagttcattctagtggcaccatttgagatcattttcatgtaattaaaggaacacagcaacctggcactgtgttattgcccttagaatggaatgaatatatgtttagcacaaggtaggaagtgatgcgttaagttggaaggctttgccgatcatggtgtgtatgttgactaacctttattgtgcctttaaaaaatatactcaagaactaccttaaccaagtaattaaagtcaagattaccagttgtgggacaaatgacatgtacttcctggtgtgatatagaaggaaggacacagtatcacctatatagtattcttgaccagaatatttaacctgattttaaacaagaagtaaaaattcaaataaatttagattgtggtgcattcaaggcctgaactttaataaatgtccatgtcacggcagcaaaaaagaaatcaacaggtcttaaagagacagggcaaccaaacgcagtaggcagtagttgattagatcccaatttagaggttggagttggggaatagctatagaggacactattggggcgaattgagaaagtttaatatgagacaatatggtgttagtgtcagatttcttgtgtgaaatggtagtgttatgattaggagaatgtccttgttctcaggatatgcatgctaaattatttaaggacaaatatttttttaaaaggttatgtgcatgagtaattctataaattgtgttgctattatgaattgtcatggtaaatcaaaaggaaacataaaactcaaaaggttttattt

SEQ ID NO: 94172 - DNA, 1234 bp, Homo sapiens
aatctcagcttactgcaacttccaccttctgggttcatgcaattctggtgcctcagcctcccaagtatctgggtttacagacatgcaccaccatacctggctaatttttgtatttttggtagagatggggtttcgccgtgttaccaggctggtcttgaattcctggccccatgtgatcccccggcctcatgcgatctgcccgcctcagcctccctaagtgctgggattataggcgtgagccacccaacccagccagtactctgtttttgatagctattcacaatgggaaaggatgtagcaacacattttaaccctatgttgagttttaggtgggttcctttgaaattttgttaaggctaacttttgttaatttttttaaaaaagtgtaaattaggaaatgggttttgaattcccaaatggggggattaaatgtatttttacggcttatatctgtttattattcagtattcctgtgtacattttctgtttttatttttatacaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggtaaaaaacctggtttttgggctttgtgggggtaacgttttgtttttttttttttttttttaatcttggagtagaaatatatttaaaattgatggagaaaattcccagttcttaacattagaaagggaatatattattcttaccagttagtaatctattcacatttggtttagagggaagatttagaaggtgagataaaagcttgtgagagaatagtgtattcatgtgaaacttcttccatgggttcagagcatttagaaacaaacatcccttcacactcaaagcttacctttgagccagtcctccaatagtgaggtctttgaaggtcaggccaaattggctgtgggaggacctcaggttaggataggaattattttaagacatggcactatattcatgtgaaactcgcaaaaactagccttgcatataggctcatgtatcatgtctcagctgagatgtttgagagatcttaactagattctaga

SEQ ID NO: 94173 - DNA, 1142 bp, Homo sapiens
tcatgtcttcaggtttttgtgtggggtttaaatgattcgaaagatttgaccatactgatacattcactagtaaccttagttactaatgagtaatggttttgagttaatcagttaggcctgaactacttttctggaagttagtaaattatctcacaggcagccctgtgagccatgggaaaatgtgtatatggtctttctaggccacagtcaaattacaggtatatttgtcatggcttctcttgatgaaaggcccagtatcggtttgtctgaagatatataatagcattgcttttgggggtaatatgggcagtaactctgtccacatctttgggcaggctgtggttctgcctttatatgctatgtcagtgtaaacctacgcgattaatcatcagtgtacagtttaggactaacaatccatttattagtagcagaaagaagtttaaaatcttgctttctgatataatttgttttgtaggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtaagtgcatctcctagtcccttgaagatagaaatgtatgtctctgtcctgtgagaaggaaaagtatatttgcagattctcatgtaaaaacatctgagaatgtttgtcttagtttaatagttgttttcctgtggactttatatactttgtattgtcttaaaagagtgattgatggtagctacggaaaactttgatttttaaaattgtctctttaagtagacaatttataagctactggtacgagttcaccttataaatctccactaccatgtttttgcttggactgttcacacttcctggaatggtccttcttgccgtttatccaacttctttctaatttttaagtccctaatgatgggaattctatttctgtagtgatttttctggtcatacgaccgtaaggtcatgggtgtttttctctgaattcctcttgagatgcctgtaacttgaaccacgttttta

SEQ ID NO: 94174 - DNA, 2106 bp, Homo sapiens
aaatagtagttatcacatgcagagtgacttatctgttgttgtttcatcctttcaggaaagtttgtcattcgtgggcttgggatctagtcagatccctgtattgatgagattcacatgttataaggctttcaaaggttttaaaaatcatactataaggattgatttcactagtcaccagaataactttttcagatagcgctctgattttccacgaacacgtttttctgcatcagttggttgcacatgagtgagataatcttggttctttatcctttgttatttgtacttcattgggaatccttttgagttagtatatttgagtcattattattattgctgtagaattcaggaacttttagtagatctggcagcataaaattttgcttttaaatcattgtttgtgttttgtatgctatagaaatgggttcagaatattttttaaaaggccagatgaagtgtgaagatagaaaaacttcatccttcactgtgaatgtttaacaaacatttgcttctactttatttttgtttgcttcctttagttgtgcaaagtattcagttctagaatgcatgagatatatgacaaagccaaaaaattctttatagttgataaataattgtggcaaaaacagctgtatagtaactttgcaagcatcatttgattaaatgcttaaaaagtcttgactcagttttaactatttcctgcaaataatcaatatttaattaaagctactccaaattagtgacactttacgtgtctgtctttctccctccccttctcccttctcccttcccccttctcccattctcccattctcccttctctcttcttcctttcctcttcccttcccttcccctttcccttcccccttccctcttctcttcccctcccccttcccatcccccatcccttcccttcccccatccctttcctttccccttcccttccctcctcttcctccttcccttcccccttcctccttcccttcccccttcctccttccctttcctcttccctttccccttcccttcccccttcccttccctcttcccttccccttcccctttcccctccccctctcctcccctcccttaccttcccatgaaatgagaaagcctcagagatagtggcttgattaatttttctttagattaagatatttgtctaagcctttaaggtttatctattgagcttttttgtctcctatttttatttttcctactatgtttgtcgaggataaaatacagcactgtgtgccaagtcataatcacttttcatttgagacttaattaaaatgcctttattttaatgatatatttggctaatgtatttgaagtaatccgaaattaagttttctaatgacaaggtgagaaggataaattccatttacataaattgctgtctcttctcatgctgtcccctcacgcttccccaaatttcttataggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagaggtttgtcagtttgttttcatagtttaacttagcttctctattattacataaacaggacactaagatgaaggttttttgttgttgtttgttttcctctgtgtttctagtgcttattttttaatcagtttttttgatggcaaagaatctatctctgtgttattttgatttctgcagtatatacatctgcatgatcaatattcgatttcaagtaccaaagtaggagtaaaggaatattaacctaggtttaaaattagtcatttcactaaaattagttattatggacgatagatgtctaggtatatctttgttcataaacgaatatatcaagttcagttattaaattacacattaggtaagaaaaggacaaagaaataaaaaagcatgattcataattcctgccctctatttgtctagaatttagttgggaagataagaataacgaacgtgacacagagaataaagtggcatatgacaaatatttattca

SEQ ID NO: 94175 - DNA, 1992 bp, Homo sapiens
atggggtttcaccgtgttagccaggatggtctcgatctcctgacctcatgatctgcctgccttggcctcccaaagtgccgggattacaggagtgggccactgtgcccggcccttttttttttttttttttttaaattagaggattactagttctcttcaattataaaaataaaagaatcttatttcactgcctggtcctggaaacatgtactgcaatatacattgtgacaactttttacctgtcatgtttttagcttttacctgtgaatgtcttatcattgttcttatctgaaggatagatagttgctacaataataatagatggtgtgtatggtttttgagcctaaaaagtgtagttttatctgttgtacctatacaagcaggagaaatataacttgttaataattttaggtatggcaggctgccatcctaaatatgaagtggtctttgtatttgcactttaatgtgttgaaatcatagctttcagtgatccaggattaggcagactcttttatgcaatctcttgtttccagttagaatagaagtcgtgtacttttgataacattaattataatatattttgagccctgtgaggttggtaacattattcccattttatgaatgaggaatgtgtgttaaggagtttgcccaagagtcacatagcaagtcatagtcatgctctctgaagcagcaataacttggcaataaaataaaaatgaagcatcttctgtatgtgttaacttttcagtgactgtttatgccttccagtattctttgtaaaccttgaattctttttttcacagatgattaaagtttatcaattgtaaaggtggaggaatttgggaactagacagtgcacacataaataataaatatgttcttcaaatattgggtgggctaatgtgggaggagtttgagaccagcctgggcaacatagtgagaccctcgtctctaaaaatatgaaaaataaaaaaaaaattttttaaatgtgtgatatgtttagatggaaatgaaacaatttgtcactgtctaacatgacttttagaaaagatattttaattactaatgggacattcacatgtgtttcagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtggaatttgagatgcattgtagttcttcgcagtgtgacttcaaatattttggaagaaacaaatagctcagagacctcgtaaaatatcttaaactggagggctccatggagatcattgcgagtgactcccccagaatgtccatctgttgacaggagccaggctggctgcatacgaattagctaaggagcttattatatatccagagtcctaccgtgagcctccatcccgtctgccattctcccatccctggtctatgataagacttagaaatctggattttaacaaaacgtttcagattgagaaccttgatttagtctacttctcctattttacaataaagagatgaagcggttaagaattagctaatcctacgcaaagtgagggaaaaaggacagtctttttaataaatgcggcgggctggtggggtatccatataggaagaaatgacattggacccctactc

SEQ ID NO: 94176 - DNA, 1135 bp, Homo sapiens
ttaagaatctcattaacaaaaagaatttgaatatttttccaaggaagatatgcaaatggactgtaagcacatgaaaagatgcagatcagggaaatgcaagtcaaaaccacaatgagctacaacttcacactgattacgatagttaaaatcaaaaagtcagatggtaagtactggcaaggaagtggagaaattgaaactgtcatgcgctcttggtgcgaatgtaaaatggtgcagctgctttggaaaacagtctggcagttcctcagacaattccactccaacgtatatccaagtggaatcacaacatatgtccccacaaacttgtacataaatgtttatagcaggattattcataatagccaaaaggtggaaacaacccgaatgtccatcagcagatgaatgcataaatgaaacgtggtctatccatacaatggagtatattattgagccattaaaggaatgaagtactggtacatggtgcagcttagatgaaccttggaaacattgtgctaaatgaaagaagctggttacaagagtcaacacgtatgatttcattcatgtgaaagttcagaatagagacagcagtagagacaaagtagcagttcagggttggtgccagggaatagggggtaggtggggtgaaagctaaaggatacggtgtttctttgtgagatggaaattctaaaataggtgatgtttatacatgtctgtgaatatactaaaaaccattgaattgtacacattaaatggatgaattgtataggaattatattttaataaagctatttaaaaaaatccagacacttcacccaagaggaaatctaagtggtccataaacatgaaaaggtctttaatcaccagtcagaaaaatgaaaatgaaaaccatgccaggccacctcccaccaccatagtgacaagcatttcaagtgtggcagttccagctgttgttgaggatgtggaataacactggtaggggtgttaagattatctggtgaaattgaaaagacgcatacgacccagcaattctgctcttaagtgcatactctggagatgcttttgcccattgtgctgcgagatgtatacaagaatgttcctaatacctccacactggaaacaactcatcagtgaaaatgaa

SEQ ID NO: 94177 - DNA, 1026 bp, Homo sapiens
catgagaagaaatgagattgcctagagagagaagaagaagagaaaagagtctccgctaacgttaatgcctggtagaggagggaaccctggcaaaccctgaacatcataggacttcccttaagagccacaggaagcaagttcaaggtgcttctacctaacagctctttggatatttgatgacaaggggtagtgtccacctctagattacaccttccaagttccctctgtctttccttgtaaggcataatttaaagctcttcaccatatgggtcattctcctcttaaagttcctttcttgaactgagtgtaatgctccagccccaggtagaaagggaccagctgagccatttatcactatccctgtttagtgataaatactaaacaggaggcagcatcaggacagggaggacagatgagccctgctcggttgttgctaagagatttttcattgcttttcccatccgtaggaaagggcgaaggatttcagagaaagcctcataaacaattgaatgagctcaggcactctgttactgcctgacagcctcagtggcagagacctagattgtttcccagaggaaaaaataaatagtgtaaaactttcaagatgtgcgcgtcaaagggctgtttgcctgctttacggtgagagctcaagatggatggtttgggaacagctgaaacctataaacacagagcagaaaagttctccatcttttgctcatttattccatgaactttttcattgctgagatgccaaggcctaaataaatatgcacgctatgccattgttccgctctgagtcccggctggaataggagacctacattcttcattaatgctgttcagattcacaggatgaatattctgctttggttactgcacatggtgcccagaaatcgcaggaacaaaaaacatatatgtgtgtctcatgtgcacattcacatacacacacacacacacacacacacgcacacacacaccccatgtacatatcctaagccttccggatgtggagtttgaaaacgtgct

SEQ ID NO: 94178 - DNA, 1023 bp, Homo sapiens
ataaaaattccatgagacataaacagctagccatcatcttaaattattttcttgctgataaatttttttttctggggcgttcctgagtttatttggggcacacccgggcgagggccctgcacctagaagaaggtgttgggcctcttggtggtgaagcgtggcttgtgctgacggcgcaggacccggtggggcagcgggaacttgatcttggagtcgtggaactgcttgacagccggccggcggcacttgctggccgcgatctcctccaccttcatgatctgaatggagtgggcccggccgccgtgccgggcgctcatgtctcggtagcaccgggtgacagcgcctgcggtggtcaggtcccggtattcccggtacatgttgtgggtgccgctccgggagtcatagcgcagccagatcccgaagttcttcacccgcaaggggaacttctcaaacacctgcccacagtagacaatctcccctgaagacttcttcatcttctttaactgagatacgaagtaccagaagcgggacttggcgacgacatgattaggcgcaaagattcgcatgcggtagaggggtggtgtgtggcatttgggggtgggcaggcagcgacccactactttgtactctcgtagtgtgcccgaggccttcatggcgtgctctccgcgttcgccgccacccgcaaaaggagacttgctgataaattttgtaacataaaaacaacaggaacggctgggcgcggtggctcacgcttataatcccagcacttcaggaggctgaggcgggtgtatcacctgaggtcaagagtttgagaccagcctggccaacatgataaaaccccgtctctgctaaaaatataaaattagacaggcgtggtggcttgtgcctgtaatcccagctactcaggagactgaggcaggagaattgcttgaacctgggagacggaggttgcggtgagctgagatcgcaccactgcactccagcctgggcaacaaaagtgaaactgtctcaaaaaaaaaaaaa

SEQ ID NO: 94179 - DNA, 1053 bp, Homo sapiens
tatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccaggtagcggggtgggggtggggtcgaaggcgggggcatagcggcggggcgcttggaacccggcgaggggaggctcgcacagggggttgggggggtgcacggcctggccctgggctcggaggaggcggggccgcagagttggcttgaatgagtgcaggggtcgagtctggagcatttgggggtgtagcttgtaaacagggtcggaggagagaggctgtgcaggaagagggctgcaggggagacgcggagagttcgggccttttggagggaggagacgcgtcccgccaggtgggggtgctgggctaaggaaggggcgacgcgcgcagctccgggtggggagggggcctgggaggtgggagcactgggggtggggcgagaaggggaaggcgcccggcccacttggtgggcggggcggggggcggggtggcgggaaggaggaatgcctgcgggaggccgaacggggagagtccggtggtgtggggtgcgaaaggaggttcctcggccggcgcggagatagtgagttggggctccagtagtcgatcgaggtagacacttagaggtagttaagagccgcggtcgccgagacgccttggggacggtgggccttcggcctaggtgaggggccgccgagggggtgggccacgagctgcgagcgcgggggggtgtgtcaccatggggaccgcggggcctaattgggcggggcggggccgtggggagccgaagtgctgggatccggctgggtccttcggtaggtaggctgcacgtgcaccgagacgaagatagaatattttgacg

SEQ ID NO: 94180 - DNA, 1030 bp, Homo sapiens
ccacccttggctaatttttgtattttttttttggtagagatggggtttcaccacattgcccaggctggtcttgaattcctgacctcaagtagtccgcccacctaagcctcccaaaatgctgggattacaggcgtgagccaccacacctggcatatatatattttaagatagagatggggtttgctatgttgcccaggctggtcttgaactgctgggattacaggcgtgagcctctgcacccggcccttattgtttataaatacatttctttctaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtgggacacggcaagcattcagttgttatttatgttagggtgatgggggaagaaagggggagggtgtattaacaagataccttgttttatatatgtgtgtgtatatgtattattttattatacatacatgcatacttctgtagttccctggactgtaggataagttaggttacttagaatctcaacagctagcatcgtttttacttaggttttcaagcctactggcagggtaagcaagaggtagtaccattttggtaagaagtagagagctagggacagtaaagatggagtaatatatatatgagggtatagtcaggccctagaaattaattatccagttttatgctttttataaaaaaactgagatggggtcttgctatgttgcccaggctggtctcaaactcctgagttcaagggatctgcccacctgggcctcccaaagtgttgggattacaggcatgagccacagcacccagccccagctttatgcttttaattctaaaactttttttgttgtattttgcattcataagaatagatgttaaataaaccttgaaatacaaccttggctcaaacgttaatggt

SEQ ID NO: 94181 - DNA, 3404 bp, Homo sapiens
catattaagagaatttacagtagtacagatggggttatcccatccacaacttatgatggggttacataaactaaaaacgtgtttaatacacctaccccaccgaatattgtagcttgggcgtagcctaacctatctcagacgtgctcagaacacttaaatgttagcctaaagttgggcaagatcatctaacacaaagcctattttataataaggaattgcctatctcatgtaattcatcgaatactgtactaaaaatgaaaaacagtggctgcacgggtaccattataaagtcaaaaaatcataagttgaactgtcttacattatggttttccaaattttgatttgtttttaaatactctttccttgcctggcaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttgggtaagactttgaacaagcttgttctcaggctttgataagtagtgctgtttgccagctgtatattatccctaaaaataagtaataaggtatatatggtacatattttgacatgcatatacatatttgcatcctgactaggctgcccacagcaatttaagttacttgaaactcgcttttatcttagtagccctttggcctttcttcagtttttttttttttttttttttttttgagacatggtcttgctctgttgcccaggctagaatatggtgacacaaccatggctactgcagcctcgacctcccaggcttaagtgatctttccacctcagcctcccaagtagctgagattacagatatgcaccaccatgcatggctaatatttaaatgtttgtagagagatggggtctcactgtgttgccaggactggtcttgaactcctgggctcaagtgatcctcctgcctcggcttcccaaagtgctgagg

SEQ ID NO: 94182 - DNA, 1422 bp, Homo sapiens
ggcatatgccacgtgtattaggcactgctaatttctgtatttttagtagagacgaggtttcaccatgttggtcaggctggtcctgaactgctgacctcgtgaactctgcccgcctaggcctcctgaagtgctgggattacaggcgtgagccaccgtgcctggcctctgctctatcttttagctttcccttggcacttctatggtccagatgttagagggtaagtattttgatgggggagatcgttggactgtaattgaaagttatgtcttataatgaaatgtgttatataaagaagacctataaaacacttaggctgataaaacccccaaacgatgaagcctcacttttaccctctcttttaacagatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggtaactgattcttaaagttttgttatcagaaagtcatttgtgacattaggaataacatacttaggtgatcattttccaaacacagttacataaaagtcagccagtgacttaataggaagcaaagggaaattactccctgtgttataaaattgagaattatatttagctgaaacatcgatgcttaatgttaaggggaatatatgttaaaaaggggaaggaggtcagtcattcaggtcatgaggccctttgacttgaattcatttcctcagaaggtaggtatattcatagtgaacaaaaatacaaaggctgtatgaaaagatgaaaatgttacaggtttatccttaaattagactcatttgcagaaatgcaaatgaggtaagaaagcaaatatagttcatgacctctagcaactgttgaaaactgctctttagggatgacatgctggcccttttttttttgttgttgccaaggctgaagtgcagtggcaccatcacagctcactgcagcctcgaactcccaggttcaacccttcctcctgcctcagcctccccagtagctgggactacagatgtacaccatcatgcctagctcatttttaaaaaaattttttatggcattgtatttatcttctctttataaccaggggttgaccagccacagaacttgtaaagttttttatatttttaaaaggttgtaagaaatagtagtagttggctggtccccgctgctctcctgcattatagtatacttctgttcacctagtttgctagagagaggcagtatagtgtgt

SEQ ID NO: 94183 - DNA, 3062 bp, Homo sapiens
ttgtacaaataactatttttatagaagattatctgaagtacatttaaacaatatgaatgtttttagagcacgcactcaccattgtggcacagaccgatagttggagataaaaggtgatattgtgaaaggtttttgattacccattaattattaggccttacactgtttagttgtaataaaacatttgttatactacggggatgagaacactaataggaggactcaggaagtttatgaccttgagcgatactgtattttctttaaaagaaacctcactccccatgggctgctaagcagactcgtgtagctaaacaaggcctatttatagaatgcttttagacgtggatgtactaaccgatgttgcttttctgtcctagcatttttgttttaattccttttttgttttaattcctttgagttacttccttatgcatattttactttaacaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggtatgtgcaaattgtttttttccacaaattcggttttttgagagggcacttctcttgctagcacatgtatcgctaatatttttctttcttaaggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcggtaactaactaactataatggaattataactaactgaccttaagtttcaaagaaacagtaaaaggggaagggatgatgcactatgaaaaaacaaaaaaacttttttttttttttttttaattttaagggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatgaccatttttccattttctttctaggaaattaaacccttttaattcttatctaccttctacataatggttattgaatactccacaatatattaagtctagatgttatggtacatgcatacactttcaggctgttttatacccactgtcaccaatacacataaatgggggaggaaaagctatgaaactgtatagggctgtatatatacttgtctcagcttaatgcaggaaattggtttaatttccagcagttttgtctaaactgttcaaaaaaaaactatgaacagagttcaaatacaggactgtttgttttgaagagactttctaaagtgtacttaaaacatagtagttttttacctttcacaaaactgagttacaagaatacttttgttttacagtgcatcccttcctaggaagtctcattaaaacactcactttttctaggggtgattttgaatgctgcacagggaagggaaggaaataatagtcttaacttttcttaaaggataccagaaacattgctggatataatttaagattagtgttttctctttcatagaaagaacgtacatactgggacatgagtacagttacagcaagtctaggtgtgctaacaaaacagggcacattcaagtacagtaagattttgcttgaaattaaaaacaaactacatgagattaaagcattaaaatcatatttctcaatctgaatacatgttaaaaaaaaaaaatcaaaaggaacgcagaagtgctagctcacatttttaccatattacaaaagcaattggtacccatgtccataaaggcagcaacaaagctgcttgtctattgaagattactactgcaaattggactgcattcaatgctagttgtaaaaacaccagcttttcagaagttggtatctgtacaaaattgcagcttattttcttcacttctgtcccttcaagtctttacacagtaatgctaaaacacccagctttgagatcctgagtcaatatattgccactttctttttggtagcttgagcttcatagtgtcaactgaccttgtgtatccatttttaatacagtctcttcctgtagcatgggcaaatattttaaatcttcttccaaaaaagtgttttaagttatgatgttacaatggcaggactttttctttagggaaggaattcagttgtgctgcaatgtattagattctataggtggagcagagtcatatagtgtatctgtatcatgtgtaggctcaccagctaatgtacaaggattagacagtgttccagcaccacagtcacagaaaaacctaaagcaaaatgaaacccaaatattagaaaagtgagggggaaagtaattgggtaatatatcaagcaagtgtgctacatacctatcatgtctaataaactctacatcatgtccctgatggcacttcttaatgcagttcacacatatggcatttcgatctgtggtgttacaagtatgacatctaaaaagcaaaagcttaaattacttttctcaaacatgtcattaatgcaaaacattccattctgtttatatattactatgacctttggctttaagaggaccaaaacaaaattctttgtggctccagcccagattaattctgaaaaggaactttaatggagtaagtgattttcctgtcatctgtgtcttcggagggaagagaaatgatttgtaaattgtataaaggcagttctttccactttaaaagcctctcaaatgtttctgggctgaaaacaatttttggaggcgtgaagagtcaaaactgtcacagtgactgggatatatcaaacacttaaccccgacatctttaccttgaaatttctaggaaaacattacacaacatgagttaca

SEQ ID NO: 94184 - DNA, 1365 bp, Homo sapiens
agaccataactatggaaaaacctaatgctacagtaactgatgtcattcatgtaactcatgttgtgtaatgttttcctagaaatttcaaggtaaagatgtcggggttaagtgtttgatatatcccagtcactgtgacagttttgactcttcacgcctccaaaaattgttttcagcccagaaacatttgagaggcttttaaagtggaaagaactgcctttatacaatttacaaatcatttctcttccctccgaagacacagatgacaggaaaatcacttactccattaaagttccttttcagaattaatctgggctggagccacaaagaattttgttttggtcctcttaaagccaaaggtcatagtaatatataaacagaatggaatgttttgcattaatgacatgtttgagaaaagtaatttaagcttttgctttttagatgtcatacttgtaacaccacagatcgaaatgccatatgtgtgaactgcattaagaagtgccatcagggacatgatgtagagtttattagacatgataggtatgtagcacacttgcttgatatattacccaattactttccccctcacttttctaatatttgggtttcattttgctttaggtttttctgtgactgtggtgctggaacactgtctaatccttgtacattagctggtgagcctacacatgatacagatacactatatgactctgctccacctatagaatctaatacattgcagcacaactgaattccttccctaaagaaaaagtcctgccattgtaacatcataacttaaaacacttttttggaagaagatttaaaatatttgcccatgctacaggaagagactgtattaaaaatggatacacaaggtcagttgacactatgaagctcaagctaccaaaaagaaagtggcaatatattgactcaggatctcaaagctgggtgttttagcattactgtgtaaagacttgaagggacagaagtgaagaaaataagctgcaattttgtacagataccaacttctgaaaagctggtgtttttacaactagcattgaatgcagtccaatttgcagtagtaatcttcaatagacaagcagctttgttgctgcctttatggacatgggtaccaattgcttttgtaatatggtaaaaatgtgagctagcacttctgcgttccttttgattttttttttttaacatgtattcagattgagaaatatgattttaatgctttaatctcatgtagtttgtttttaatttcaagcaaaatcttactgtacttgaatgtgccctgttttgttagcacacctagacttgctgtaactgtactcatgtcccagtatgtacgttctttctatgaaa

SEQ ID NO: 94185 - DNA, 1015 bp, Homo sapiens
atctttcatggcatattgcatatatttataggtatagcagactccaacatacctttcattgtcacattaacaccagatgctaaaaataagcctccaaaccggttgttaaaaatctgattgccttctagtgttgcagttgcgtgatttgtaatttcaatacctgaagtaaaatttacaaacaagtagatacatcactttatactgcttcttaaaaacctgaaattagcaagcaaatgtaaactgcttcttttatagaagtacattaaccctcttaatgtctactgaataaaatgtagatacctatttcaaccaccaacagtaacattcacttatcaatgactatggtcaaaactgcaattaactttcgcaccaacctaactgtcttaaagtttaaatacatgatacttggatttcatttgcatccattttaacatctctttttctgttgcagatttaaactggtaaattcatctgaggaattgaatctatctgtattcctagtggtaatacaagcctgcatttattctatcccaataaatgtttcataatcacgactaagcaataagagcaatatttcttaggagtctggcttagagtagaagaatccagaacttgattaggtgctcttgtaagtgaatgaacaggcattcagccacttcagcacactttgcacattttagttaataagcaaaacaaaatgaatatactccacatcaaacactttgcagaactatatataagccacaggtaagaaaagaaaatacaaacctgcggcaaatccatcaaatattctgtttttccttaagattggatgactattagtgctgatgagaacacctgcttgagcattcctgaaaatatcattttcttcaaggagacctataataaaatatttccttagattaaggctaatgcatataacagactactaacctttttggtggtatttaggtttgcttttagtttcttatttaactgcatggtaaaattcacaggactattttttcagccaaaa

SEQ ID NO: 94186 - DNA, 1050 bp, Homo sapiens
tccctgaaggcttagattgttatgagcatttttttagcgataaagtatttttaagttagggtatgtgcttttttttatgaaatgctattgcatacttaatagactacagtataatgtaaaccaaaaaattgatgcgactctctttattgcaatactcgctttattatggtggtctggaacggaacctgcagttatctccaaggcatgcctgtaattcagtccttcattttacatatgaggggaatatatgtcacttaatataaccccatttagtttacatgttaggaaactctacaataataatctgtagtaaagtatgttctgtgggaaatacaggattaagcaaaattaaaccactttcttctcagggcatcttggactccattgtatagttaattcttactaagtgacttatgtggatttctccactgtttacctcacgtaacatgaagatatgggagtagaagctattgaaatggtattattgtctattctgtttacaggactggaagcaaccccaaaattagacgcaacaaaatctggggaggacagaatggtggaattctagtttataattctggtatgtttaatctgtcatcttttttctgtgttaataaactttagaaatacaccttctaggccgggcacggtggctcacgcctgtaatcccagcactttgggaggccgagatgggtggatcacccgaggtcaggagtttaagaccagcctggccaacatggtgaaaccctgtctctactaaatattacaaaaattagttggacatggtggcacacgcctgtattcccagctacttgggaggctgaggcaggagaatcacttgaacccgggaggtggaggttgcagtgagccaagatcgcgccactgcacactccagcctggcaacagagcgagactctgtctcaaaaaaaaaaaaaaaaaaaaaaattaaaaagaaatataccttctagataacctacatttttgcatttataggtctaggctgtatagaagacaatgaaatatttgacaatgcaatggctggagtctgga

SEQ ID NO: 94187 - DNA, 2163 bp, Homo sapiens
tattcttaaactttttttttaattttttttgagacggagttttgctcttgtcacccaggctggagtgcagtggcgcaatctcggctcactgcaacctctgactcccgggttcaagcagttctcctgcctcagcctcccaagtacctgggattacaggtgtgagccaccacacccagctaatttttgtatttttagtagagacggggtttcaccatgttggccaggctggtctcctcttgacctcaggtgatccaccttcctagggctcccaaagtgctgggattaacaggcgtgagtcaccacgcccagccttaaatgtttctaatacttaatttttagatatgcattgaaatgttttttaaatggcatttctttttttgtaaagtaggctttacctacagatttaatttctgtatttttcagggttactttgaaagttgcaatatacacagaaataggatagcaggctttgaagtaaaagcctatgctaaccctacagtggttcgatgtgaaattcaccatgggcagactggaggaatatatgtccatgaaaaaggaagaggacaattcatagagaataaaatctatgcaaacaactttgcaggtgtatggattacctcaaatagtgacccaacaataaggtatttacatataattatgggtgaaaattactttttcacttcaaggtttgcttaaaagtcaagatattgagctttaactcttgaaagtttttgttagacatttgactactataaaatagattttcctagttaaagtctgtgcatctgaatgagccatagctattgcagatttattttttggtgtttttatttttctttttattagtgatataaaccatatgtgatattatgaaaaattgcaaatgctgtgatttttattttaaattcatcaaactgcattatagatgagtaaataggactgttacctccccttggagcttgaaggactttgtcttcttttttctgaagttagcaaatagaataattcaggaaaaatatctcaaagattcttggccagaaagactaaaattatcaaaaagtcaaaaactgcaagctgtcattttcccttaataagccaaaattgtagaaccaaaggtattataatctaatcagacactatgaattatttttaattgtcaaattttattttccattggctttatggaagtagattttgggatttccatcttgttaatagtcatcaaatgtttctagatcagctaaaaaattgttttgaatgtattagctgttttgaggggaatttttaagaatgctacatatgttctttcaaatagtagtctgacttttccaaagtcttaggccttagaaataatgaagaaattgaggccttagaagtttatgtaatttgttatatgaccatgaggggccttaccgttgtataaaacaagtaagtttggctgaatagatgtcttctttttttttatttcgcataattataggggaaattctatatttaatggaaatcaaggaggagtttacatctttggtgatggacgaggccttattgaaggaaatgacatttatggtaagcgtatggttttgttctataaaacttatagatttgtatgtcttcttgatattagcaaaatgatggaacattttgaaactacccaagtggaagcactgatccagctctttaatttttttcttttttaaagaaatgaggtcttactctcttgtgcagactggagcacagtggcacaaacatggctcacagcagcctcagacttctgggctcaaagcgatcttcctccttcagcctccctggtagctagaactacaggcatgtgccaccgtgccccactcatttatttgtggaggctgggttttgccttgttgcccaggctggtcttgaactcctggcctcaggtgatcttcccgccttggtctcccaaaattctgggattgcaggtgtgagtctcatgcgctgccctttaatttttgttgttgttgtttttgagacagagtctcactctgttgcctaggctggagtgcagtgacacaatctcacctcacagcaacccctgcctcccaggttcaagcgatcctcatgcctcagcctccagagtagctgggattacaggtgcatgctaccatgcccggctcaattttgctttttttt

SEQ ID NO: 94188 - DNA, 1002 bp, Homo sapiens
taaaatatcagtaatgctgagattgagaaaccctgttctttgtttctggatattaccggatcataacttgttttagattttacattgtactctgacagaaaattatttggaatagttgagaattatttttgatttgtaataaaagttgttcatgcaattgtacattaatttaaatataaggtttatgttagtagtcaatggttttgttttgtttttgacattttagtataaaggtgcacatgtaaagccaggatttgctgaacatttctacagtaaccctgcaagatataaaggaagagaaaatatgttggtatgtttgatttttatttttatgacttaaaatggtaatctttcagttctgtactgacacatttatttttttctagtattatgatactattgaagatgcccttggtggggtacaagaggctcattttgatggacttatctttgttcattctggaatatatactgatgaatggatatatattgaatctccaatcaccatgattggtgcaggtattttgaaatgcattgtcattaaaattttaatattttactcatttatgtgataggattttaaaaatgctagtgacttaaaatccagttttataatatcctgctggtaaagtaggaatgaagatatcacacatattttaagtgaaggaagtgaaaacataagagttcagaaattatagctgtatataaattctttctccccgccccccccaaccttttttgtttttttgatgcagagtctagctatgtcactcaggctagagtgcagtggcacaatttcagttcactgtaacctctgcctcctgggttcaagcaattctcatgcctcaacctctcaagtagctgggattataggcatgcaccaccatgcgtggctaatttttgtatttttagcagagatagggtttcgccatgttggccaggctggtctcaaactcctggcctcaagtgatttgcccatctcggccttccaaagtgcgggga

SEQ ID NO: 94189 - DNA, 1065 bp, Homo sapiens
attgacatcagtctgtagatttactacatgaaaacttggataagtgggctgggcacggtggctcacgcctgtaatcccagcactttgggaggccgaggtgggtggaccacctgaggtcaggagctcaagaccagcctggccaacatggcgaaaccttgggagacagaggttgcagtgaactgagatcacgccactgcactccagcctgagcaacagagtgaggctccgcctcaaaaaaataaaaataaaacttggataatttgtatttttttttctagtttacgctcttttatagtgacccaaggcaatgatttttttaaaaagatattttggcgccatctgctgttctttaatgcgatatttcatctactttggtaaagatttgaaatatatgtatgtgtgtgtgtatatatatatatttgcccatataaaggacaaaataatggcgatttttaaaagtctgctgcgtctgccttatgattcttgtatttccagctgcaaaggctgtcttgtaattttgatggtaagaaacaggcttgcctaaaaaatatttctgtagtcctgcgtctgccagttttgtatattcattcaatgactttgagttcctgaagacttccttctcgagtttactgtgacttctcgtgacaaagctcctgagttagctttgctcatttgttaatgtcccttctctctgaacatgtagtttttcatgtttcatggtctgtccttatcttacccctaaaccacatccctatccctgctatgaaatctaccccccatgattatttttattgattttctaagcttctatgtagatcagttgtactgcagatacagcatcttattttatatttgtagtctttacttgtctcacatgatctggttgcatatatagtatagctatatgtatgtctgtatgagaccataaaatttctggccaggtgtggtggctcacgactataatcccaacactttgggaggctgaggcaggaggatcacttgaagccaagagtttgagaccagcctgggcaacaaaacaaaaccctgtctctgctgatttaaaaa

SEQ ID NO: 94190 - DNA, 1037 bp, Homo sapiens
aatatttatctgttaacatttaaattcttgtatgctattaaagaactgcagcaaacaaccctatacaaatatctttacatgtttatatcacaattttagtagaaagattcactttttttttttttttttgagagtctcgctctgtctcccatgctggagtgcagtggcgcgatctcagctcactgcaacctccacctcccgggttcaagcgattctcctgcctcagcctcctgagtagctgggattacaggcacacgccaccatgccctgctaatttttgcatttttagtagagacgggagtttcaccatgttggtcaggctggtcttgaactcctgaccttgtgatctgcctgcctcggcctcccaaagtgctgggattacagcgtgaggcaccgtgcctggcgaaaggttcactttttaaaagtgggttattgggtcaaagggtttttctgtttttaagctttattgaattataattaatatattttaaaatgcccatgtttgattatacattttgatgattcggagggatatttgcattttaaagtttggtaaatgttgccaaatttgtttttaaaaagaaggttgcataatttataatcccatcattaatgcatgaggttaagtattgaatgaatgaatacatgagatacttgagagtaaagaggcaactagtgttagggttgaaatggtttggaaggactgttcagagatagtgggggtacttaaactataccttgaggaatgagtatccacagatagaggaaaggagggggaaaaggatattcttagtgagagagaatgggccaaaggccatagaagatttatcaggacagaattttactttgttgtcatactcctttcgtctcttggttcactttatgttggcatttttttggtggggggaagaggaactaggcactctcttcaaggctttactctaccacctgtggaacaatcttttccaagtcttgtatgctttggctgtttttcttttacaaaattcttccttagacaaactcatgtacacattgtt

SEQ ID NO: 94191 - DNA, 1217 bp, Homo sapiens
tgaaggtaggaggacaggtttaaattaaattatatgttgctagaatttaagcacctcaattgcagagataaaacaacattttgtttcctcataagcatgtttaatcccacatagcaagcagtagttgtaactcccaggatgcctttatgaatctttctgattctgcattgcagcatgtcagaggaaacctgtactctatttctgcatcatgtgagaaccttgtagctgaatatatctagagttgaaaaactgagctggaagatccggatgtagggaggttgatcacagtatgtaaagttaagtccctggttttagggggctaggaaagtgttacataccaatcagtgacatgtgttaataacacatgcaatgaaacagaaaatataccctttcgggtgaaatatctaaaaatttttggtgaaatgttaactaatatcttgagatggtggtggcgagttgatttttgttattcttttacatatctttgcttttcaaatactgtatatggaatctacagggagggaggctttgtgacattgtctttggcagtgatttcatggatacaacacctaaaggacaggcaacaaaagtaaaaatagacaagtgagacatcaaactataaagcttctacacagcaaaggaaacagtcaacaaagtgaaagggcatcctatgaaatgggagaaaatatttgcaaaccatatatctgataaggagttaatctccaaaatatttaaggaacttctgcaacttagtggcagaaaaactaataacctatttaaaaatgagctaaagacttcaatagacattctccagagaagacatacagatggcaagcaagtatatggaaaaagactcaacatcattaatcatcagggaaatgcaaataaaaaccacaatgagatatcttttcatccctattaggatgactgtttaaaaaaaacatagaagacaagtgttggtgaagatacgtagaaattgaaccccttatacactgttggtagaaatgcaaaatggtgtaactattatggaaaacagtgtggaggtcctcaaaaaattaaaaatagaactatcatatgatccagcaattcttcttccaagtatttattcaaaagaaatgaaatcaggaacttgaagaaatactagcactcccatgtttataatggcactattcacaatagccaagatgtggaaacagcccacaacatgtccattgaca

SEQ ID NO: 94192 - DNA, 1521 bp, Homo sapiens
gtgtgtgaatatggcatctcataattatgttactaaaataattggaaattattttattttaaatattggtgtttttcttgagtctcttggtatcctttaacagttcagtcttgaggcttacagtgttaaccttttccacaaaaaacagaggaggagactgctgtgttctttcccattttcacattttcatttttttgcagatagccacagttgttattaaaatatgttgggttatcataaacattgtttttgtgctaaaattttttatccacagatttgattgatttaaactttggacacacaaacatttaatagttcttttaattttaagtttttgcaagtatactgtctaaaaatctaaggaacttttttcccactagtcagaaagtttattcactaacttaatatcactttgatttcccctcaaagattgtaggttgggttgctttgaggagtggaagacatcttttttgtatttaagaattttaaaaaaatactgtggactttaatatgtgattctgggccttcattccaaaaacttgcttccttttgctgctgaagtggtgataagtaattttgtttctccacttaagtttggaacctgtttcttactcctttaaagtttatctctttaactcttatgaaaatattttgctattatttggacagttatttcatttctagttttctgcatattcttgactaccctttattgtcttacaataagcttattttaaaattgtgaaactttcacagaaaaatgggggcatattttgcttttagagatgtttttctggtccttgactggacctttccgttcctggtgtataggaggaaggtgaaaaagtgcctctgcccagcatccttgataagttcttcaagtgaaagcttgtactaaagtgctagtggcacataaacttgtattcctcatgatacaagtatcccctgagaatgacagggctctgttcatcaggaactacttgattgaaattgatgatatggtagccttagatagcaaaggaggaacatttcacatttgctctttcagcacttaagcagtccaatgttaatgctaccagttgatctttcttatccgcaaaaagcagtgtggaggagactgcccttgctttccattttcttttttcaacacatagccacattcagtaaatgttgccatttactgaacattatccctaaatttggggataaggagcctgagctgcttcagggtgacatttgtgtcttccctttttccagagtggtttcttaatcttatctttaaattagaggatttttgaataagatgacttctgagatgctctaaaattctgtatcatttgggttgccaatataaatcagcaaggtttgaatttgttaggttatcaccatgcaaacgtagttcttgcccttgtggaacttaaagttaagaaactgagtttaaataaaatttgaaattagtctgaattgcaagtaagcttcttggttttattttcattgtcttctggtttttaatttttcttc

SEQ ID NO: 94193 - DNA, 1617 bp, Homo sapiens
ggtttagatacaataattcttttttatatccaagcattgatttttctatcttccattcatagtatattaacatactgtatataagaacatgtggctttatgagattctaacacttagtaggaaaggggatggggaagaggaagagcatgtaactattttttattcccttgttatatattgagatggacaactttggtatgtatgttactagttattgtttcttcccacataattggtcataactttttgaaaaaagaaaaaaacaagctttaaagggaattagaagtgaataaaatttaacaaatgaaaagtaggagtctttccagacttctatcatagtaaagaagaaatatcaaagaagatttgttgagagaaatagaagttggagtaaggcactatattttgaaagctagtatttttagcaaagtgttcttatggtaaaggaaattatagactcactcactttatttcatataaggtcagcaatacataaaagtagccactatactacttcacacttacatatgaatgactgatgtcttcattaattctctgaaagacatttgcatttttaagagactgattatgataacttgtcaaattttggtattttaggccaagtaaaagagggaagcgaaattaaacaattgggcggggcatagtggctcatgcctgtaatcctagcactttttgggaggctgggtggggtggatcgcttgagcccaggagtttgagacctgcctgggcaacatggcgaaaccccgtctctacagaaaatacaaagttagctgtggggtggtggcccatgcctgtagtcccagctactcaggaggttgaggtgagaggatcatctgagccagggaggtcaaggctagagtgaactgtgattgagccactgcactccagcctgggtgacagagttttaagaccttgtctcaaaaaaaaaaaaaagaaaagaaacaatttggagaaagatctttcgggtaggagtgattcttcagaggcaaataaagtattgggggagggggagagtaaaggattcctgcaagaatcacttaacattacgtgtttatttcttttcctgatctttttctgacttttaaatttttctcttaaagtttcactttttagaaaatactcaaaagactaattttggggtgaggattgtgagggagagaagtagagtatgtatgaatcatttgtgttagcaatagttgtttgaattagaaacagtctatagtttttaaaatataaatgggctatatacatttaaaactatatagttatggctgggcatggtggctcatgcctgcaatcccagcactttgggaggctgaggcgagtggatcacgaggtcaggagttcgagaccagcctggccaacatggtgaaaccctgtctctactaaaaatacagaaattggctagctgggtatggtggcagatgcctgtaatcccagctactcgggaggctgaggcaggagaatcgcctgaaaccagaaggcagaggttgcagtgagcccagatcatgccactgcactccagcctgggtgaaagagtgaaattctgtctcaaaaaaaaacaacaacataaactatatagttatttaaattgtggaa

SEQ ID NO: 94194 - DNA, 2133 bp, Homo sapiens
atattttaacttcatggatcctgtgcagtcttaatagaggagttctgcacaagaaacatgatttttcctgttttaggaagtaagtactgtggggtactactctgtcatctggtggctaacccttccaaatgtatcccatgagaggagacagtgccactcaaccttttggaggcaggaagtatgggagctgtaaaaagagcctattttcttaaagcttggaacttacttgagggatagaaacagagtagtgttgctattagtgttaaagttgtgctgatgaggcctaagagctctgctgataaggcctaagagctcttatcctgcttttctccctttactggaaattctgacaaacccaagagaaggccaaccagcttggagacctactaggtaaggcaggaaccacaagtagttcctgatctgttagtgagaacccctagtttgagtattttctcaagtccccccgccccccaccgtttgttttaactttgaaaataaccagtttacagtaatgagctatttcaacatgaggtcttttattgtccccctatttatccctgatattaaagttactcttattttgtttctgtcttgtcccacttatctttgaagtattactctgttttagaccttccaattcactgatttatcagacctttgaaatatattcttatcttccacagaattatagtatgtgactttgttggcaaagtattccccaaattgtagttgctaccctgtgaaaataaaattatgaagatacactataaggaatgagacagtatgatgtaaagagctcagagttaaagctagctagatatgggttctaatcctgactacacatctgattagttatttaacatttggtgagcaatgttacctctctgagccttactttgtgatctttcaagtgggaatcacacctgccttatagaacatttgtaaggatgagagatagtaaagttcctagcacatgatagatatttaataaatgataggtcttttaaatataaaaagtaagggattgtatcagctgtatataaaattaaacccaagagataaaattcaatctgtatgacttgttacaacctcagagaaactgatttgttgaagcttataccaattcttttttttttttttttttttgagacggagtcttgctctgtcgcccaggctggagtacagtggcgcgatttcggctcaccgcaagctccgcctcccgggttcacaccattctcctgcctcagcctcctgagtagctgggactacaggtgcccaccaccacgcccggctaattttttgtatttttagtagagaccgggtttcaccatgttagccaggatggtctcgatctcctgacctcgtgatccgcccgcctcggcctcccaaagtgctgggattacaggcatgagccaccgtgcctggcccccttataccaattctgtaagagattttattactttttttttttaataaatgaagaagtagaggctcagctatacaacaatgaagatgcatagtaagtagcaaaaaaatttcaaaattgatttatatcacctaatctttctataaacaaggaaagataccaaaatacatttggcagaatgtttgtataactttcaggggatgcaataacctgccccttgaagcagatctgtcccctgttctataccatctgtcctattggagatggctgcactagtctgatgctattgattgttgacttatctggtttcacatttttcaagtaatcttctgattataattttacctctcatgtagatttgtctcaagatgagactctactgattgaccagcatgtttttccagtgtgttgatgagatcattaagcactcattatacaaagaagggtagatttcccctgaattactcataagttatgaataaagggtattaactgattttagctcatggttgtaggctggactatttcagaaggagaaaaatgtgcgttaaattagttttagatttcagtggtaattttgactggtttgtggactaaatattcttttctcaccatggtttggtgtgtttcttatatgtgtagcttggagtttttatatatgtttggttagcataaaaaatgtgcttaaacttaatccttagaaaata

SEQ ID NO: 94195 - DNA, 1945 bp, Homo sapiens
gagtctgttggtggccggggggaaggcgagcggcgtgatttctcccttttctgccgccttccatggtttagtctgcctctttctagtggtaggtggggggagcgactgggagcgatcgggtggtggggttggctggggaacttgttttccccctcttttctgtgttagcctaccccttcctgaggaggagcgggagaggggaatcggggtggtctgtggtgttggcaggggaacttgtttcccccgcccccccgtccctggtcacggggtagggggagcagcgactcctctcccaaccccacagtgtttgctgcgcagtttgtctttagttacgaacccctgggaaggacccattaaatcaagacctttaaataaataaatatagaatccatcggccatttccagccccctccctcgtgtgcagtgcagttacccttccgctctatcgacaccccctcgcctgtcctccccgagcgaccccccatgccgcggtgctactctccgtctcctagtggggtttgaacgccccttgcttagaactggccccttgggatattttgtgtgtgtgtgtgtgtgtgtgtgtgtgtgtgtgtgtgtgtttgcgcgcgcgcgcgtgtgtgtgttgtgtccaaggcctagtgaaatgtgtcatttggacccaactgtttagcactgtctggtaaccaccattgtctaagggctgaggctccccgaggttgaaatcctgctttagcaaaaataatgttcagttctacttggatgatgtggttattttgggaggtttatgagggggggtgttgcaccttggtctccaaacataaccattctctttattaattagctgttcgcagtagtggtagaggtcagaaccgtatttatgtgtacggttgttgttttaaggaggaggagaattgttaggagacattttgcgtgttttagttggcggattaaggttaattttacatgcgtttgttgtcacacctccattggttaaagggattgagattaaatgttttttaaaattatacattatttccttaaaaacggtttcattgttatacttgatcacaatatttaacaaatgaaggagggagatgttaatcggaaaatagtttaaaaggctttcaccagtcactgttaaaggtagtcttagagaaagcagtttgctatatgttgcttgaaagaatgtgatgtttcaaggcagttggagatcttgtgcaacataattggtaaaagtgttttatttctttgatacatttaccattttgggggtaaattttaaaaatctgtagtctcattatttcctttcacatatgtctatcagtgttcttctgatgttccgttcaaataatgttcttcttccagaattgccactgtatgcagtacagctgacaaatatgtttgagaaaacaatgacactcgattgaaattctagcctttaatattaaggattctattgctacagtaagctttttcaagatgtggtaattggttaataatattagcattggatcaaaacgtgtcaaacaatttagtctccttgtgtattttaaaatgtttactctgaattttcatttcaaggtttgtgtgtaatttcgaacttagttgatgtaattttgtcttggacacttttattcatttgttcaaaattattagctactgaggtctattttcatttctatgtgaggtaaggtgacttggttgttggcagtcacatgccagtgtcaattttcttctcattgatgtctataaactgtcaatattcatgaatccaaatttcagtatgtacccaaccaaatggtaaatgaaatttactgtagaattgttgcttctctgcagctagtacaaactgttttggagattctgtgttggcacagagcagagaggaaaagaactttagggaaaatagtgtgagtcttaaagagggcacataaatggccttaaa

SEQ ID NO: 94196 - DNA, 1017 bp, Homo sapiens
ggctgaagagacagatcccggtcccgccgactcgcgagcggcgtctccggcagcggggggagtgggcgggcgggtgaggaagggagaaaaagagagggagagaagggagggagggagcagggggcgcccggctcttttttttccctcttcctcccccccacaccccctgaaagagatttctgtgaggaatttttctctctttcttcggtctcttctctctcctcccccccttctctcctcggcgaaggggaaatgagtgtgaagggaggagatagggggaaaaagaggcgtcgtccttcctcctccttaaaggaacctttcctcctcctcctcgtcagccctgtcgccgctgcttctgctgctgctccgtggcaggaggagccattgacaccgccggagcctccactcgcccagtcggtccctccccgccgcggggctggccgggggcgcgggggagggccgcggggcggcggggggaggggtgggtgggcggggaaaggaggggcggggattccgtccaggcggccaatctaaggcgcccgtacaaccttccggccaatggggcctccgctcttatcgcgaagtcccttcaacgccctgtttcctctctcgggtttcctccctcccccgcctaggagggggaaagaggaaagggggagtgtggcggggcgggtgataatggggaggtatcagggcaaataatagagcagggggtgggcgaagagagcgccagtgcgtagcgacgattctgggagaggaggtgctcggaggaaagggcgggggttgctgatgtaatggggagaagtgattaatccttcggttcgccgtttcagcttcccccctaccccaaccttcacccgatttttttgagctgaaaaaaaagtggaacgagggagccaatctttggtaactcgggttttctgtggtaggtgggttcaaaatctgagctgtagggagcgctagagatttcgtgccctttagccaagctgagggtatttgcaaaccctgaagatttcc

SEQ ID NO: 94197 - DNA, 1048 bp, Homo sapiens
cttctatccaactgccaacttgacatttctacttgaacatctaatagcaagcaggctgagaattttgagaattgaataggcttctcaaacttaaccaaaaccaaattcctgattcccccacaccacacctgcttctcccacaatcctcccccaaaactttggcatcattgttgactcttctcttctccattctacactcaaaccatcagcaaattttgttggctgtcttcaaaatacatcctgaatctgacagtctttcaacacctccactgctgccagcctggcccaagccaccattatctctcacccagattattgcaatggcctcctaatctctctgcctctgcccttacccttatgcagtctttatactagtcaaaacaaatcactttatttacctgcttgacattcgccaactggcttctcctgtcactctgagaaaaactcgcagtccttaaaatagcccacaggacctgtacaatctgcctctcaacactcacctctctcatctccttccacacccttcctactctgtgctgcagtcacgctggctgctttgctctgtgaacatgcccgtgatgagcatgttcctatgccagggcctcactgcagtctctgaagcttcaagtggttaacctgtccaagatcacacaactagtcagtggcagagctgggattgattccaacccacctctgattctaaattcagtgttttaattagcgtaccatatggcctttctactgtaaacaatattcattcagtcatttaccaattgctgttccgggtcctaaaggatatagtaactgacaagacaaagctcttaactttgtggagctcatattctcgttagtggaggcaaacaataaataaattcaaaacgtggtacagtaagtcttcacttaatgtgtccacgagttcttagaaactgcaacttaagcaaaatgatatataacaaaatcaattttactatagactaattgatgtaaacaggagtgtacatcagttaagttcccatggcatatttctggttacaaaaacatcaccaaa

SEQ ID NO: 94198 - DNA, 1576 bp, Homo sapiens
aatccccaggccctgttctatggagcaaagcaaaatagaaaggcaaactcctctaatgggctacaaaacttagcatacacatttttctcttccacttgctcagcatttctaagttgctaatgacaaaagccagcatttgtgtctcatgtcttcctctcggctggtgtgacacagtctttaatctgggcaggctgccccttgggggccaggataatgcccttgtaatgcagggagcactcaatccactcacatttccctgtatcatggtgagttgcttcatcccagttaaaaatcaagaaatgatacagttaaaagactcttcaagaaccaagaaatagctcctaagtggggtcttcagttggatgccaaagagaaatggctcattttctccttggttgagtgaatttttgctgctgacctgtaaattctaaactatttgaaagttactggctgggaaattaatggaaactgagctggaaattttttctttcttacccttatgtgtgatgccttatttaaaataattcagactcaaagtgaatttctagcaaatggtgctaggctgctattaaatttattgatggtgaatacatcatccttgctttttatgtatgatgtcgctgatgtggtgattttttttaagcctcatggtaagactttttaaaaattcaccttttccatgtgccccatagtgctaagtgagttcaggttaagacgccatttagcaaattaatttaccatgttgatattttatggtaaagctttggaaaaccattaaagaaaccacatttactttttatatattgggatgttttttatgtgctaagattttatataaatttgttatttatcttgatgaaagccagataaataaatgctcctattgtgcctaataactcaactctttgctttcacaaggccagagcaaggctgaaaggaaattcatctcaaagctattaagaaaagccagatagaaggagagcataaaaatgaaatgaacgatggtgaaagggccagaccctcttccagcctgctctacatcatcccagctacccagatggaacaaagatttagagttccaaacagaattcaagaatagaaagaaacaatgcgggatggtctgagaaagggatcaatccatcctgtgttcataggagacacagggagaaaaagaaatcattcggtgaaaagtctcagcagcccaaagcagaaataatatgaccacccgcaaactgccaccatggcccccatttgaatacacctcaaaagcagcccttgcttctattactctctttattccccatatgtgtgaggagatgaaacaaaggaatgaagaaactacctgggtgcctcctccttcatacttaggggagggtttggtcccaacgttcaagtttactgaagcccctggtggccagaatgcaaagaacatgataggtgatacggactttgagaattttctctaataacctacggtaggtgagctttcttttttctttttctttttctttctttctttttttttttgagacagagtctcattctgtcacccaggttggagtgcagtggaacaatc

SEQ ID NO: 94199 - DNA, 1027 bp, Homo sapiens
cggtgcgggtttagggctgagcagggcaggggaaagcgggaaaatgcaaaggcctcgcatgtccgaggaaggacctataggagtgcggcggaggcgcggcgcggccgctgagtggtcgaggaggcgcgggggcggggctaggctgccgcagggcagtacggccctcggtgcctgtgcccgggctgaggagaccttcctcgacaccccacgttatgtgggtttccgcaagaccttccgccattgcctgggctttgaaagcgctttaggaacggtaaagcattgctgtaacttaaagtagtgttactctggcttgactgaaatgttctgtggaaacaagtcactgtgtttgcagtagggaaaaaaagacttacggatcaaatccaaaatttaatgtgcataggatttacagaagctaaggacttcacatccattgtcatatccataataataacatagctttgccacacgaaatacaggagagctcatttaaacctgaatttcagaaaaatggagattttttttaaaaatataagaatatcccgtttgggttatacttcctgtttgttttggttcgttttactaaatctgagaaccctatctaactcatggaaactttacagatacggaaacggaggcttagaagtggaaactttacagatatggaaactgagacttagaaaaatgacccgtcaaaggtatgagaagtggcagcactaaggctctagtttgctacgaatatgatcctgataattaaatctctgagtttctctatcaatatcttcaaaaactagagtagtgatacctatctcacaaaggtgttgagtagactaaaagaaaaggtatacgaagcccggatactgactgagcatgttcactgtgtgtccaggctctgagtagaaggtgagctgtgtgtgaaacaagctacctgctgacaataaaacaagtcaggctgtggggctgatagctgcagaagaattatgggcatcagaatatatttttaaaatataaacatttgatcccgtcattc

SEQ ID NO: 94200 - DNA, 2024 bp, Homo sapiens
ctactgtttcagcgctgcaatatggacacttcctgttcgccgcctcctttggggccgtggttacctttgccttttagtcctctttcctggcaaggtgagaggtctgcggtggaagaggccttcagcctttcaagtttgccccactgcagcagcagcctgtgtggaacccggcaggacggtggtagttagcggaaagcagcccatgtgctccgtgctccatcctccactacttaactccacccccttttgcacctttgcaaaatgcctctttttccactgcatctctcgggagttggggtgtctgcttcgctgacgacccacactctcgcagtgttcttgcactggatttctgctttaaagtctttttacagcagtctctgaacttcattttctccctactgggaaaaaagagttttagcgtgcaaagaaatgaccacagactttctttctcctaccccaactccgaggtgaggggaggagggcagttaagtatttacaggttagttgaagttgtttctcctatcttttttctgattgtgacagccacgtggccggctgagtgtaatagagtgcgctagcggcactaggggctgaggtttctctggtagccaggggctttgtaactgtgctgtcgcctcgcatgtacatttatcttggtgggagaagctgaaccattcatgcctgtacctgttccatccgaatcttaagacttacctctgttaccttgcagttctcctaaggtgtataccgacgttttttgccgttctctgctgttttgttgatccatctttaaaacctcagcattattaggtaccatcatagagtgatggggaataatagagtagtgcattatggagtttgccaactttgggaaaaaatattacttgaatttcaaaaccattaatgagagattctaatgcaatcagaagtaattgcattatctggatttctttttgatagttttagaaaaatctatttttttctttttacataaaaattgtgatctaaacatacgtaaataaaattaccagtgaaaatacttttttagggatgaagtagtgatttgatttgtgtatatgtgtgctttgtaaagctttttttgaaaaatgtgaagttaatatgaacgttaacatgaacagattttaagagaatgaaatataatttttagaatatataaaagtagaaggtcaaagagttgaagataaaaaatgaacttttggagagtttggaaaatttttgaatttaaggacaatccttgtttactaatgcatcgtttcattttgtgaatgctttggtaggtttgaattatttctgtattgtatgtttttatttgaatcaattttactggaagaatgttaaaccacaggaaccatttaaaatctgcacaagaactgtatagagaagttacagcaacaccattttattggaattttaattaccccataacaatggtgctcaatcagaaaagttaaataaagatattgaagtggtatctaggccttagggcagaaaagacaatacaattgagaaatgagtatatatgctaaccactgagagcaatttttagttgagaaagaaaagtaaatgaggtcataaaatacttatataaggctaaggcaggaggctctcctgagatcaggagttcaagtccagcctgggcagtgtagccagactcccatcccttgaaaaaaggattgctcaactcgtgcctgtaatcccagcactttgggaggctgaggtgggaggatcacctgaggttaggagtttgagaccagcctggccaacgtggcaaaaccccatctctaccaaaaatacaaaaattagctgggcctcgtggggcatgcctgtagtcccagctactcgtgaggctgaggcaggagaatcgcttgaacctaggaggtgaaggttgtagtgagttgagatcatgccactgcactccagcctgggcaacggggcaaaactctgtctcaaaaaaaaaaaattttttttttgaagggttgagaacaaagatttgatgctttggg

SEQ ID NO: 94201 - DNA, 1084 bp, Homo sapiens
tatttttagtagagacggagttttaccatgttggccaggctgctctagaactcctgacctcaggtatccgcctgcctcagcctcccaaagtgctgggattacaggcgggaaccaccacgcccggcttatagtattgttttattaataattttatatcctctaaatgagaaggctatccctgtcctgccactaatataaagggatcaaaagaatgtttattattatttgcttctaagggattttgatccatatatactttatttcccttaccctaacttttctatttaaataaactttttattttagaatagttttatagttacagaaaagttgcaagctagtatacagagtatacctcacccagtttctcctgttcaatttcctacattacaatggtacatttgtcacaattaaggaaacaaaattgttacagtactattaactacatactttattcctatttcgctaatttttccctaatgtcttttttttgttccagaatttcactttctatgacttctctttgttttgatgactatgacaattttaagaagtgcttgtcagacattttatagaatatccctcaattgagatttatctggtatttttctgatgattagactgggattatgagttttagggaggaagataacagagatgaattgccagtctcatcacatcatatcaaggatacaaactaacgacatgataaaactgatgacgcttaccttgatcaggtggttgaggtctttgtggagtttcgcccactttcctgcctccttccgatctctactcttttggaagcaagtcactaagtacatgccatactcaaaaaccttaacctaattttgattcatgtatttgtaatttccctcgacctaattttcctttctataaacgaatacttaaacttggacagatatttatttagtatctattgtatttaggtgctaagaatacagtggtgagccagagagacatttgttctggagtctgcctgatttaagtatcacataggatgtatctcctcaccttaggtcttgatttcgttaacagtttataaacataaaattactgaagccct

SEQ ID NO: 94202 - DNA, 1098 bp, Homo sapiens
tatttaaaatacactatttaattgtgttaatatcacccatacacctggtcctataaagctgcactttatttacagccatttcaactaatataagttattttccttgtattataaccattagtatcttcattatacaaatgttgtgcttaaatattatgtgggacaattgattgcaaaatttctctgatttggggatatttacatatgtattttctttttcccagagtttaagaatctaaagtattacattgataattgtttcctttgttgcagaactgtaagagtaaatgggtccagtaattggaatgactccagataagagagctgaaaccccaggagctgaaaagattgcaggattaagccagatttacaaaatgggaagcttgcctgaagctgttgatgctgccaggccgaaggccactctagtggacagtgagtcagcagatgatgaactcacaaacttgaactggcttcatgaaagcactaatcttctaacaaacttcagcctcggaagtgagggtcttccaattgttagtccattgtatgacatagagggagatgatgtgccatcctttggaccagcttgctaccagaacccagaaaaaaaatcagcgacttcaaagcccccatactcctttagtcttctcatttatatggccattgagcactctccaaataaatgtttgcctgtcaaagaaatttatagctggattctggaccattttccatattttgctactgcaccaacaggctggaagaattctgttcgacataatctgtccctgaataaatgttttcagaaagtggaaagaagccatggcaaggtcagtgtttatgaacattgctatatttggtgaggtggggggactaattaacatggagcccttaaaatatctggaaatcggggagacaataagtagtcaagtcaaattacttcagctgaactgaattatattcatttgttttcacttgagatgttttaaaatttcttaaatattgatataaatttagcagaattatgttttgtccactataggtacctagattagtctttttattattttagttctttgtttctagtttctgtagtgttcctat

SEQ ID NO: 94203 - DNA, 1072 bp, Homo sapiens
tgtagcccttgcatataagaatttgtaagtctgaggaaaagagtgagatacagtatatgtaaaactatgaataggaaataaacttttaagttcgttaacaaatagatttttttttcatgctatcataaattccaaagaagagaagtagtttttcccaaaaatattttaattcctggattaaaaaaagaactgttggtgtctttccatgaatatagaaagtttaattttatgtttattaataaaatcaggaacatacctgtttgctatcactaccaagtgttccttaaccatgaattttggtaaatgcttttatttttgtggtaatacctatattagtattatatcaaacttaagaatccaatgcaaaaccaaacagtaactatcatgtattatctatagttccaggcattttaaatgcattattattatttaattatcacaacagcctatgtgggagatttaattattcctattttacagatgaagaagctaagagattaattattttgcctaagaacatccaaatagttgtgatttacctcttttggctcctatgctctttctgctttggcagactttctaaattgagtagtattagcaaagaaaacaaggtaaaaatagtttgtttttggtggtacaaattagctgtatttgtgactaagttctataaaaagtgaaatagttgggtgcaagtggctcacgcctgtaattccagcactgtaggaggccaaggcaggtagactgcttgagcccaggagtttgagactagcttgtacaacatggtaaaaccctttctctaccaaaaaaaattaaaaaattagccacacatggtagtgcatgcttgtggtcccagccactcaggcagctaaggtgggaggatcacctgagctcagaaagtcaaggctgcagtaggctgaaatcatgccactgcactccagcctgggcggccagcagagtgagagagaacctgtcaaaaattagggggaaaaagtgaagtaaacatttttataagcatatttgcttttctgtttgtttttcagtggttctttatcacctcactatttaagctctg

SEQ ID NO: 94204 - DNA, 1822 bp, Homo sapiens
cagcattgatccaaaagaagatcacaattacagtgcaagtagcatggcagcacagcgttgtgcatccaggtctagcgtgtcttccctgtcttctgtggatgaggtatatgaatttatcccaaagaatagtcacgtgggaagtgatggcagtgaaggatttcacagtgaagaagatacagacgttgattatgaagatgatcctcttggagacagtggctatgcatcacagccttgtgcaaaaatctctgaaaaagggcagtcaggcaaaaagatgcgaaaacagacatgtcaagaaattgatgaggagctcaaagaggcagctggatctctgctccaccttgctggaattcgtacatgtttaggttccctaataagtactgcaaagacacaaaatcaaaagcaacggaaaaaatagaaatacttaaagtgtggcaatactctttcacttaattctttacaagggatatcaaagccataatggacttcattagttttagggtagggaagggatactaattacttatttctttcaaaacatttttggtttttggtttttaaaatttttattaaacaattgctgttaggatcatgcctgatcagaaatacatgatgtgaagtcctaaaagcataatttttgtgataaatgtgtccaagatttgaaaatttttatataagaaaatccccagcctctgtcttaaacttgtgggacaaaaatcctttcttctgttaatatgtcagaatgtaagatttggcaactcgataaatttttttcattttcttttccaatctgtaactatagttactgaaccagctaaaaattttgctgatgtatttttcatatacttctctcctgacacgcaatccggtaacataagattgaaatttttttactttgtcttaatttgtttctaattttttttttgttgtcgtgtgagcaaagacaaacataaattgaaaaacatcctgatgtttagaaagtttcttttggttacgtaggtagagaatacaacaaagagttctaagacttagaaaagacaattttgtggtgtcatttcatccaagaacactcccaattcctattagaatggtagctttgaagtgtttttacttcagagatcctgcatagcatttattggggccttttattctttcccaaagtgctttgcaaacattaagttttagccactagctgcctttgttgagtataagttatccagtgagaggatatagccaattaagtgtgttatggagtacacccattttgacacacttgtaataagagaatctttcatttgcctgccatgtgtactgtattatgagaatcttataatcggaatggagtgaaatgaaacattttgagtactgatggcatgttatcatacataaagtaggtcatttaggaaaaaacttctgtccaagctttgtatgaattaaattcataagtataccaaattaaatcttaatagatttaatgcaattttacagacacaataccttcatgaatttcaaaattcatataaaatttgatcttatgcaatacacctttttgaggaggcagtgtaacaacctatagtgccattgatccatgagaaaaagattttctggtactactccaaaagtgctttgactaagtatcttaactatttgaacagtctgcttatatgagacagtttttcatagtatcatttgtataatttgattagattattcagaaacaataggatgctaaactaattcattgtatcttttttttacaatggtggaagcaactttctgaaagttcagtcttatgctacatcctaagtcatagacaatgaccttg

SEQ ID NO: 94205 - DNA, 1150 bp, Homo sapiens
caacttagaaactccaaggaggttacatgttttccaacatatcctaaaaactgtgatataagctaacatataatttgccttacgtcaaaagaatatgttttgttgcagctgattccagtttataatagatccctagtaaaaagctttgattcaacacaattgttcatcttcacatcccaaacagaatcactgtttcttgaatatatatttttgaagtttttttgtgcaatatattactaaatcagttattattttacttttccaaattcagagaaagaaaacagattacctgaattcatggaaaaggtggatcacctccctttttccaccttcaagcctttcctgtcctcatagccagcatgacttcttttaacttggattcctttgtatatagtaaagtttagtatatatatatttttttctttttgctactttctgaggcattatgtaaagggctcatactagatgttcagttaaatatactttagcacaaagtcaaactagagaatgtgttaaggagggaatgtatatgtcttggtagaccaggaggcctttgccagcaatttaagcaacagatgtgaatacttcacaaagctgtaaagaccattgtcttaaatactacaacaacttaacacccttttgtgaagatcacagcatttatctaagaaactgtgaggctttctggtttacatatatcttacaggtgtttttttgtatttttttttttttttagtttgaaatgtgtaagctttgatttaaaccaagtttacttcagtatgttaatgatgtagtaaaaatatttattgaaaggtgaattcgagtattttaatgttatacctgccattttttttcttaaagcatattctttgcatctaactgccagtgccattgtcaaaacttattttttaaatcgttgtacatttcttattaaactaagtgcttaattttaaagtattatgttgccatcatatagtgtataaaaatgtataattgccaattgattgtaactattatttatttttaaatgaaagtgtaagaatgctttctgattcaacaaatttgttatcaaactgtttccttatcctcttttctgatgtagcataaaaattgtcccggtttgagttataactgccagtagatgaccagtcac

SEQ ID NO: 94206 - DNA, 1040 bp, Homo sapiens
caatggttggagcttcagcaaccattctgttaccatggatttgaagatggaaatcaacgctaaataggggtgttaaagcagaaaaggtaggaggcttggacacaccaacctgagactgctaactgccaaatttatcttatttgagagaaaaacaaacccctatcttgtttaagctattgtcagttgaggactctgtagtaatgaccaaaggtaattgctaatgaatggctttccatgggttgaagggcactgtactaagggcactttggaatttttttttagagagattgcatttttggttgtcacaatgaataggaaaactacttggatttaatagatgagagcctaggaggtaccgtcccagatgttcatgtgggttcaaagcaacaacaacaaaatattgataatcaattacctgtgccttgaacctaactatattttccatgtaaaaacaacatattttttgcgtggattcagacatacctaattttccatgaatttaactgttacataaaacaaataaatcttgaactttgctttttggacctttactaggatttgttcaccttttacagagttatattagcattggcaacactagctgtattcagtataacacacctgtattaatctgtgtttatagttgtcctgtttatggtggatgtatgaataagtatagaatttgactccttcatcacatcttctcgggtagctagttctaagcatttccttattgaaatacatattactttattataaattaactcccttttatttctcctttgcatctttccagggaaggccttacgctgattctatttttgagaagttatgtgtaggtagattatattatctataaacttaattgcaggatcataataattgccctacaaatttagcggggagagagctttgctcttgaccatgcctgttgttctaactgataccaatgaatacacactcagccctttgtctgccttctttgctttagtgctaagaggcagaaaggactgacaatagcgagctaagcctttggggtc

SEQ ID NO: 94207 - DNA, 1021 bp, Homo sapiens
tattcagtaccatattatttattgtattagtttttatttagggatgggacttggttttatagaaagagtgacacactagaaatcaggagactggattttagtcccatttttgccattgattttttttttttatttcattgggcaactcagcctgtgtgtcctccttatctgtaaaatggtgaattattgttatctactaccctctttgggtctaatacttttttgttctcatatatatgtgagaagctacttagttactcagtgtaatgatgcctgtaaaattgatgtgatttccttgatataaccaattgctttatattagaaattgattattgctttctctgttttcagcttcgggctcagaatcaggttctgaaaaaaggtgttgtggatgaacaagcaaattctgcagctttaaaggtgggcaacaggatatttgtgttgtgagggttaagttagcatttggtgttgctcaaagcaggttcattgggttttctgggttaaagttccaactctgacactgattcactagggataggggacagtaatacagtcttttgtggttaattttcctacttgcttaggtaagaacatgaggtactttgatttccttagctaaaaattataaaaaaaggtattatgtgactttgtctaatgcattactcctgtgcctcaaggcctttacttagctcggtttatctggattattaaggcttcttatcagttgtcatcacagacagctttctgagggaggctatgtcatattcctatttgaatccctctcactcagcagatggcaggtctctaataagtggattccattgtgtgaatcatttagtccctaaatcttgcctttagttgagttatttaatagtaataacctgtgttaatcaggacactctttgagtgatacattttaccatcagcatttttgttaactgaggggagaaatatgatagatgaaggaatttgtttctgcctcatttctagtaggcatgtagtaaatattgcttagtgatat

SEQ ID NO: 94208 - DNA, 1035 bp, Homo sapiens
aaaaagaagctttatagtcaggatttattagtcaagttattgtttcaccaaaattgttgaaaaaatgatcattatatctccaaatgatatttaaacttattgctggggaaagtctttccttgtttgtcctagtagcctgcgctggtgtttcataccctcctgttgctggttgtgtttgattaactctgtgatggcagtaatggtaggaacagtggtaggcgtggtgacagctggttctattgattgagcactcactgcataccaggcattgtgctaagtccattatgtccattatcttatttagtgttcacaacaacccgatgaggtcagataacattatcatccccattacagaaactggagtttagcgaaaggctgggatagatgttttctgaaattaatgattggttaatggagttggagcattagtttattttaagaattataagcataattatatattataattatataatataaattatgagaaaaataaattatttttttttttactgtttattacagtagtcattgtaattatagtacaacaagtgacaatttgccagtttgctagacaggaatatttggatttcctgtgttacaggaggcttttagttttattactgggtttaccctttcagtgcgctgttaggtgtaatcaatgctcattgatttgaatttttaaaatttgaaagacatgatagtttggacatgggctaggcctaaatttgcctttgaactacaagtaaaaattaaggttttactaaacaaatgtaggaaaaaaattattttctccttaatgggagcatattgttctatccctctagcacttttctcaacatgcaggtaatgtcagtagagtgtagacactagcctatggcttttaagttgctgttcctttttttttttttttttgagacagagtcttactctgtcacccaggctggagtgcagtggcacaatctcggcttactgcaacctctgcctccctggtttgagtgattcttgtgcttcagcctcctgagtcactgggat

SEQ ID NO: 94209 - DNA, 1045 bp, Homo sapiens
tgtagaacgagttcatattagtaaaaatttaaaggaagggattttaaaataatctttgagaattttcctatttatttataatagctttattttatatattttttaacttagaaatttatatgaacttttgtataaacttacctttgtggatgctgttacagaatttattacaatttcttatggagtttaacaactccgactcatgaaattgctataactctcatttcccaaaccaaaagatcaaattgaaatgatatttatgagcttattttatattgctggagctttctaggtctgctccgtcctccagcagaactactcctgaattcatctgcaaagaatagtaagccttatctgttcttttctctctctttttaaagctttcctgctccttacaatatttgcagtttcaacttgtgtcacataggaaaagttaaatgatgaactgtatagcttttgcaggattgtttgagaatggtgaacacatagaagagacaagcttctaagatgatagagaatctgtgtaccttaggatgtttctctaaaggatgaaagttatgtggacataacttattctttccatcagaaaagtggagaatcttcttctcagttgagtcaagagcagaagagtgtctttgatgaagatctgcaaaagaagatagaagagaatgaacggttgcatatacaagtgagaaaatctgtttttctatgtgaattaaaaaatgggtctgtgatctgttaatgtggaaaagctaatgcacatagagtgttttgtgtctgcgtgggtattttaatgtcttctatggtcttcaagtatatatgtcactgtcacttattcatttcttaaatatcacacagtcttaatgtggatgtgtgctttgaagtatatgcatttgttcagaagacagcagaatagctttataacttaacagtgcagaaatatactgagcattattcattttatatgggaagtgattacatgtatcatttaaatgggagcttaccaataaatggtatttgcttttttccctccccctcccttttt

SEQ ID NO: 94210 - DNA, 1951 bp, Homo sapiens
atggggttgttggagaagtttttgagccagggaacatcatgttgctatatgtgtactcacaaggttaatctggcaacagagtgtagattacctaggagtgggacaagggagtcaaagactattgtgatgatagttttggcgtactattgtggaggcttagcctggattggggagatgtggaagatcttgtggaaggagagggagcagactggtcctttcaaggagacaagggagaaagaggcagtcatggggaagatggtgatgcagttgaccgaaagaaaagaggtagacaggagcaggtttatgggagagacaacgaggttaactttgttgttgtttaatcttctgacagatgggttcatatgtatctatataactgctgatgtatgcctttctaaatgaaagactagactttggcagagaaactgatgtcaacactattgggctggaggagccctcatgttgggagtggtgggtgcacagtgcagtcaggcctgtgcagggtccttggtgagttctccatcccagtgatcaggaggcagaggggagctgtggaaacggggtgaggtagaagctggagaagggagtttcaacctgatggtgcaggtcagttctgcgcattgctgtggagaggtcagagggtgatgtatcaaggcgactgggtttggtgactggattttgtggcctcgagaggactagtatactttgcgaggagcgcttctgtgcagggtgtaggtggacactagattgccagcacagggagttgaggtgaatgggtgctgaggaaataggcagagcagtgctgttttttgagcagtgggaatgaaggaaatggagaagcatgagagcctgacagacgggcaaagtgaaagaaaaggctggggacaggagtcagggcagagaattaagtgtgattaagtaatggaagagactcactgtggacacaagagttaaatgagctgcagcaaatgctttatttgtaatgaggagatactgaagatagaagcagggagtgattatgtcctaaggtcctgagggggtcagaagcagaagggcccaggaggacggttagctgaggaaaggatatgcaagcagtagaccgaggtggagggtggggagtgtaagaactcttttgctttggctgtgattttcttggtggagtagggagaggccatcctatccattgggtagtggagaggagaggaggaatggtattaggagcttaaaacagaaaaggtttgggatagatgccatgggaaataaaataggcacacggcaatgaaattgtggattgctgagtagagttgaagccccctggagttaggcagagtaaattgtagtggactttactcgggattcgtgttagcaaaagcgttgttgaaacaatggaccaggctgggaagcaaaacaagcaaggctgaaagatggctgatagaagtgtccagaggtgttggtggatgggagatcaagctggtaatgtatagcccagtgagtagcaatggagacataaaagggaactgggtgactatgccacaggaacattctgaatcgtattttggcactggggtcattctgactgagaacctgggcagagaagggcaggtttgagtggctgaagggatgagtagagatgaggagagatgcagctcattaaggaggagtttgaggaggtatggctaggtaggaggaagctgccagaggttagtaacagaccagggtagagaggaagactgagaaagatagtgataccatccaggaaagttaggattgagtcattgggatccacagtggcagacagtgatagatttttccggtaatgtagtgtcaggaaaacagtggtattttttgctgattagcgtggcggctttgtggagggttattttagaagggagaatgactgaaaacagcaagaacgtcatgagcctttctaagtagtcctgataagcctgaa

SEQ ID NO: 94211 - DNA, 1048 bp, Homo sapiens
actaggaaactagctatagcccagtaaggactgtgagacagtgtggttgtgttggctattcctttccagcctggtgggttgtttatataaatacaagataatttctcctcaatgcctgttacactatcaaaacagtggtttttaactggtaaatagtggtttttaactggtaaatacaggatcatttacccaatgttagaattaatactccgacgaggaaatcttggtggctgtagtaaagatagccaagatggtgttcagagatccttacttctctctgttctttccatgtagatttgtgacctaattgatactcagtgcaatcctgacacttgagaccattctttgtcaaatttactttataaatttagaagaatagataggagaagtgaatgggctggttatctgtatgtgacttatatatagataataatgaattttcatgtaattgcttttatagatatttccaaacattatagtcaaaaagctgcaatagagcatgaacttccaacagcaacacagaagctgataacaactaatgactgtatcctgtcatcagtagtggcattaacaaatggagcaggaaaggtaattctcttctggcgtatattgatgttaaaactcttaaatatgtgctttttttctgagggacataggaaaatggatctgtaaaaggattttgtaatataagggtttactgtaaaataaagttgtctctctttcctctgcttcctacccagtatgtactctgacttattattttaagagagggatctctcgctatgttgccaggcttgactcaaactcctggactcaggggagtctcctgggtggcggggactatgggcacatgcactgcatgctgctttcctacctaatgtttaaagcaatgtgacagtgactgtttagcatttgtcttggatgtgtagatcactccctgtttatgttttaatgcaatattggatgattagaagattctaggtagtctcaatatagatcgttgtgtatatgaagggtctgccatatagaacactgggaacatacaaaa

SEQ ID NO: 94212 - DNA, 1042 bp, Homo sapiens
tgcctaacacggtgaaaccccgtctctactaaaaaatataaaaaattagctgggcgtggtggcgggcgcctgtggtcccagctacgcaggaggctgaggcaggagaatggcgtgaacctgggaggcggagcttgcagtgagccaagactgcgccactgcactccagcctggtgacggagtgagactctgcctcaaaaaaaaaaaaaaaaaaaagtcagttttgtggctaataaaagctggatggaggggcagggttccagtgggcttcccattacttcagttctgttttcttgaagccataacttcattctgaaatagaaagatgctaaataaaagaaatttggaatatacacttccctgctatgtctgaagtttcttcgagggggtaggaaaacagtgattccccatcaaagttcaagtgagaatgtacaaaatgttgtctttttttttttttttttctagaaatgcttcatctcactggtacttgtttatttatgtgtatttgtgttctatttaggttccagatgtggaatctcgtgaagacttaattaaaaatcactacatggcaaggatagtggaacttacgtctcagttgcagctggctgacagtaagtcagtgcatttttatgccgaggtgagtgtagatttaattagattggtggtttttttcctaacccctgcaggagttaggacactgtcctgttttcatgctgttcactgtaagagagaagtcagtgtcccaagtagctgggactatgggtgtgtaccaccacgcccagctaattttttgtatttttagtagagacggggtttcaccgtgttagccagaatggtatcgatcttctgatctcatgatccgctggcctcgacctcccaaagtgctgggattacaggtgtgagccacctcgcctggcccggagttcatattgactagtctgtataccaactaaaaatctttatttcaataaatataagactgatttgagtgaggctctgccttttttttttttttttttttttttttttttttttgaggtggagt

SEQ ID NO: 94213 - DNA, 2424 bp, Homo sapiens
caaaacttagctgggtgtggtggtgcatgcctgtaatcccagctactcgggaagctgaggcaggaggatcacttgaacccgggaggtggaggttgcagtgagccaagatcatgccactgcaccccagcctgggcaacagagcaagactccgtctcaaaaaaagaaaaaaaaagaaagttcttatgtattatatataaccactggtcatcaggctagagtgaagaaaaaaacattgatcttaagttggtagacttttttccccttactgaaatgacaaagctgggggccacttctttcttaggtgtactctgatgtgtgacacaatgcctataggtattcaacagattatttgtggaatgaatgagtagctttggctttgagaagtgtttttaacaaactttcccgaagcaaatttggttttagaaagtgctccctctagtaatggaatgttttctgattttacagtgccgagcactgtctaaaagactggccttggctgaaaagtctaaggaagcattgacagaagaaatgaaacttgccagtcagaacatcagcagacttcaggtgagttaagtgttacctgaatggttttaatgttttttcattgaaagttctttggtagcaaagcagcatttcttttccaaaggcatttgatctctagatatgctttttaagataaccactgtatttctgattcatttaaaaataacatcttacttatgttaggcaaaaagtagttgtattgtttctctgacttgattctaattgtaaatcattttatagtcggcttttgcttaaataatacttatttacccagaatttttctttccccttccttgtacatacccatcatggtgagctgtaggcttgttctgtacatagtactctgttccttttctttcctgttgcataaaacggatctaaactgaaaggtggggctataacattccttcttactcactgcctggttttaaatctttgttttcagaaagcctctgctaataaaaacatgatgccaggcaaggaaaaaacacagcactacagcaacacccacttcctctttgctttagattcatttatcagattaattaggcacacaggattagattttaggcagcagaagagagcatgagaaatgggaagagagatgaagggtgcttctttcagggacggtgctgccgggagggctgtaggccatcgaggcataggatggaggcaatgtgttgtaggcctcacctatggctcagcaaaacctgagggaatttggaaagataatgaggccatatggcttttcttacaattttatacctggcatagaaagaaacccttaaatttttgcaaagaaattatgaatctactttggaggctgagaaaaacttgttgccatttcttttaactttgttctcttgttaggcctgggccttaagctgcatgtcaattgatcagatagaccatctttataggttgcttttacaagtaaaagaatttttttaaaaaattgatgtaaatagttgtacatgtttgggggggacatggtattttgattattttgatacctttgtacagtgtgtaatgatcaaatcagggtcatttggaggtccaccacctcaaacatttatctttgtgttgggaacataataattcttcttttgtagctattttgaaatatacagtaaattattgggaaactataatttccctactccacatttttcttttgtgaattaaaaaagcttcagagtggtacgactcgtgggatgttgatttttgtctttttctttgctatttaggatgagctgacaactaccaagaggagttacgaggatcagttaagtatgatgagtgaccacctgtgcagcatgaatgagacattatctaaacagagagaagagattgacacactaaagatgtccagtaaggtatgtgaggtgaggtgaggtagtctctctgcaatataatatttaatgtgaggtattttattgttatgcatttcaggaggaagaggacataagatttaaagtgtttgtaagggccaggggcagtggcttaagcctgtaatcccagtactttgggaggctgaggtgggaggatcccttgaggccaggagttggagagcagagtgggcaatatagtgatacttcatctctacaaaaaaaaaaaaaaatgaaaaaataagccaagcatgagggcctgtgcctgtagtcccagctagttgggaggctgaggtgggaagattgcttgaacctaggagtttgaggttacagcaagctatgattgtgccacggcactccagcctgtgcgacagagtgagactctgtctctaaaaaagaaaaaaaaaagcatgtataaataattttccttaatatcatttgtccttttttccaaaagtattaagtgtctttggctgaattaaaagctgagaaa

SEQ ID NO: 94214 - DNA, 1039 bp, Homo sapiens
tgaaatcttagactctcttgtctttggaacaaaatgaatgtttgtagttttgataaatccaagatagttgctttcttttctttctttatttcctgtcctcagccccgagagggatagggtctgtggaagcagagaggagagagagtataacaaactgctttgcgattattgaataaaagttaacaatgcaaggttatcagctattctcctttttggaagctagtgttccaaagtgaaatatggctttcagacagcttggtttataaactatgtgagttatttttttttatgtttatgttcttattgttgatatttttctttgcacaggggaattctaaaaagaacaagagtcgatagttttgaaatagctggttggcgactgttctttccagacctgctcctgctgcacagagccgcagggctgagaccacgtccatgctggctgccttcaggaagctaaagtattgttggacctagtaaactagtcagtgttggaaacggccttgaaatatttaaaacatatttgtaaccagtgaggcaaatacagaagttgatgtcggcagtaaatggaaaacaatacgtatgtcatggatattgtaggtttccttatgctgtttttactgtgcactttttaaaattaggttttaatttcagtatgtaagaacaaatattttgtatactttcaaactcaattatatggtaatcgatttggtatctatggaatagatatatgtttctggaaaaaaatgcttaaattgtcaaactgtcattacttcttattatagttgaaggcattctccagattctttttaaaagatttgttcatatttctctctctctctctctctctctctctctcttctttctctctgagggagagggagccctccaaacttcagatcctgtgggtttagtatcattatcttcagctctttgataccctgtgttagagtaatagctaaaggaagttcatgtcaataaattcatacttatatcacactttcagtctctctattaaaatttgataaaggaaactgaa

SEQ ID NO: 94215 - DNA, 1011 bp, Homo sapiens
cacactgatacgtaaaatggaaaatgcctcccatctcttccagctccgccagtcacttctctttagaagtctttggtaactgctccagatttagaggtagctcaccccttccttgcaaaccagctccactcacaagaagaatcccgaattccatggaggcttcctggccagcctggaattccaggtaccttatgggattctggagcagtcctcagtacagggcaagatttttaaagtagatcaggcaaattatgtcttcagagctctgcagattacagggtgtcatcattctttgcagcgtcaggagagtgtgataggtagaaagacccagggaaagcaccgaggctcaaatgtacctgtgtgttacatggaatgccaggggaaataaagggtttaccatggaataagaaagagaaaaaaaaaacctcattgctggatgcttattactatgaacacacaacaataaattatctttcgaaagcttgcctatgtgggtgatcccatgcattggtgagtttgactgattgggtgaggtggaaatatttagtgtgagtgattctggggagagctctgggaaaaaatgcccacatcctgtactaccatgtcccctcacaggcaagcagctcctgggatcactcatccattctctttgtggaaggtaccttgagatccccagaaggatcagcattcttagagcccctggcccatcacataacaaacatgccttaagaagaaggctttcagctgggcgcagtggctcatgcctgtaatctcagcactttgggaggccgacgtggggggatcacctgaggtcaggacaagaagtctgatcacaaatgattgtcattttattataatctgccttctccctggtagcttttaaaattttctctaaaatgttccacaggtatgtctaggtatggatttagaaaattttatcctacccagcagtcagtgagcatttgtgattacacaaatttgtgtagctgggcacggtggttcatgcctgta

SEQ ID NO: 94216 - DNA, 1042 bp, Homo sapiens
ctgggcgaagagcgaaactctgtctgtctcaaaatagagaaagaaaaaaatctttctctattttgagtattgttcaagttgttacgtatttatacacatatatatcaatggaattccgtggaagtagagaggaatagaagcaaacatgctgttgttatgttatctgtaattcagcagtacttgcctgtgtccacagtgatgtggacatttccaggtgagcatgatggtcagcaacagcctaggactggccatggacaaaccaatatgcatttgattttgtggcacacacacaatactgctaatctctgctcagtggcttgtggcccagtttaggcagccagagaagagatctgccatagctatgatcacagtgtgtgtaattggattttgtatctgcttactggggtgaataaagccaggtgggagaaattcttttacactggcgttaactggcacataactcaaatcaacagaaacatgagcagagggtatagtggcaaagggcttgtttgctgccctatgtctttactcaagcagatgtcccttccccatgaagccttccttgctcctgagccagggctgcatttgatactgctcattcctaacctcccagtgcactttagcagagaaggatgagcacattttatctttcatttgttgttttctctggcctttcctacaaggttataaaagccttaggagcaggcatctatacaggttgagtgtccctaatccaaaatctgaaatctcgaaagttaggaccttttcgaatgctgacctgaggctgaaaggaaatactcattggagcatttcagattttggattttcagattagggatgctgagctggtaagtataatacaaatatttcaaaatctgaaaacatctgaaatctgaaacacttctggtcccaagcgttttagataagggatattcaacctgtagtaacaagagcttctatttaacatctcccccatgtacctggcattttacagatgttactttatttagtatgtgcaagaatcatttaacataactgtctt

SEQ ID NO: 94217 - DNA, 2072 bp, Homo sapiens
agccactgcacctggccaggaatggtattttaaatactgtcatagcaagcccttaagaaaattcttcacagctgcatgttaacacactggcctgtccctgactttggctttgtttccaggatatacagttgtttctggaatgtacagtagctagattgcagccctccaatcatacaaaaacagactgagggtttggaaatgctgctaaagtctagttacagtgttgctcttgaggagtctggcgctatagggagtctgagaattccttatttgaaaaacagccaatggaaccgcacagacacactgaaattaagacattctttctgtagattatgcagcattgttagagagcaaagaaaagccacaggaataaaggactcaattcagccctctgctgaaggagagggtgttcctgaggcttgagtaggaattgacccaacagggacagtttggttgggctgataccaggaggctactgagaggtgtcgatgatgccttcctgagctctgctgaatacctccttggcatcagtcctcccccaacatctagcagaaacagaggagccagacattagggaccacattggggcgtgcttttccccacagatgcatactgaagtggggacaaagtcttcagctgccatatgacctggattgctgtttcacctatcacatgcatctaatctgacttcaacaatctacaggagaaggtagaacttcatatttacattttatttgagtggtttatgaagaaaagtagaggaaaactgcaaagaacggcagaagtagactcttgaggttggaggggagtaggggatgatggtgtgggagggatgaactttgcagggagttacacaaaatttggaaaattacagagaatactggaatcgccactaaaagagaggcagggcacctaaatctatttattagacaacaattctgagaaattattcatcactaagggcaggacagtcagttgatgcagtcaagaaggggcaggaaatagggcgagctgagttatgaaagccattctcagaaatgacccaaatttgtactgagctgttgttcttgagcaaccttggggaaaattatcagtctgcttttcccacagcctgatgtccaaggggcagatacgtgtggtgggcttgctggagaaataggctcttctcacgtgagaacagcatccttccaatctagagctcctggctccaggaagtggtggtggctctaccctggtgctatttcattagtgaagggtggggtggtggaaagtgcagaaaaggcaggacccctgacaccagcaaggcattggatctctctggacctccgggtggtggactttgggactggacagacctggtcacagtctaggttctacatcttactggtcgagcaactttaggcaagtagcttaactcctccgaacttattttccttttctaccaaataatgataatattacttcatgagtttgtgagtattaaatgagatcatgcatatacagcctacagcccttagcacaccatgaacacatagttatttgataaatgtttgttagtgtggttaattgaacagaaagccttaaatgtcttcctaaccctaaaatccagtgattctttgaactggggagggcagtagagagatttaatttgtggaaaaatgaaaagaccatttaaaattattcaatcagaaatgtattaagctttgtgtatttgtgtcaggcatttgtagacagtgtggaaaatgtcttatccaatgattctttgaactgggagggaagtagagagacttaatttgtggaaaagtgaaaagaccatttaaaattattcaatcagaaatgtattaagctttttgtatttgtgtcacaggcatttgtagacagtgtggaaaatgtcttaataaatgagacatgctctttccttgaaaaagcttcagtctgactcacaaagagtatatgaattttttcctatgatggcttgaaagattttatcttcaaattcctttttgtgagattgtttttccataccagtgcttcttatttatagggcttgttgcaagtaatttgcaatattg

SEQ ID NO: 94218 - DNA, 1018 bp, Homo sapiens
acactatatgacccccatctaaaatctttgaaatatatccagtatctctgggtctggcactgaacctggcctggcatagcacagatgctcaataagtgacaaattgagtgaaaaccaatattagattaaaatattaaaggccaatatgcccatttctactctgtatagctgttccagtcaaagtattttggaaggatgagtgagaattacagtagggaaaaataatttgttccactgaaaaaagaattcttggcctggaacattttctgaaagttaagtttaacttttaaaaatcagaattttaaaataatgcgacttaatttgggctgaagtttatttttgagttatctgtaaatagatggtaaggaaatgaataaattaataattataagatgttactcagtctaagagaaagaggcttgtacaggtcttgagcacattgtagccaaataattatgtttaatataaatattactcatatcttttaattaaggaaaacaattaagtttaagcatattactatattgtttaatataaattaaacattaatattaaaaatattgcttaaaataaatatttagcaaattatattagtataatatagtaattatattgttatatactaatataatttgctaaatatagtaatatttctaattaatattagtaatatttctaattgaaaacatttttaggagttcatctgtgcctgcatatagtaatatattttttatttttatatttttgccattcttattcaaaatagtaatgaagttgtacttgtttttaaagctagtacttaaaaatggcagacagctttccccctagttggtgcaaaattgtagattttcatggtatgttgtttaaatggaatttgcactgctgcagtgctaatgaaattccttattaaggagagagatgagtgccttttatgttcaagagaaatgttcaatggccattaaaatactttgactatttgattttttttccctcgaggtctagatcatccccattgtct

SEQ ID NO: 94219 - DNA, 1074 bp, Homo sapiens
gtgaagaggaagatgaaccctacggctcagagtaccgcggcagatcatttgatgttacttctgtgaagcgtagcaagtcaactaaatactttgacgccagtggaaatggcgataattatagtagcggaggtgaagtaggctcgtgtatccacgtctatccctactgtgaatatatgatgagctcatacaataaatcctaggaaaccaattgatttcatagctcagactatgcccatatacccgaatggttctttttttccagaatagtatgttacgatatgggaaattatcccgaagcccggtaggatgagaatatagactttggggtgaccgaagaatcaaaataggtgttggtacaggatagggtctccccctccgactggatcaaagaaggtggtatcaaggttgtggtctgttaataatatagtaatgccagcggccaggactggaagggagaggaggagtaggactgctgtgattaggacggatcagacaaagaggggtgtttggtattgagatatggcagggggtttatgttaataattgtcacaatgaagttaatagcccctagaatggaggagatacctgctagatgcagggagaaaatggtcaggtctacagaggctcctgggtgggagtagtttcctgctaaggaaggatcaactgtccagcccgttccaggtggacatggctcactgcaacctccccatcctgggctcaagtgagcctctctcctcagcctcctgagtagctaggaccacaggtgtgaaccaccatgcctggctaatttttgtattcttagtggagacgtttcaccatgttgcccaggttggtctcaaactcctgttctcaagtgatctgcccacatcagactcccaaagagttgggattacaggtgtgagccaccatgcctggccaaaacagggattcttatgctcactttaccaatgaggaaatcaaggctcactggagttaagtaggtttgcagcaaaacccaactgttatagccagacacaccaaaagactgtgtcttgcccaaggtcagggagctgggtagagacaagattggcactg

SEQ ID NO: 94220 - DNA, 1014 bp, Homo sapiens
tatatgactttccagggatttatgttatccttggttgaacattctgtcttaaacgtagtagaatgtttatattgtcagaagagaataccacagtaaccttgcagaatatattctgaacacacactgtaaaagagagaaatataggatttaaagtttgtataattctaaggattttttttttaacttggtctcgtgtgtcagattgaataattctcctggtaatgaagtaatgaatgaagggatcctaacaagatgcagggtccagaaccagatgtaacgtttctcctcagcagagtgatttgtgttaatgttttatttacactttttccggttgttatccatctctgtcaccatagaagagatatggctgaataggccagtgttgtgtctcaaattggtttcatagtaaggtatattatcattctttcaatgcctcctttcgctaatgaaaatcctagaaacatctgagaagttccaaatgactcacaactttcctgctctacttcatacacatgtatgttatcaataattacttagtagactctttaatttgtctaaatttgtgcaggcataatggaacttgacaatgcaattttccattgcaaatggatgactaagctgagcaatttgcctccttcccattccttttgtcccgatatattatgctacactagaatgcctatactttgaaaatagcccgtctatattcattcatcgatgcatataaattgatttgcatgctcattttgcagtttccaaatatgcatttgttgcataaaatttttcatatctaacccaaaatgcttattttaccccttcttcaaaaatgcagctggtgtgagccaactacacataaactccaggtgtttcacaactgaatatctatagagaaatgcagaaagcatggagatgaaaggcttgaatcttgccattggtctgaagtcccaactcagatcttcctcttctggatcagctccttgaaattagggcaatattggagttaagtaacaagag

SEQ ID NO: 94221 - DNA, 2104 bp, Homo sapiens
agatactgtaatcttattatttataatagggaatctatgactcatgatttaagaaaatgcccagcttagacttaggttttatgtacaaaatcgataacttttgctttcttatttggcattttgaaacaccagtttgagtgatttctttaattctgaataaactaaactaaacctaaactagtaaactaaaaacgatgatgagttaacttctatggcttggaagatattgaagatgttagagaattaattggtctcaagccctatgggtattagagtttaaagaaccctatacctggaatcagactagctggtctggtatcagctgtgctcttgatagtacttgtctttgatgctctgatcctggtctgttcatcattgttaaatttcacagggatttataaaagatttcttgaattaacaaaaggctttggtccgattcacataaaagcagacattaacttctttatttaacacttttcatcttggaaaatgaaactgctatcatatgattcttttctttttttttttgagaaggagtttccctcttgttgcccaggctggagtgcagtggcatgatctcggctcactgcaacctccgcctcccaggttcaagcaattattttgcctcagcctccctagtaggtgggattacaggcatgtgccaccacgccaagctaattttgtatttttagtagagacgttgtttcaccatgttggtcaggctggttttgaactcctgacgtcaggtgatctgcccgcctcagcctcccaaagtactgggattacaggcatgagccaccgcgcctggcctatcatacagttcttaattatgtgcatttgaattgtcctttaattggtagttagcttttggctgcactgccttgccagatacacacacacacacacacacacacacacacacacacacacacacgctttgggttcagatagatctgagtttgaatcctggctctgctgcttactagctctgtgactttggaaagttgtttttttaaatttctacaacagcctgataatatatacttcatgaagttaatgaagataaaaagagaatttgagtgaagtacatgggcttatggcatagaaggcactcagtaaatactccctttctctcagagtcaattaaaaattttcattttatgttatggataaaaaggaaaacttgcaagctgtacatctattcacttgatgtgataggtctggaaaccatttgtaatgaaatagattaagaggaaggtagcatttgctattgtgagcttccaccatttctaaagttggttcatccatttcttaagtgcaggtattaacagatctttagaatttgagcatttagtgtttgcggccctggatactgactttgaatgtgtggccaacaaactgaagggagaggagccagttgaaggctgtagaaaagaataaataaggtttattgtggtcatactgactcaaagtagtcttctttcaagcaatatatcacttttattactaagagttgggggaaaaaaaaatttacctttatgtgctattacatctttctgtttaaaaaagtttcaccttgctttttttgtttctccagccactgttccatccctgacccatctttgtcgtttggaaattcggtccagtctaaaatcagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagccacagagtacaagtttttatgattttatagtcaaaagatgattattgattgtgagataggttaggttttggggggccagtagttcagtgagaatgtttatgtttacaactagccttcccagtaaaaaaaaaaaaaaaaaaaaaaaaaattgtaaacatcacttatattactttattgcagcttcatcaccagtacattatatgttgtaatatttatttacctgatcattttgatcattttctgctttattttgctaa

SEQ ID NO: 94222 - DNA, 1034 bp, Homo sapiens
aggctgaggtgagagaattgcttgagcccgagagttggaggttgcagtgagccaagatcgcaccactgcactccagcctgggcttgttgagcaaaactccgtctcaaaaaataaataaataaataaataaaactataacattcttttttccttaagggaaaaaccagaatatttataattactgcttccatttgcctttcattttagatgacctttagttactggtatgttttccaatatatccatgtaaagtgaatataatatacctaatacgtataaattgatggaaatcttttagaaaggccaacacagtctctagataaggtaggttctcttaattcacttaagctttatcataaaaaataactatgcttaagaaatagtgcttcttatgagcaaatataattcaaatattccatgtcaaaaatgttgctaatgctcagctacttaatgaactttattaattcagaaaaatttttttttacctttttaaaacagcctggaagagttgtgactcttgttgaagatcctgcggtatggtataaatattcttttttgtataattttaattttataaaatgttgcgatgtttctgtttcaatttgattaacaatcatcacagacaatttgaactaccctaaatttagaattcttctctgtatttgtgggttttttttgtgtttgtgaaaactgaggccaataagaaaagttagaatgcagagtgcaaggtagacaacaacgtacagacaaatagcatgtagttttcgtttttgtggggttttttgagacagagtctagctctgtcgcccaggctggagtgcagtggcgcgatctcggctcactgcaagctccgcctcccgggttcacgccattctcctgcctcagcctcccaagtagctgggactacaggcgcccgccaccatgtctggctaattttttgtatttttagtagagacgaggtttcaccgtgttagccaggatggtctcaatctcccgacctcgtgatccgcccgccttggcctcccaaagtgctg

SEQ ID NO: 94223 - DNA, 1058 bp, Homo sapiens
agagcgatactccgtctcaaaaaacaaaacaaaattataattccaggaggtgcctgttcttggcttctgccagaggttacactttccagcctgtgggatggccagacgcaggctgcaaagaaaaaaaaaattttatatgtatatatatgtatatacacacacacacacacaaattgagatagtgacagacaaagaattccaaaagctgttttaaaaactaaattttcattatatgtgccattaatttgtagtatcagcccatctttttcagttttggtataagattaatacaaagtgaatgacagactacatcattagtgatcatgatttgtataatgtaatttatgctttagtgagttattttccatatagtaaaatgcctttatttaaaaaagaagaggtacagtacattataattccaaggaaattttcgtattttaaaaatgccaatttttggctaaaaactcaaaagatttcatttaatacttgaataacaaggaaattcacaattaaggctgaaatactgttcatattattgtgtatttctaagcatgttattttaagcttgtgtattttaaaccatggttacagaattgtataggaatatattgaaggcataaccttatatttattggaattttggtttaattgtttagaatttcaaaatagtattgggatgtgaaacaggatgattatcactctgataaaaacaagactgaactgagtccttcactgtatttttctaaagaactcacttctagtgagtaagtgttcaataacataaagttaggaaatctttatgttattaaaatttgaatttttctttcactgtatcccaatattttaaatatgtgtttcaggacatttccagttaaaataaaagtttaaataatatcctcactacattaaaaataagatctttaagtaaacgtatttccaaatcatattgtcattgtgcactgaagttaattctctgaagactaaattatatgcaattgaggttctgtttcccttctaaacgttcctttactaatttttccaaagcgaaaagatgctca

SEQ ID NO: 94224 - DNA, 1058 bp, Homo sapiens; identical to SEQ ID NO: 94223

SEQ ID NO: 94225 - DNA, 1058 bp, Homo sapiens; identical to SEQ ID NO: 94223

SEQ ID NO: 94226 - DNA, 1054 bp, Homo sapiens
ggttacaaatgttcttcactacaggaaaactcaacatagaagctcatgttctggggactcaaataacagtcgtaatacatgaaaactgtaaaggatattctgcataaagggtcgttaacatctcacaggccaaatagccctctcagaaacaactaggaaaggaaaaagttcccttggagctgtgcgtttgcgtatgtccgtgtgtgtatacaactgagggagaacgaatacgagagagggaactcgagtctgaagtactgtggtgtgggcagggtgacatgtaatactgaaggaaagaagtctgctggtgaagtaagagccacagttaattttccgaaaggaagatgagtaagtgcacctgacgttattctacgaaagctgcttctgcagggtgggaatgttgggaagcaaggtctagtgcgacagaattgaaaaggtggagagcaggtgattgctggatccctaatgctcagcaagggggacgcatccacataacgtgagaacgaacgaatgaatgaacgctgcataaaagcagctttggcttggggaaggtaagagtctgcagagaaggtcttggggagaaaaagcaaagaaaaccgagggaagaggccgaacccttagtgtcaggaggaggggtggctgcggggttagtgagggcactgaccagagagaactcggtgccgggccagttgactcggaaagggatgtcatcgctgagttgaggaagggctcggccgccgccggacgcctccaggaggccgcagaggaccagtaacaccggcccgcccgggaccagactccgtacgccgccgcctccttcctccatcctccgccgccgctttctccagccaccgccacaacctcctctgctccaggaggagaggaggaggaggaggaggtggaggaggaggcggcgggactataaagcgcccgggtatcaccggcccaaccgccgccacgtctccttccggagagcccggcaacgccgcctccgcccccttgagcctcctgtcaccgtttccggggcagacgacatatcaacatccgggggtcg

SEQ ID NO: 94227 - DNA, 1081 bp, Homo sapiens
taatatagccatttaccgagagtttagagaagaaagctctgagcagcccagtatagtaagtttctatattttatcttagtctctttctttagaactgttgagaataattcatattaatcattattttgtagccctttatataaatgtacatttacttaacatgttaattttggcactaaataatctttttgctgtattaaactagctctgaaaatacatatttgctcaaataaaaacttacgaatcaaaataatattagagggagaacttaaaatatagaagtgttacctttcagttaattagtaaaatgtagttttcttcctttcagaataataagttcctctcccacccccagtcccatctccatgtctaatgaaaagtctgtcttatactctttttttttaagattcccactaaaaatatcgaaggtcagatgacaccatactatcctgtgggaatgggaaatggtacaccttgtagtttgaaacagaaccggcccagatcaagtactgtgatgtacatatgtcatcctgaatctaagcatgaaattctttcagtagctgaagttacaacttgtgaatatgaagttgtcattttgacaccactcttgtgcagtcatcctaaatataggtaggatgtgcatttaatattttaaacataaaatgcacacatgctttaaagtgttctgtgcatagctttaatgctttgttcctactgaacaggttcagagcatctcctgtgaatgacatattttgtcaatcactgccaggatctccatttaagcccctcaccctgaggcagctggagcagcaggaagaaatactaagggtgccttttaggagaaataaagaggtatgagaattgtctaatgatagctttttggtgcttcatttttaaaatttcagagcatatgtcaatattttaatgatttctgtagtataatggtagtaatttattttactggcccaaccttttgaatttcatttcttttcattgattttaatccttttccttattctagtactactcaaactattttaatattctcttatattcataatttcataatattttaaagttt

SEQ ID NO: 94228 - DNA, 1400 bp, Homo sapiens
caaatgaatagtgtaaagatcagtataacattgcgtaggatgaagtcaggctgcagtggaagagatagaggccaaagatgcaattaagaattgcagtagtatgtgatagtattatctaggtatgagagattaaactcttggttgtggggtgagttgctggcagtgaaaaagtagaggaagagtctaaagctgaaaaatatccaggaaagaactgatgggacttacctgtagaagagaaaaagagatagaagagccgaaaataactacatttagagctagccttactaaaaattagttatgttattcagagaaacaaggaataaagaagataatgtgcttaaatttccactcattgaatttgactgacatcattacacctaaatatagatatccactgtgcagataaagactagcttacaagaaggtcaggtcatcagcataaatatctacttgatgatatcaagcacgcattatcacaaatttttttcccatattaggacaaggatagtgggaaaacctctgtggttgtcgggacatggaaccaagaagagcatattgaatgggctaagaagaatactgctagagcttatcatcttcaagacgatggtacccagacagtcaggtaaagattcactttacttgcctttggagctaattactacaatttctaaaactcaaaatattgaaaaacataaaaattcaaacatttaagtaaaatccctgtttagtttttttcaagggatatcttttaggttagttttcttttcttagggaagcaacacagtgtaatagttcagagcacagtccctggagtcagactacctggattcaaatgctggctcatcacttcctaccttggagaaattacatcatcttttttatctctcacttttgttgtgtaatggtatttgcctcatatgattattgtgtcatttaagaggtaatttatgtaaaggagaatgcctggcaatagcatgcaataaacctgggctgccacccataacagtgggggtgataacattaatgagagtggcagtggtgttagtaactggctcaattctgtcagaactgagggtgttttttaaaaactacctcacatctcttttaggatatatgagtataccttgtcaaaacaccagtaagttaatctcatttcccaagaataactacgcattagcttttcttgcagactcttaactcagtatgttttcaattattccttcttgttccttcttgggtattaccttttccttcctaaaacagatgatttggattgttttcagagtgtactgacttttcgggctgataaaagtcaaagtcagccaaattaaaacatagacttttttttttttaatactttaagttttagggtacatgtgcacaatgtgcaggttagttac

SEQ ID NO: 94229 - DNA, 1356 bp, Homo sapiens
ggatcctgctcatttgagattgacagtttggcctaggctttgtcttctatactacagtgcctaacgaacagtattttaatgggagtagcttgatggaggacggaagcaaagaactgttttacaaaacaatatagtgggctagggaaattgataactttaaaacaatttttttaaaggaatctaaccaaaattatttgtatacaaataaataatatgcaagttgaaaataattattaactaagccagtatgaagtatctcttatattctctttatagaatccaagagaatgcctctgtgagataaccctaaaaatatttttttaaagaatattttatagtcaggtttttttttaactaatgcaaaactgatccctctaaccatcttctcaccctacccattacaattattctattagtgagattttagtttaataaaacttgtgtgtttctctgattcaggatggtgtcacatttttatggaaatggagatatttgtgatataactgacaaaccaagacaggtgactgtaaaactaaagtaagttagaccatcaaatcatgctgtatgcctttgtcttttaactgcttcctatggacaaaagttttatgtaaacagtataattatgaataattatgaaagtataccatttaaattattgataaaattatattaaatcatacagggtccacttgagtgggatttttaagagtacagttattaacagtgatcttactttaaatgatttggacagtaccttaaagtgctctctgttttaggtgcaaagaatcagattcacctcatgctgttactgtatatatgctagagcctcactcctgtcaatatattcttggggtaagttaaaaagaaaataatcaaaaattccattttgagccatgttttaatttttttttctttttttttttttttttttttgtttttttgagacggagtcttgctctgtggctcaggcagagtgccgtggcataatcttggctcactgcaacctctgcctcccaggttcaagcaattcttctgcctcagcctcccgagtaactgggattacaggcgcacaccaccacacccagctaatttttgtatttttagtagagacggggttccaccatgttggccaggctggtctcaaactcctgacctcaggtgatccacccacctcagcctcccaaagtgctgggattacaggtgtgagccaccacgcccggctgccatgttttaattttttgcattaagtttaggaaggaccttcagtagtctccaaggcttaatatggcccacataccactcatgtaatagttgacatggtttttcttgacattttttattgagatataatttaca

SEQ ID NO: 94230 - DNA, 1033 bp, Homo sapiens
agtagctgggactacaagcatgcaccaccgtgcctggctgatttttgggttttggttggtttttttttttttttttttgaaatggagtctcactctgtcacccaggctggagtgcagtggcatgatctcggctcactgcaacctccgcctcctgggttcaagcgattgtcctgcctcagcctcccgagtagctggtattacaggcatatatggtaccacgtccggctaatttttgtatttttagtagagacagtgtttcaccttgttggctagcctagtctcgaactcctgacctcaagtaatctgcccgcctcggcctcccaaattgctgggattataggtgtgagccacccgcacccagccccattttcttattaatgtcttttggtgaatgaaaaatttttatttcatgaaattcaatttatcatttattcctctttaatagctaacgctttttgtgttctaagaaatttttctaccccaaaatcatgaaaatattctcctatatttccttctaaagactttatggttctacctttgattatctaatgcctaaatgtggttttctctgtatttatcttgcttggagttcactaagcttcttggatttgtgggttgatatattttatcaatttggggaaatttttggacattatctcctcaaagatttattctgctccattctttttctcctctatttctgatactccaataagacatgttagtataaaattgttccagaatctcagacactgctttattcccactttttttcctttgtttcgatttgggtcatttctgttaagctgtcttcaaacttgttaatttctctgctgtgcccagtccattgaatgaatttatcactgatgtattttttatctcttaacatttccacttggttctttttgttgttgttgttttttatttacttatttttttttttttgagacagagtctcgctctgtcacccaggctggagtgcagtagcgcaatcttggctcattgcaacctccacctcccgggttcaagttat

SEQ ID NO: 94231 - DNA, 1117 bp, Homo sapiens
ctgaaatttcctatctggtcatacatgttttcttcatcatgtttagtataattattataacatttgataatttcaacatctgttccatctttgggttacatttttctttacctttcattttaaatacacttaattattttgccataatgttctatcatttttgttgtataagagctatgtgttcctctcttactcctgtcctttgttccttttccctcccccgcttgtttaaaaatattttctccacctatctcatattctgtatggatgactaaaagttgtttttcaagaagcttaatttgtagaaataatgttggatgtttatctaaaacaaggactcatgcttctagcaaatataactacatgtatccattcagcagaatagtactgaaaagtattcagcttagcaactttttaatggctttgttgttcttctttaggttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttctaaaggatggtataaaatgactctcaaccactttgtgaatacatatgtgtatataagaggttattgataaacttctgaggcagacatttgtctcgctttttttcatttttgttgtgtcttataaactgactgtttttctttgcttggatactgtgattccaaaataaatctcatccaagcaagttagagtccagcctaatcaaatgtcataattgttgtacctattgaaagtttttaaataatagatttattatgtaaattatagtatatgtaagtagctaatgaagtaaagatcatgaagaaagaaattgataggtgtaaatgagagaccatgtaaaatatgtaaattctagtacctgaaatcctttcaacagatttttatatagcaactgctctctgcaagtagttaaactagaaactgggcacatggtagaggctcacatgggagttgtcctcacccttgttaatctcaagaaactcttatttataataggttgcttctctct

SEQ ID NO: 94232 - DNA, 1039 bp, Homo sapiens
ttgggaagctaagccaggaggactgcttgagcacaggagttcaagtccagcctgggcaacatggtaagaccccattgctaataaatgaataaatttttctctcaaggtgagagatactagtactaatactactactaataatgagatcactgtatgaattcctttctgtttctacattaatccctttctgtttctgggtgtgcatttttgtgtgtaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtg

SEQ ID NO: 94233 - DNA, 2521 bp, Homo sapiens
gattataggcatgaaccaccatgcctggccaccagctgatttttaaaaattatttttggagagacaggttctcactttattgccctggctggtctcaaattcctggcctcaagtgatcctcctaccttggcctcccaaagtgctgggattacaggtatgagccactgtgcccagctgacaaattcttaaatacagaattatttttagtttagcctcaaaatcaagtatttgatgtgtttacatgtagattcattttaaatgcagaaattcacatattgaaaacaacacaattgaaaactaattttatctcactgtaacaagtgcattagagacatatatatatttgcacaaatgttgctattctctttgcagagttggtcaaacgccatgctggggtgctaggacttggtgcatgtgttctttctagtccttacgatgttcccacctggatgccccagctcctcatgaatctcagtgcacatctaaatgatcctcagcctattgaggtacagttcttccttattagtttgtacgtgtattatcagtgatgttttctaagaaaccataataataatttcctatacactctgaactaactgctttcataaagctgctgcctctgccaaggcttagtctgctcaccagtaattattaaaaaattacagagaccttgctgccatggatatttgagatcttttggtagtgaggaaattattgtagcttctatccctcccagtccaatggaagtaaagtactgtcaatattgttgtgataaattttatgtttctatttttctagcactgcaaagtattttactggaagctaatattaaataggaaattatgatggcatttttagtaactcaaaagaccattcactttgtccttctcattggctttttggttttgtagaacttggtattgtgtgagatctgaagtctagagggacggtaatttaactaaaagtatcctacatatgatcctggttgtccagagaggttaaaacgtatgtgggttgtctactttacagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaaggtaagtcagcaaagttctgaatttacattggtttggtgactgagaactagatatttattgttttttttctttttgctgacattcttagatgtcagtgtttagataaagttggatggcggggattgtttgtttttaaacatggcttttgctacggccattggaaatgagaattttgctgtgcctccttgctttaggtttaaagcagagaaaatgtgtgactgcttttggacctttgtagatgagtggtgtcagcctgggaatagttagataaaggaaaatacatcttattcttggttgcctcctgggtggggctgggacattttgtgtggccctgaggactctgggttctaaaagttgtgagaacttgatctggattcttacacccattctgttaaagagggagtacccagaagcctttctactggaataggaagaataaaaatttcatttattaggcttttagagttggatgtcttgttacctaattgaaattttttcctccctgatacagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaataaaaaccctgactggctgttttttccctgtattctttacaactattttttgaccctctgaaaattattatacttcacctaaatggaagactgctgtgtttgtggaaattttgtaattttttaatttattttattctct

SEQ ID NO: 94234 - DNA, 1031 bp, Homo sapiens
attccaatttgaaatggactgtgtacacgcttcatttagtacttttgtaaactgtgtttgtgatctgacagcagcctgtgaaattcataagaatcacataggatgtaagtctccatgatgtatgccaattacagaaattaggttggtctgtgtctttgttactaacaaaaatagctatagcagtggccttcagagatgtagagtctggaaaaacttgatcttaatgtcaggttctggcactgcttttacagttatagccctgatgagagctatcagtagggaaaataatttatggagaaatttaattttgctaaaagagataaaagtttatgctcataaccctaatgtagtttttatccattatgaggccacaaactctttgagaatctgctgaaatctctattaagaaactgccaaagagcatacacaaaatttgcatgcaatttcagggaaggtcttcaccccagttcccacactaccccctatcctccattattccctcagacttagaatgtcagtcctaatagaaattattatatctacaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcaggtaacattgctggtaggaaacacctgtatcctattgggaattaatgagggttaaccaggcttactcatatttattgaataacttgtatgtatgtgcccaggtctatgctaggtattgggaaaagttttccctacttttgaggagttttgcatatagaaagcaggacttggaatgtagaaaagctaaaattgaggtagatagaaaggaacctgtagaactgctacctaacaactattgtattcagtctaccctccgcccagaatagcttcataaaaaagagatattcagaattagttattttggagggtctgaaaaacctgttt

SEQ ID NO: 94235 - DNA, 1762 bp, Homo sapiens
ttttttttaaattgtaataggtaataatacatgctggttatgttgtcagtgggtttcatggtgtctttctcaaattgtttgctattgtgtcgtgggaaacaagatgaaacactctgaatgtaaactaggacagcagtgtgctcagaagccagagatgagcagtcacaacacctaagtgttaataccccttaattataaggcttcttttacacacaggcataatctaagacccactccaggaattgtcttgggacagtttactttgattgggtcataacttttgaacctcatttttatttataatgtggcacctcttcctattattaagtattttattttgcagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccagtgagtggataaaattagtagaaactcagttgaaaacatctatttgattatcctgtagagttttttgcaccactttttttattgtggtaaaatagacataatgaaaaatttactgttttaaccatttttaagtgtacagttcagtggcattaagtacattcacatccttgcgcaaccatcatcaccatttatctctagaatcctcttcatcatacgaaactgaaactttgtaccctttaacaacagctcctcattttccctcccctcatcctttataaccactgtctactttccatctctgaatttgcccattctaggtaggtcacataagttgaatcataagtcttttttgtgtctggcttatttcatgttacatagtattttcaagttgaatgaatgaatttctgaatcatgttgtgtccttaatctgttacccattcatctgtttgctggatatttgggtttccacctttggctattgtgactaatgctgctctgaacattgatgtttgtataagtacctgtttgagttcctgctttcagttctttagggtatgtacctagaagtggaattgttagaccatgtagtatttctgtgcttaagtttttgaagagctgccagactcttctctgcagcagctgcaccattttacattccagtcagcaaatgcacaagggttccgtgttctcgccacctgttttgtttgtttgcttgcttttttaaagtatagccatcttagtgggtatgaagaggtatcttgtgattttggtttgcatttccctaatgattactgatatttcaagaatctttattagccattcgtatttcttgtttggagaaatatctactcatgtcattcattacccagccctctgctgcctttcactctgtcgtccaggctgcttactgcagcctcaatctccggggctcaagagatcctcccacctcagcctcctgagtagctgggactacaggtgtgcaacaccacacccagctaatttttaaatattttctagagacaggggtctccatatgttgcccagactggtcttgaactcctgagctcaagggatcctcccgccttggcctccaaaagtgctagaattacaggcatgagccactttacccagcccatttctgaattagattgttttgttgtttttgagttttagttctttatttattctaatatcaatcccttatcagata

SEQ ID NO: 94236 - DNA, 3171 bp, Homo sapiens
ctagaagtacaaaattagctgggcatggtggcacacgcctgtaatcccacctacttgggaggctgaggcagtagaatcgcttgaacccgggagggggaggttgcagtgagctgagattgtgccattgcactacagcctgggcaacaagagtgaaaactctgtcaaaaaaaaaaaaaaaaaaaaccctgaggctaagatttgaagaatgagcaggtattggtttaacaaagaaggggtcaaagttttctaggcagagagactagcatgtgtcaagactgtagagtaagaactgcctatgattcattctaagtcagatttagcactcacatggatgtactgccagatgtcgataggcgaggtgtttttttaaagaaacagaatcctatttctgctttgagtaaagcagacaaccagttaagtgatttaaacttttttttatgaatgtgtacctttttccttttctagatggctatctcagctgttgctggtatccttaaacagctaaaaagaacccacaaaaagctgaccattaacccctgtgaaatcagtgagtactaccagaagtaattaatagtgctttccaataaaactcagaaaattttcttgacatgtataaattctagttcttgacctcaaatattgttctatggatattaacacaaaatataaataatattatgaaggaaacagttgacttagtaaaagctagtgataactatttacaaaaatagattgactctttctgccttcatatttatctcacctactaagcaattatactaattattttatcaactgtatttcaaagacttaaattgctgttattaatttgttaaatgtttctctttgggtggtgggattagggacaaggtgaattttcttcctcataccttattgtattaccagaatttttcagaagaaaaaaccatttttttctggtctccaatccaggattaaaacattgcatttaaattgtatggtatctttagtttcctttaatgcaatgtttaatcctggattggattatagtccagaagaaaatgttttaatttttttcatataaagtacattcagtgggacaactgtcaaaatttgagtaaagtctgttgatgaaataattttactgtattaatgaaagcttttttgagaattgtattttgattatttgagatgatgtctacagtttatactcatagtttagataagtatgtgtggagagagagagaatatcaaagtatgcatggtaaaatgtcaaaatttgggtgtctcagtaaaagatgtgggaattttttgagctctgtaagtctgaaattattatttcaaatctaaatagtttaaacaaaattaatccttttaattttggtaaaaggaatgaagtgtgtttcatacttgatctctcccccaaaataactgattcaacacaatttagtagataatgccatctactctgttttgaaatgtgcctccaattgctcatatatatgttatcttaatgttatttttgtagtgttgttttgtgaagacaaagttatgctggtactgttgattgaaatttggtaataattgttgggcgaatatttttaaattcatcaaatgtgattgtcttttccttaggtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagtaagtaacttactgtgcaccttatcattaaatgcctttgatataactgctttatcatattttggtttctggggaggttcagaggcacttgaaggttcttttatctttccccttccctagtcctctctttcttttgctcctgccaatgctatgcctcattcctgcctctttccttgtgcaaaaacccttagcctttctgaatcccatggttatatggctaaggaggttattaatagctgctctaaattatattcctacctattaataatacatatgcctaaaccagcccagagaaatacatatttttctctccttatttactccatttgtcattaggacacagtgatctgatagatttttaaggcctagactgttactgctgtactcatctccccaaacttagcatctagttagagttcattaaaagtgccttctaatgctttctatccatgaagctctaatatttttttctatgcgtatgataaatatgaactcttactatataggaatatggttgtttatgctggtgtggaagagcagcctaagcttggcagaagcagggaggatatgacagaggtaagcattccatttcaccatggttcaaatgcatcttgttttgggccactgatttatctcaacctcacttcagttcttcttcttcttttttttcttaatacaatttgtgtttttctgtatagcactgcataaatattggtgactatgtaatccattctcctcaaccccttcatactagtgccagttgacatagatgttgatgtatctaagactgagttactaccccattcagccctccgttggctactgctttatgtaatttgctgctcatttcttgtatcagttctgatacaagcgttttgaaggaaaagttaatgactgatttttagttttctattgcatataaattatgggatctccgtaaatgcatgttggtagatttcagttaaaactccttaaacttcatttaatttacttcactttgaaagttgacttggctgggagccatggcacatgcctgtaatcccaacactttggaagtctgaggcaggtagatcacttgagcccaggagtttgagaccatcctgagcaacatggcaaaaccttgtctctacaaaaaatacaaaaatcagctgggcgtagtggtgcacacctgtagtcccagctacttgggaggctaaggtgggaaaattacccgacccgaggaaggcaagactgcaatgagccatgatcgcaccactgcactccagcctggatgacagagtgagaccctgtcccaaaaaaagaaaagaaaaaaaagaaagttgagaaagggtttttaagtttatgtacttggtccttgagttaatggtattgtaactttttctgattctgaacagtttgccttt

SEQ ID NO: 94237 - DNA, 1392 bp, Homo sapiens
actgataacactcaagcaagagtcttcctaacttgattttgtctttgccttataattagtatatgaatatacctctttgttgttttctaaaatgtctataaataataaactcttatagcctacctaatatatttcagaaacctggtgtatcgtgtgtgtgtgtgtgtgtgtgtgtgtgtgtgtgtgtgtgccactcccaattaattgattactacttacagagttacttgtgcatgtccattcaggaaaagttgagttcactcttcctagcctttcatgagcttttcccagcatctctgttcacctgtctactttcattctggcttgcttctcatcaggccgtttacagtcaggtggtgggaagtaagtggggaaggagggtgaaattggctagaatttgaatttctattatatttttgatgttcattttagtattatagtaaaataatacctcaccttttttttaaaggaactatgaaaatttggtagacaccttgctagatggtgtggagcaaagaaacctgtaagtgcaaaagatttttgtaattctcacagcatttttcataaatactataggagttttctacatggaaggctatgaatgactatgtcacaaaaagttatattccggtttgtgtatttggaagcagattaagaggaaaagagatggagggaaagtttgggattaatgataggagcagtattcttcactagacctattttaattcttgagaaatttaaaattataaggtgtttcacatacagttttttttttccaagtggttttatgtgtgatatgctttgttatttttcctccttttaaggccctggaaatttgaacatataggcattgggcttctgtctctactgctgagagatgaccgagtgttgcctcttcgtgccatacggttttttgttgagaatctcaaccatgatgcaattgtagttcgaaaggtacataccttgttttagctacagtcttgggtttgagaatatgtacgtgacctgaagtctttaaattcttcacaagcaatacacacttggttaataaatatcttgaagtgtattgatttgaaatctccccctgttgattcagagatgataatgattcatctaacaaatgaacatgtttaggcactctgtttaaaagactggggatatagcaggaaataagtttataggctaatgggaaagatttaacaattagaaaattaggtgtgcagtgtgtttcaggaggggcaagaaactcgagggtatagctttttactctccaagtgttagaggtgaggtgggggttggggagatggcctaagctgaagcattggagaaagacctttaaaaataccctgaggctgggcagggcttggtggctcatgcctgtaatcccagcac

SEQ ID NO: 94238 - DNA, 1482 bp, Homo sapiens
ttttttttttttgagagagagacaggggtcttgctgtgttccccgggctggtctcaaactcatggcctcaagcagtcccctcaccttgacctcccaaagtgctaggattacagagatgagccaccatgtctggcctccacaatgttttcatcaccccaaaagaaaacaagtacctaatagcagtcgcttcccattcttccataccccaaacccctggaaaccactttctctgtcaataaatttgcccattattagatatttcatataaatggaatcgtaaaatatgtggacttttgtgtctggcctctttcacttagcatgacattttcaaggttcgttcaggtagtatgcatcagaacttcattttttttcctgcttttttctttttaacaagattccaaagtcatgtgttgaaatagcggaattacttcaacagtcaaaaaacccctctatcaaccagatattgcttagcccagaaaaaattaaggaaggaattaaacgccaacaggaaaagaatgccgatgccctaaggtaattgatgaatggtgtacttcaatagatgacattatagatagtaagttttggcttttttttgagacagagtcttgctctgttgcccaggctggagtacagtgagacgatcatggctcactgcaaccttcacctcctgggtttaagctcttctcatgcgtcagcctcccgagtagctgagattacaggcatgcaccaccacacccagctaatttttgtatttttagtagagacagggttttaccacattggccaggcgggtctcgaactcctggcctcaagtgatctgcccacctcgggctcccaaagtgctgggattacaggcatgagccactgcgcctggccgatagtaagtttttaacatctctaaaatatagatgtataacataactgcttaatgatgtttacacattgacttctgaaaaaaatacaaaaaagttgagaagtaattactacacagattcctgtttttcctttttaagctatggaggtataaaacaccatcttaaaaataaggccgagcacggtggcttatgcctgttatcccagcactttgggaggctgaggtgggaagatcacttgagctaaggagttcaagaccagcctgggcaacatggtgaaaccctgtctatacaaaaaaaacaaaaatttagcctggcatggtggcacgcgcctacagtcccagctactcgggaggctaaggtgggaggatcgcttgaacctgggaggcagaggttacagtgagcagagatcgtgcccctgcagttcagcctggtaacagagcaagaccctgtctcaaataaacaaaacaaaaagttatttcactgtcctatctttttttttctagtgaattatctttctttttttgtttttttaaggtagtaatatttcagaaactacataactggtacacatcagtcattaattcctaaattcaagtttagcagatgt

SEQ ID NO: 94239 - DNA, 1964 bp, Homo sapiens
actcagtgagtagagtcattgttttttggagataatgaagacgagccctaaacatcttccatgaagcttgtaagacagaggtgtcaataaactatagctcaggctcagttgcttgcttttgtaaaagtaaaagcttgcttttttaaaacttcttgaaacacagccatgttcattcatttatatattatgtatggctactttcactctacagtggcagagaagagtagttgagacagagagcaaatggctttgctgtttgctttctggccgtttatggaaaatgtttgctgacccctggtgcagatgtataattcaagagtgttgtaggtttgactcattgactattctgttgttgaccttaatgagagcagtttaaatggacaaaattagagaggtcaagtacaatcaaaacagaaaaatatctattagatcaacaaaatcgaggttatgagtgaccttatagagaacctgtagaggagtggaatacaaagtcagtaataagctagattggaatcaggtgaggtaaattggaaatcaaaagttttgatagtaaaaactttttatgaaaaagcactttagaaaggatacctgctgtcatcaaaggatacctgctgtcatcagaatcattgtggttaattggacttttatgagtaataaatatgcagtatactttagtttttatgtactttgtaaattactcagcaaccaggtgttaactaatatttaataaattatttcaaacaccaaacttcagactctaaaattttaagagtgacacatgttgtggtttttatgatacagttgaagaaaatcagaatggaatatatgttcttagaaacatccttccatttctttattaccttattagtagccattctttgaacaatttctttttttctttttggagacagggtcctgctgtgtcacctaagctggagtacagtggcacaggcatggctcattgtagcctcaacctcttgggcttaagtgatcctcccacctcagcctcctgaggagctgggaccacaggtgtgtgccaccatgcccagctaatttttgtattttttatagagaagaggtttcaccatgttgcccaggctctcaaactcctgagctcaaccagtctgccttatttggcctcccaaaatgcaagaattacaggcgtgagccacctcacctgtcccaaactctttattaaatgacttagagaaaatattaatggatatcacctaaatgtcaagttcagatttctaaaaagtaacatgttaaatgtgtgaacatattttactaaccaatattaagcatttaagtaatcaatactcatttaaaaccaatacataggtgcattggctacaactacatgatgcctcttatttcccatgtaaacatatatatatttttttttctgcagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacagtaagcaatatcattctttcattcaagttttagtgtaaatcctgtcttgttaaaatgccctttatttttcttgccctttttccagtaataatattcttggcatttgagtccagtgtttttttaaaaaagcgtttgttacctgtttgctttttgtactttcattgatcattattgtacataacagggtgaagtagcaagttggagcatggtagggagacagccagggctccacaaagggttattgatttgttatatttacccttattttgtgtgtgcccacagcttcatttttcaaagagttaattatattttatgaggtttaccatgctagccaaagtcgcaa

SEQ ID NO: 94240 - DNA, 1665 bp, Homo sapiens
gatgacttgcaaatacaatttgaaattctttgacacagattattggagaccttttacaattccaaggatctcacaagcatgaatttgactcccgatggaaaagcttcaacttagtaaagaaatcaatggaaaatcgggtcagtattttcacctaaaagtctgcactaattgttttaaagtcgtataataacctcgtaatttgggtattattcagcatatagaagaagttttcctaaaaggaaaaatagtagatttaaaagtatgtaaaagttaaaaacatcatggtagaaatcaaatggatcctagcaaaaaatatatttttcttatacagaatcttctgcctgtttccatgacagtctctaaactctcaatgggaatttggacaatagcattgagactaccttgtaagaacttgaaggaatttaaaaataggaggaattatctatgggcatgaatttaaagcattacactttatgtagatctgagaaaaagttaccctgtattatattcagctgcagaagtcattgtaagcttctttggggccttggaagaaagagtatcagtgtaagccaagagatgttcatggcagaattcttacgccagaaacttttactgaaattgagtctaaaaaggttgtatgagttcattgtttagacaacagttgctagatactttagacagaaggaatggcatgtaaaagggcaaggagatataaaaacatggcatgcttttaggggccaggggctgtagagggtaaactaggttgcttatactttgttttgagaaagtgtttcagttttatattcagcagtaggagagtcattaacagttcttaagtagatctgatttgaatattgattggaaaagtcaacactcaattcactaaacattaaaaagctctgccaccactgtgaacagtaagtacaaagagattgatactgtaagcaagaaagggagttaaactgtttcactccaggtgaaaaacacagcctaagtcaagtcagtggtattgaaatggaaataacatgttttgaaaatggtagaattggggggcttaatgactaaggaactgtggtgtgaaagaagaagagtctttgagcctcaactatctgcctttggtgaccaggtggaagattatatggataaaagcttaaatgataacttttagaaaagatattattattaaattttgtagtaaacatatttgattaccctgaaaggctatggctatttgtagatttaagagagttgagcaattgtcttagtaggctgtttttgtactttcagtatttaactgaataagaacacaactctgttgctctcccatgcatgggtctaatagtaaactatcagagaaaaacagggtgttggatgggctatttaaaagggggatatttctactgttagccataaaaattaagacaacatttttatataagcctgatgtctttagaataaaggaaataccaccaccactcaccagtcaaccagggacctttttgaccacttattaaggtatttagaggcatccattgttgaagtcatttagggaaaatgttgaagtatttgttgctactttgttttccagctccatgggaaaaaacaacatatcagagcactgttgattgatagagtaatgttacagcatgaggtaaatatgttttt

SEQ ID NO: 94241 - DNA, 1075 bp, Homo sapiens
tgatttttatacctgaatttcttcaaaaagagtgtcttattactgcacattaggagagatgtttttgactgattttaagaggaaggtaatgattatctaaataagcttgtcagctctatatgctttagtaaaatttgttttaactgttgtgccattattaagctgacttttctttatgtaaaggtttatcatatttaatcttttacatttgagtattggatatcaatattatgttcctttaggaggcctcctgaagtcactaaattttttctttaagttgaataacatgattcttactgaaacagcattcatcttgagaaagatagattgatttttcccattgaagatgggaaatctgtgtctgttaaaagaacattatctttgttttggtttaaacagtccagcaatgaaacttttccctttaatacttcatattggtattattaataaatgcaagcactcttgtttttatacagagtaccaagtatggtgtccttggaagagacaaagttgtatactggacttgaatatggtatgtgaatcctaatctgagtaaatctgtgtggattatttttgtcagtaactccacaaggactaaaatgaagtatgaagtagtgtttttgttttgttttgttttgagacagagtctcactctgtctcccaggctggagtgtggtgacgcgatctctgctcactgcaacccctgcctccctgcctcccagattcaaacgattctcctgctccagcctcccaaatagctaggattacaggtgtgcaccaccaagcccagctaagttttatatttttagtagagacagagtttcaccgtggtggccaggctggtctccagctcctgacatcaagtgatctacccacctccgcttcccagagtgctgggggattacaaccgtgagccaccctgcccggcctaaaatgaagtagttttgtattatgatgttcctaatctcttttttgatatatgaaaagaatattaattatacagtagtcatttttgccttttctggagaaactggaaaattattgtataaagaatagccagtaagaaattgggtca

SEQ ID NO: 94242 - DNA, 1045 bp, Homo sapiens
cctacagcataccaaaatacattcatactcaagtgccacagtaggccctgtagagctcacatacaggaaaagtcagccctccatatgtgtagatttctcatctggctaatacatttagttgaaaaaaaaatctgcgtgtaagtagacccacacctgtgttgttcaagggtcacctctgtgtaggagatatggaagctgtattttaatccaagttttaaaagtcgaggaagaagataaggcttttatttaaatacattacttaatattttacaatcttatacaggattttttaaagtagtcagcataaatgattatttttcaaattccctgataagaaaacaattcaaagtgtcacatggattttaagaaatttggtgtcaggactcttagatgaaacttgtttgaaaaactttaaattcccaaatgacaggctttttagatatagtaaaaactatggagaataattggttataaagaatgctttttttaatttgtataatatgacagtaactaaagtgacagtaattaaaattcatgcttgatttaatattatatggcattagatacagactgcataagctgcagactgtatatttctacttcagaaaactaagtgtttatggcagcagtggggagacacatactctaataggatggctcatagcaagcacttcccctgctctaacagtgggcggggggagggtgggaactctcttgtgctttattcttgttactcttgagtacaggccttttctctttggtgaaatctaatttcagtaaagacataacgttcatgtaaaggaatctgattttattttttactaacagattttggatacatacatatttttgatcatgcaaaaatatttaagatgctcaggtttgccagtggttgaagctttatagaaggaaaacaaaattttaagaggaatttggtcttgaaagtctgaaaaagcaaattaacgtttgatactattaatatacaatattaataagctttgaagtaagttagtgaaaaagaagccattctttgtttatactctat

SEQ ID NO: 94243 - DNA, 2501 bp, Homo sapiens
gagtgcggtggcacaatctcagctcactgcaacctctgcctcccaggttcaagtgattctccagtctcagcctcccgagtagctgggattacaggcgtgtgccaccatgcccggctaatttttgtatttttagtagagacagggtttcaccatcttggctgggctggtcttgaactcctgaccttgtgatccacccgcctctgcctcccaaagtgctgggatcacaggcgtgagccactgcgcctggccactaaatatcttatacttactataaactttacagtttcaaaggatggatataataaagtaattgtgggtaattaaggataaatttttttcttatttcgtactattgaaaacagtttgaatttttaacagttttgtcagatatcacaggttgttgaattaatcttaaaataggacctattttgctcttggaacctttagataatgttttaagagaaatatttgtggtatagtttatactcataattctacctttatagatgtggaagttggattatgtctttccagagtcacaggaattttggacccttgcctttaatcctgaaatcatcattaatttttccttttgcagtccattctctaaataatcttttaggtctaaccagctatcacaggatgcaaaaaactaacatctaaaaaacagggttactcaaggtagaggagtcatttttcatctcaaaatattcctttattttgtgtcccctttcctctgatagatttattacgtcatttttagttaaatcatccttaggatctcagcttttactaacttttcgctcaaagaaattcatacttaaggtctaatagtgagaccatttcattgatatgtgaaaggatgtgttgcttatgcaatgaggggcagggctagctaacctctcttggcacctccaggaaactacccagctctgctgggggagctgcacacagaaaaggaaacagttactactccacggtgagtaaccctgttttctccttatttcaccttctgactgttttcatttatttttaaaagcttatgtgtcagacttggaagtagttcctgttttcagagttaatttaaaatctagcaacatataagatttctctttatttagtgaccctttgttcactggcaggataagagccaggttttcatttgtgtttatagttattattgctacctaggattgaattggataatagaacacaaaaataggcctaactgtctcttgtgagacatttgtactttgaagggaaaaaatctattagtggcttggttttacatcttttatgtttatttttatttggaaggggaagggttattgggaagataggatgttctttcacttatacacaggaagaattttatattattgtttacagctgtttcatgacaattcgcccagccttcatttacatatgtgatttgtattatatattttgtttttgtgttattagttatttctttttcagcatcccttctttcctaccagtgattcttttcatagtcctgctctaatcatatctaaagaagattcccatctagtggtacgaatactatagttgttgaaaattcataggtccttttttagtggtacaaatattttaatacattttactatatgttaggtggcctggtactatctagaagctatgaagcagatttaattttattattattacatagagggtgttatttacagtatgttgtgctggaattatttttttgaattgtattgttccttaggttaaatgatactatggtttgtaaaatgaactagtgaatgagtaggatggatttcacatgaggaagggagaggtagtgatggaatttgatttgacttacatattgttaacatagcttttagtcagaatatagatctgtaagacagtgccttaagactattcacttaagattatgtgcatagctaaaagctaccagaacagtttaatatatcacagattacatcctgggcacaatgagatctataatgtcacaaagagatacagtcatgatattttacttgggtaatgggtagagatttcttttagtaaaaaatcttctaaaggtcagaagaggtaggatactatggctcatgcctgtaatcccagtgctttgggaggtggaggtaggaggattgcttggggccagggatttgagaccagcttgggcaccatagcgagaccctgtctctaccaaaaagtaaataaacaaaattagctggcgaggtggtgtgcacctgtagtaccagctactcaagagcctgaggtgtatgtgagtccacttgagccaggaaggttggggctgcagtgagccatgatcgtaccattgcactgcagcctgggtggcagagggagatcctatcttgaaaaataaataaataaatagctacacttgctgagaagcatttattgtaaatcatgttaatccagttaatttgtggtaggcaagaagagatcaaattatggtggataagaataaacaaaagctgtaa

SEQ ID NO: 94244 - DNA, 2181 bp, Homo sapiens
aatagagtgagaccctgtctcaaaaacattttaaaaaacaaaaagaataaaatcagcagtatatattaattttagcttaattattaaacagatagataataatttaaatatactaagaccatttttttcaacatcaatatcttgttactaagcaagttaatgaaatcacatgtaaatcacattcaaatgagtaagtgccctctcttccctctcaaaaaacacaaaggggaaaatgatttactgattttccaacaaaaacgttaaaaagcctcaagaagtggtttcaaaatgtggctacatgtctttcccatactttgtgtagtcattgtttggtgtcatgcatttcccatttttttcactccaaaaactgttcttaggcattgaactttttagattattaagtttaagaaggagaagttagggtcatttcaggtaaggaaatctgttataagtgtgtttaggaatttgccgaattctttttaaagaacttttgtttttcattagttttgttgtttgatataagcgcagttgtaccagaattcatttttgttaaaaaagattgattttgaacaatatttaaaaataagaggcttcaaaaattgtttcgattttcacctatgatcttaacagtgtgtaatacagtaagaacttgacccttttatggcaggcaaaaagctatttcatacttaacaaactttgcacatcagcaaattgagttctgcttgaaggtgtcaacaattagaattgtggtcatttaatccaataatttatctaagagcaaaagcatgtatttttaatgttagtaaatttttagtactgagtaatcattaggatgcactgctgaagggtcagctaaagaggccaagggattttccttgcagttcgtatcagcctgtatcttgatgccatgtacactgtaatagtgaattgaagcaaaaggctttatcctttgaaataaatgtgcatcatgacaaaagcttcatatatttgattattataaagccaattagattttttataatgaagtgcattttaataaggaaaagaatatattatgataatcttatgaataccatatgatacagactattagtttatattactatatattataagctataaaattgatcctgagtatccttttatctgcttttcccagaaaagttaaaaaggaaaagataaatttagcctgaaaggttttgcgttttagcacttgcacatttagagtgaaaatttaatgtaataatatgatgaagtaataaaaatctatattaaatatatgtatatttatttaaacatatatagattaaaatataaaatgcttcctgatacttaataatataatgaaataaaacaataaaacttcaatttttaaaaataattgaataatacgtatttttagggttctttttagttacatgtatctgtgggggataatgattgtataaagtaaaattaagaataaatgaacaggtctttgcctttgaattgccaaaagagggagttttccgtcttcctttgacttttgcaagttcttaatagaattgtatttaatttataactagcattaccttcagctgaaactttattttggcaaagtatagctttttacatttatttcctatgtgtaacatttttacttttttttaacagatggttaatttcataaagtaccataaaataaaatagcctttaaaatttctaaaatgcttattttaatataggttagtaattgttcaaatcttctaaatctaaattgatttgaaaaaactaatacagtaattccaataaatggtcccattgttctgtgatacgaattcatactgcctggtgtgaagaatgaatatctgtagcatgatttatggtgattatcagcagatcaatttgaaactagtagagaaagagaattaacttagcacattagttgctccataggaaatgggaaaatatactaggtcagggagaaaatgaaacacataattgtcatgaatattttagtgtaatgtctaagatgtctgaggaaaatatctattgttaataacagtttggctgtggtattaggagacaggagacattatgcattttctgaaataccagaccagtttttagacgcacatagcaattcataagattttttttttttttttttttgagacagagtctcgccctattgcccaggct

SEQ ID NO: 94245 - DNA, 2768 bp, Homo sapiens
ctttgggaggccgaggcgggcggatcactaggtcaggagttagagaccatcctggccaacatggtgaaaccttgtctctactaaaaatacaaaaattatctgggcatggtggcgtgtacctgtaattccagctacttgggaggctgaggcaggagaattgcttgaatagaatagactcttttgaaagggatgttactatggtgcatgaaagcttaagctcagaaaatgtgtttgatttcaaaaaacaattaattattagaatgcagttaaagtgacaatcctaaaattaattaaagtcatttagagaaacactaggttagtggccaaacattgaactttgcattaatgattggttcttgttcttttaaccaaaatatcttcaactattttttccctccttttagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggcaagcattttcagtactttaggattcaagaatatgttgattttttgttttaagggattcaaagtgttattttttcttgcatatgttagttttttacttttaagatagattattgaaactattattggaatatgtgaaacttgtgctgtctcactttgcatggaactgaaactctagttttctttcctattgatatgtgaaacaacttcgtatatattccttatctaatgtctatagttcaatataattttattgctaaactaagcctcacttaaactcatcatcactcttacagtatcactcttagagcaaactcatattataatgagtactcttcggggagacttttttcaggagtgataacgaagaggcagtaagatgttgttttcatgctacttttttgtatatcatttgctaccttaggtttggattatgtgtacattttcttttaaattttaaaaattgtgtatatgtatgtgggtttgttgttgttgtttttaatttctcaacttgctgagtagatgctgttctcttctaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctaggttggttttattttataattagagttattcagttgcagactaaagaagtcttttttggctttatctgtggcatatctcatgtattaattttcaattgtgttttgaaaatctgctatacatgtacttagaaaatcatttaatataatgttgtataacagaaaatttaacaacatttaaacattttaaacccaaaaattgtgggtttctttttctaattttttttattaccttctacttagcaatttcacttgtcttttggaaggtgtgtgtagatatgcctcctttgaaaggaatgcctgttttcctagactcagctaagattttattgggttctcaaaattttattttaagaattatttttatgagatttttttttccctctcccacaggtatttaacaagaaataagtatttgaaaccattagactttcatagtttgaaagtttctaaaataatagcaagaaaattaatgtatcaaacaccacaaatttttcataagcagatttaagaatgcacttggagaaagaagtgtgactgactaacatcaactctgtcgtactctgaactgctttttggaagtaaatgtttagtcccatttttaaaagatggaataagctggaagatcttctgtagcattatttcctctttttgttagtggcagtggtctttggtaaagggatgcttaaattaacagttgtttcacaaagggcagttaattattgttacttgtgatttacttagagcctgtttaaatgtaagcaggcatagtgttagcaataaatatatatttaattgttcttcactgttaagttggtaaactgaagacatttgctatttctttaccttaatcatttatatccccacgtgagaaaacttctgtgctaggctctagcaggcttattaaatagggatttggaaatatgaaaatgtcttttttttttttctagagatgatattctacagagtctgactatagtgcacaactgtttaattggctctggaaacctcctacctccgttgaaaggagagccagttactaacttgtaagtaaaaataactgttttccacttaacatatattttaagtcttagtcacttaatgagttattggtttgttgttgttattgcttttatttctgtatcactttaacctttttatttgtcactgttaaggtcaaaaataccagaggtacaatttagatttataaacctgaaggctttattcagattttcacatggtaccaggatagaataactttaggtattaattttaaaatatcaaatgtggagatattaagttagtctcttagtttactgagttaattaagataaatgctgttcttttaaaaaggaaaaatactgctttgttttgactgtagcaaatgttgattcagaattttgtagcaaaaaactttaaaaaaaaagatttcttcaatcttattcattatgatttt

SEQ ID NO: 94246 - DNA, 1384 bp, Homo sapiens
atgtgtatttttagtagcgatggggttttgccatgttggccagactggtcttgaactcttgacctcaagtgattcgcttgcctcggcctcccaaagtgctaggattacaggcatgagccacagtgtctggctagctaccgtgcccagtcgcgagcatgttattgtttatatttttctggacattcaggtagtgagagactagactttgcaaaaatcagcagtttgaaaactgaatttataataaagatagctgcttgacttctgtatttggcccttgtaaaataacattaatttcttctttctttggttcctagaaagtagtagatgaagttgttctaaattgaaagtagtagatgaagtctagcatggtgctgtttctcatagtacccaatataatggtttagtgtggatacatttggcaggcaataattgagttttgttagttcaggaaaaaaaaacaaaggctatatgtaatctttctccatattgggatattataggtggaacgagaactttgttcagccacagctgaatttgaggatttcgtcttacagtttatggacaggtgagcttgtaacccacaccaacgtttagctgaaattctagaaaatgactcttctatcccagaaagtttagtttatttctgcattataacctttatttagctactactggtgctcctgaagttataaaaggataatcgatttgtgaaccacgtagaaattaagtagctatcacttgaataattaggacaatagagagttacctgatgaccaccaaaaatgtcaaaccagattttagttgctgaaattatgctttgtttggattatttagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtaagaacattgctgcaaaaaataaacttccagcttttaagtttcatttgatgttttaaaattgacttcaagttactttgtgtatatcatgcagtttatcatttacattcatactaaagttttaaagaaatgtacagttgctcattatttgcaaatttcgtatttgcaaatttacctgtttgctctaactatttgcaacctgagaatcaagcttttgcgactgacaaaaattcagttacttaaatttgatctcacatatgccatgtgttctcagctgagagcaaacgaggcactctgccgtcttatatccagctccacttaaacaactgtcccctttgcgatctatttaatgccacttttttacatttttttgcttcttattggtgattctgctgttta

SEQ ID NO: 94247 - DNA, 1737 bp, Homo sapiens
gtatctgtaacttgttattccactgactgaccgttagattagtataatatagattaggatggctgaaatcatgcaggatctatcagttgatgttcttttggtttttttttgagacagagtcttgctctgtcgcccaggctggagtgcagtggcataatcttggctcactggaacctccgcctcccaggttcaagcgatcctcctgcctcagccacccgagtagcttggattacaggcatgcaccaccacaccccgccaatttttgtattcatggtagaggcagggtttcaccatgttggccaggctggtctcaaactcctgaccttaggtgatctgcctgccttggcctcccaaagtgctagtgttacaggtgtgagccatcacaccctggcctctaccagtttgtgttcttttttcactgtggaattggcatggaaagagttggtaaggtagcaggggattggggacatgtgcaataaataatctgtgtatctttcctttatttgtgtacagtagtgtctccccttactggtgagggatgtgtttgaagacccccagtgcatacctgaaaccatggatagtactggaccctatgtatactgtgttttttcacatgcatgcatacctgtgatagtttaattcatgaattaggcacagtaagagattaaaaacaatcataaaatagaacaattataaaaatatattgttcagtgtaatagaagttatgtgaatatggtctctcgttctcaggacacaaatatttggttaacctttgttaactgaaactacggaaactacagataacggggctactgtaattgttaactttgattgcagattttcactctgagtattttgctaactgtaagcctttaagtcaaagtgcagtttatgaatttattatatttaatgtattatggtattatgcatatctgtgatggagactttaaaaattctgttttcaaactgtagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatggtgagtatattggtgattatacactccgtatttaggtaggaggcaaagtaaacttctcagtgacaaaaggttggagaagtttgtgcataagcctaatataaatatgaaaataaatgttgtataatttaattattaaagtaacagttgtttatttatttatttattttgagacggagtcttggtctgtcacctaaactggagtgcagtggcgcgacctcggctcattgcactgtgatccacctcctgggttccagcaattctcctgcctcagcctcttgggtagctgggattataggcacacgccaccatgcctggctgggtttcgtatttttagtagagacagggtttcaccatgttggccaggctggtctcgaactcctggccttaagtgatccacccgcctcagcctcccaaagtgttgggattacaggtgtgagccactgcgctcggccgacagctagttaattatgaagaaccttacagtgttcaattctaaatgaggaatacccagaaaaactgttgtgggattttgatcaagataatttattggggtaatttattgtagttcatggtatact

SEQ ID NO: 94248 - DNA, 1146 bp, Homo sapiens
acgcttttttttttttttttttttttttttttgagatggtctcgctctatcgcccaggctggagtgcagtagcgtgatttcagctcactgcaacctccacctcccgggttcaagtgattctcctgccacagcctcccgagtagttgggactataggcgcccaccaccatgcccagctaatttttgtatttctagtagagacagggtttcaccatgttggcaaggctggtctcgaactcctgacctcaagtgacctgcccgcctcagccttacatcaggttttttatgcctgatgttagcattcttggtaattttaagatgataatcttagtgataaattttagtatccaggttatttactgcagaacagtaaagtacgctgtttgttatcctaagttgacaggtatttttttagttttttatgttggttcaagtaagctgcccttatttgcagtagaatattttgagttggtttgcatgaagttcatcagggaattgtttttgactcttatttaaaggtagaatttatttttgtcagcaagttgactataaactgtattagtgatttacgtataggcttgggcctgttgacctctgtttttacagtatgatgtgggtactgacatttttactcttttatctggacagggtggaccaagtaagctagtgcaaaaacacttagctggtttgtttaacagcatcacatctttttaccatccttcaaataatgggcgctggctggtgagtaacttcgttttgcattatagggcttggaatttttaaagatatggtcatccttgactattgcctattgtgtgacctgtaatacattttctgtccttcatagctttagctatatgtaaatgcttacatttaaattaaattactgtgtgggagagcatataaattaaataaataatattgatgtggtaactgttgacaacatggctcatttttgcaaaaaaatggtaacaaaaatgccttagaagcatagaaccatcttttcagttttatcctgtcatctgtttttgttgtttttaagttgtccagttaaaatggctttcatgtaatggaaaattatgtgctagaaatttttttagactggaatttgaaactcattttcattaattattaggaataattaatt

SEQ ID NO: 94249 - DNA, 1082 bp, Homo sapiens
tgttaagtgattgactaaaatacaaattcttagggaaaaatcaaatcaccattaaaattttgaaagggaaagcattctgctagaagatacttgcatttaggttggtgctgttgtgcatgcttgacatggaataggagctcaggaaaaattatttgtgcatttgggacaagaaagaagtcaaaatatttcatgtttagccacagtatgtttttgtctttttatatttagccataaataatcacatttgtctgttctttggatacatggacacaactgctttatgtccatgtgcctctgacctcagagtgtcatacagcacatctgttgatatttatatgtaatttttgaagaataaagcaagttactaaatactatgtaatttcacttaaaaacccttgtgataaaatgaaaatatcttcagtaacactaatatacagcacttactaagctaaagaattattttgatacctgtaaatatccttacttatttttttcttttaaaagatatttacaagaattctgagaagcttgaacctcccagtgggaagcagtcaagtgttagtcccaagatttttaacaaatgcttatgatataggacatgctgtaatatggatcaccgccatgatggtttgtaatacattatatttgttttctgtagtttacgcctattttgtgttaaccttacaaaaattgtggatagtcgcagaagttgataatagtggcttggttggtgacttgattcttggatattttctgatttagcaagctcatgtttatcaaatccagaatatagtggtaccatttctaaatctccctaaccaatggacattataaatagagtcaaaaatctagggttttgagggattcacgatgtctaacatttttactgtccgggaaccagacttgtagcccggaagactttcccaaggtaggattacaactcaggatttgtatgtgcttagactccattacttactcactgttaatattcacataaaacattgcattgaacataaagcttactaacaaagtaatcttagtgaagggagagatgtgaaggattactttgttgacatcattaa

SEQ ID NO: 94250 - DNA, 1050 bp, Homo sapiens
aagctaatttctgatggaaacacccagattttggtctgtctgctgcttgtgttttgatgtaaaagtattttagtaaaaattatttgaagttttaagccactgtgttgataaatatggtgtgtggtcattgctgcctaccttgtaaagactgaaaacaatttgttcttttcccagtgtaacctttttttccctttagttcataccagagacagcgaaatgagggcaaaggaaagagtagattaaggagtttaggtagttaatccttgcagttccgtttgtatgaaagggaaggctcaattattacatgtaaacaaataatacctgaatgtgtgaggttatcttatagatatttattaattgaattagatatgttcttaaaatacaccaatctaattatcaaatggctttccccccccagttctgtagaaaatattctcaaaacactcgtgaaaagctgccgaccgtaagtagcttctcaatttataaagcctcttgttgtttctgtgggcttttccacatctttagtatggtttgaaaaggaaatgaaaagtataaatagttcctgacattgtgatgttagtcactgagcacaacataccgtttccagttcattaactgaacttctcagatttcatttagaaatttagaaattttaaagtcatccattgtaaagtaagaataccatactttacataaaatcatctttatttggaagcatttcctagagtattgttatttgttattcagacaaaaaataggagtaatgccaagaaggtggttcataacttttttcaactatgttctgtagaatatttaaatatcccatattcttttctttttatttcaatattttttgtagagagtggggccttgctgtattgcccgggctggtcttgaacccctggcctcaagcagtcctcccaccttggcctcccaaagcattgggattataggtgtgagccaccactcccagccaattatcctatattcatatgatcaaagatgagtgtggataaaatttaattttaatttttttggttatctttaatt

SEQ ID NO: 94251 - DNA, 1113 bp, Homo sapiens
cgaaagtatattggtatagcaaggtcgtatgtgaaaacagcaggttttctgtgtagcgcagaaccaataaaataaatgtaatattaatgagaacacaagcattagtactgatagaattatgtatcttatgctcattttcatggataaacagtttacaattttagaattaccttttaaaaatcttcatttaaattgagtaatttagtttaaaactagatgactctttaaaccttagctgttaattctatactttgttactaaaagaagacccaagatctgtgctttttgttactctgatataaaatgtttattattacaaatcaatagacagataagtataaatatatatgagcagatagcctttttataagcactttggaagtgcccagaaataaaaatcatagctgtggtcttcagggagctttaaacgtagttggatagaagtttgccctgtttttttttaatgggcaaacttagattttctctaaactgtgtttttgaattgcttagccttttcataagaaaaagaagaacctccctctcatgatcagagacagtgcttattgatggccttttggccatgtagtttcttttttattttagaagtcatctcatgtgttgtaatctagttgcctcttcagttaatttttctctgagtagttttgaaattaaagaggatttctactgctccaagtaatgagattatagttttcctctcttggttatataatatgttgattatttgtgatgagtttgctctctgttattccttggaatttctttgcagattagttcctaaactttcagagaagttggatagacttctggacttaagaatttcaaaaagcttaataagaaagtgtcaggtggagacattgcctgaaacttactcctttcatatatatatatatatatatatatatatatatatatatatatatatatgtatatatatatttatatatgtattatatatatatttaaatatgtattatatatatttaaatatgtattatatatatttaaatatatattatatatatataaatttttttgagatttggggaattttatttttacttgtacatatcatactgtaagtagtcacacacg

SEQ ID NO: 94252 - DNA, 2058 bp, Homo sapiens
gttaaccatatatacattgttgtacaacttcttttattttacttgactgaaactatacccattgaataacagctctccatttcctggtccttgcaacccctggcagcaagtattctactttctgtttctatgagtttgattactttggatacctacacagtatttgtcttttgtgactggcgtatttcacttaacattcatacatgctgtagcttatgactggatttccttcttttttaagactgaatcatcctcatcactggttctagctgaagtatgatgggatcattcttcctggcaaataaattcctgtttctatccagaaaaccaataaaaagttttccatgaaatgttaaaaaaaaaaaaaaaagacaataatccattgtgttgtatatgccacattttccttatccattcatccttctgtggccattcaggttgcatctacatcttggcttctatggataatgctgcattgaacatggatgtgtcatcatacctatttttaaagggtatatctatttttctcttgcagatatattcgactttatgggagaaaatttagcaaagaagatcatgttctttttattaagttattgtatgagctggtatcaattccaaaactggaaatcagcatgatgcagggatttgcccgccttttgatcaacttgttaaagtaagtctttttccagaggtttctgttaaggtttgtttgtttcttcagggttttagggaatgaggactaagtgtttttggtaagaagaccaagtctcaaattgccaatttggaaaatgattgcaaaaaacattatcttaattttcatcaaatgtgtcagttaaccttttagttaaaattccatctcttccatgacatggtctcttctctagcacccattgaacttccccttttataggttgttaagtcccttgagaagacaagacaaagatcatggattcttttgcttaccctgaagcatccaactcaatgctggaaacattaaatattccatagtgtgggaaaacatgaaattcatccacaataatggcgacacaaatttaaatgccctcttttatctgctgctctttgaggtttgagcagcagcaagaattgggtgcattattcttcttaatactatgttctgctagtgagtggccatggatggggaaagcaaaacccatggtgatgagcagcaatgtttaactgtccctgtgtagtatttgtggtatacacacatctgtgcacatatgcatacataggtatttattttattttactttttaggaaaaaggaacttctttcaagagctgatttggagttaccctggagaccactttatgacatggtagaaagaatattatattccaagacagagcacctaggattaaattggtttcctaagtaagtatttccatttaaagcacttatttgggagtacttggggttttttaggggggtgatcatgattgaaaaatattgagttgtttgaaagaaacaagcagatattttaatgtgcctatttctgtgtaatttgactcctgaaacaattcattgccctctataaactgtatctgaggctgcatctctcttgcagatcattgacttcttgcacctacatcctgcctctttgatagctaatttttggttttatattttattctgagtttatataataaaatatcatctgcccttttttggttaatagtgatttcatactagactgacaggtatcatttctgtccagttgtggtctagctttaaattttctcagttttagcacgtttggcttatcattcttttttttctgagatggtgtctcactctgacgctcaggctggagtgcagtggtgtgatctcagctcactgcaacctccacttcccgggttcaagtgattcgcgttcctcagcctcccgagcagctgggattacaggcatgcaccaccatacccagctaatgtttgtatttttagtagagatggggtttcgccatgttggccaggctggtctcgaactcctgacctcaggtgatctgcctgccttggcctcccaaagtcctgggat

SEQ ID NO: 94253 - DNA, 1258 bp, Homo sapiens
tttcatcatgttggccaggatggtctccatctcttgacctcgtgatccgtctgcctcggcctcccaaagtgctgggattacaggtgtgtagtagagacaaagtttcaccatattggccaggctggtggtctcgaactcctaatctcacgtgatctgcccacctcggcctcccaaagtgctgggattacaggcatgagccaccacgcctggctggtatctggaatattgacaaggcctgaagcagccactgaaagcagggaatttttctttgatgtcttctgtctttatcttaaaaatgtgttccagtttttagggagatgtttgtgttcatttaaaataacattttaatgattctagcttttgctcctaaatttagagtgaaattgagggaggcatcagaaggctctatcattatgcttattcaacagcccaaaataataatatatttgggtgtaggatcttttgtcttcactaatctacgtgcgttaccattttagggtgtttaagaaactttcataataattattttgagtatcccttatttgaaattctgggaccagaaatgtttaggattttggattttttgaggttttataatatctgcattatgttcttaccgattgagcatctcaaatccaaaaattagaaattggaaaactccatgagcatttcctttgagtgtcatgttgttgctcaaaaagttttggattttggagggtttcggattttcggattaaaggtattcaacctgtactggcagaaccaaaacaagatctcacgtctcattgctcctccctctatatttgctggtctcatagtactaatgtgagatcatgggattataccttgaaatgacagaaaagagctgaataaattcagaccagcttgagaaaataaaaatgagttaatgaaccaagaattttgaagaatttctggaagataaaaaagcagttagatgccctaactttagaaattaaatgtaagtgctgggcgcagtggctcacgcctataatcccagcactttgggaggccaaggcaggggggatctcaaggtcaggagtttgagaccagcctggccaacatggtgaaaccccatctctactaaaattacaaaaattagccgggcgtggtgttgggcgcctgtaatcccagctactggggaggctgaggcaggagaattgcttgaatccaggaggcagaggttgcggtgagctgagatcaggccactgcactccagcctgggtgacagagcaagact

SEQ ID NO: 94254 - DNA, 1055 bp, Homo sapiens
ttggtagtctgcactctagcactccaggaatttatttttcattcaccttaaaaaaaaaaaaagacaaacagctttactgagatttaatattcctaggatttttggatcccaagaataatgcattttaaaagttaccctgcatagttcttctttttcttttttttttttttttttttaatagacatggggtttcaccatgttgctcaggttggtcttgaactcctgatctcaattgatcctcctgccttcgcctcccaaagtgctgggattacaggtatactacgcccagcctttttgcccatttttaattggattatgtctttttcttactagtaatttggatatgagttctttgtcaaatatatgtatttctgggctttttacttttaatggtgtcttatagtgactagaagttatttatgataaagaccaatttattaattttctttttatagttagaacttttgtgcccttttaaaacaaatctcttgcaccatattttgataaatgctgagataagaaccacttgctggttggcgaggaactgggggaaatagaagctttctgaggagtccctccagaatctttagatttgtcagcagccctaggctttccaggaatccccctgttggtctctttttatagtattaaaatttgagctttgttaattttatgtccctaactaatgttaaatatacagttgtctgtctactgcaatgaaaacaatgggctgtagctaagttacttcagtggcttggagcagggggtcccccaacccccagctcagggactggtatgggtctgtggcctgttaggaaccgggctgcacagcaggaggtgagcagtggacaggcgattgggcattaccgcctgaggtccacctcctgtcagattagccatgatgttagattctcataggagctcatatcctattgtgaactgcccgtgcaagggatctaggttgtgtactccttatgagattctccctggtaccaaaaaggttggggactgctggcttagagtacagtgtttctctagtttttctgcagaagtat

SEQ ID NO: 94255 - DNA, 1422 bp, Homo sapiens
gtatttattgttaacaagtttggtaaattagcactccgagttttgttattgttttggcttattagataaaagtttgtacctagaaagggctaaaaataacaatggagctaatgtttggtgtttagggctggattgcagatagctgatggcttaatacccatgaacccataaccatttatagctaaataaccagcaagaaatgctactgggtagaattttattttggaatagtggttagatgctggaaactgattcttgatattgcactatgagacattttgaatgcggtgggacatgttgtgatcttgggtgtgtttttttcctaagtcatgttaaggtgacctgttcatagttgtgcttgttgttttttaagccttctgtgttgcataagtgaacatctgaataatgccaaaacgtgtgacgaaagctgagtggtgatcatatttagtactttgtagaatagaaagtggtaatgaaaagaaaatctagtttctcccactagctctgagactgtgggaaagttacttaatcatgtgtttcagtatgcttgtgcgtgaaatgaggggattggactaaataattctttttttttttttttttgaggtggagtcttgctttgttgcccaggctggagtgcagtggcaggatcttggcccactgcaatccctgcctttcgggttcaagcgattctcctgcctcagcctcccaagtaggtaggattataggcgagtgccaccatgcctggctactttttttgtatttttagtagagacagggtttcaccatgttggtcaggctggtcttgaactcctgacctcaagcaatctgcccacctcggcctcccaaggtgctgggattacatgtgtgagccaccgcacccggcctggactaaattcttgagaagcatttctactctggtattctgcagttttatttttttaatcctgtcaagcttcacatcagtcattgtgtgtatctttctacaagaactgtttgaataatttgtaaaatactggaaacagttgcatagatcaagtacattcctaaagaccaaagtgtaaatgcagttgagagttagtgggactatcttgctgatcagaaatgtgcacccgtaatctggacatcagaggtgtgtttgggaccaagttctggtttggaaggttctcaggctttacatttggtccctctttttgacttttttttttttttttttttttttttttttgagacaatctcactctgttgcccagacacaagatagtgtagtggcactatcgtggctcactgcaacctccacctccacctccctggttcaaacgattctcctgcctcagcctcctgagtagctgggattacagttgtgcgctgccacgcctggctaatttttgtatttttagtagagacggggtttcaccattttgg

SEQ ID NO: 94256 - DNA, 1861 bp, Homo sapiens
ccaccaccgcctcccccgacgccgtcgctccgccccgccccgccccggaagtgacttgaggccggtccggaacctctgggcccggcggctgcagcgtcaccagcagagccggtgcggggcgggcagagcggccgctgccgccgccaacgaactgagagccgcgtggggcccagcagcacgccggccagggaagggggcctagcgatcggtccgagggcgacgggccgccagcggccgcagggcgacgaagacgcggaggaggcggagcccggagaggggtgggggccggggagggttcgggtgggagggggtggggggggtgtccctgggctcatggagccggccgagcgggcgggagtcggagagcccccggagccgggcgggcgtcccgagccgggcccgcggggcttcgtcccgcagaaggagatcgtctacaacaagctgctgccctacgcggagcggctagacgccgagtccgacttgcagctggcccagatcaaatgcaacctgggccgggccgtgcagctccaagagctgtggcccgggggcctcttctggaccaggaaactctccacgtaagtgtgcccgggcctgcgggccgggccggggggaaaggctcagtgagaggtgtcggggatggttgctctttgtccagagggctggacccttagctctgtcctcgctggagctgtccccgagcggtgatcccagggtcgtgacagagcctgtgaagtactcaagccgtcctccctgccactttcctacgggacttcccgggtctttaccatccctctacgtcctccgcatctgcttctcccgaagtgttcgggttgttgtcttcccacctggggggccctgggtagcccaagggccccggccccgagggagagaggtgagcctttctcaagggtcctccgtggacttttgcgcatgggagaggcggggcaaagagaatttgtctttgggggagttccttgacttgtctccttgcttcctccggttcttccttcccctacgatccccgcctcttcgcatctccgttggcgtctagtaactttctgaatggagagaagaccatagggaaacttaagggttttgctttttgggggccctctcagacctggcggagttgatcgaaaagggtcgtttaaagtcagacctcattcttgagcttaacgtcttatgtggacagtgttgttttggattgtgtgttgctcctgttgtgacatttcttttggagagacatttaagatactgaggaaagtagggaagagcactgtcaggatgtccagggcgatattagtatcaggcttgtgttaattttttgagttactcagattaagagattacctaaatcagtttcaggagttctgtttgtaaactagcttcaaactatagtgtcactgaaattaggaaaaaaaaaaaaaaaacgagtgaaaatacagtgggggaaaaaaggttacatttacttgctggatgggcatctttactgtgtccgaagagctttttaagaaagaattttgctgtatcttgtttggttaactgtacataaaatctagtaacatggtatgttcacgcatgtgggtatggacgggtgaacacacaagacataactcactcattcagtgtttacccaaagctgctgattgaactgagtgatgactcagggttttgtaatagttttgtgtatattcactggatgattctcatctgccaattattaaggggcctctgacaaatttctcatttccacttgaggggtgggtgggacctttttaattaaaaagaagcaaaactaaaacatgtaatttgccctcttcagagagtgatcataaaatgtcaaggttaacagctctcccct

SEQ ID NO: 94257 - DNA, 1048 bp, Homo sapiens
ttatagctatttttaaaaagagaaaaattttttaaaatgcaatgacagtaagttgcagaaatctgaattaaattgcctttaaaaaaaccacatttgtttcttcccaggccatgaaaatgtggaatacaacagggaccatcatttagagatggcctggctgtgattatagcagccctgctctgtctttactaacaagccagcagcatgtaagaacacactgtggatgtgtgtgttttcttcttctgtgttttattttctcaaaaagaatgactgatgactttcttttgcaaattgtactatattattccaattgcagtggtaagttctgccaacattttttgatgcataaggactgttttgaatctattgttttattatgtctttttttttgcaaaattaagaatattttctgtttcttagtaatcatgttaaattaatgtacagtgttatgacactgagcataagcctttgaataagtcctcagaaaatatattttccataaagactcaatggtagttttgtaaaataaaacacttgtatttggagatagccaaattctaaaattaaaattacatcttgattgctacatattttttaaaccgtatgttatgtatcagtcctctgcacttcaaaggattattaaaggactggtatatgtatataagaggatgatgaaatggttacatggcctggaaaactatgtcataatacaaggaatgcttgaaggcattggggaatttagctggagaaaaaatacttgaaatcatgatagcttccttcaagtatttgaagggctgatacataggaaagggtaaatgttctctctttttccagaaggcaataatcttgattggagccatgggtgaatttgctgaatttgcttatttcagctgaccctgacaacaagttttcctgtaaagtcattaaatgtatataatggtggaattttatcaatacctaggagtagtctagatcagggattggcaacccacggcctgttttgcaagtttagtaaatgaagttttattggagcacagccacacccatt

SEQ ID NO: 94258 - DNA, 1029 bp, Homo sapiens
tctagtggtgcaacactaactctttggatgtcatttttaacttcgtcttttgtattcaaaagttgaattgctagtgatctttattttggtagtttttaaaggaaataagtgtataatatattatccatactaaatgagaggacccactgacaaggattacttccaattaatggtaatcattttggggtctggaataccttaagtattttttttttacttgtttcttagacaaataataaaataagcttttactttctgaatatacaacaacagggatggagtgaggggagacattccagaagatgccaatagtataagttgctaacctaggattaataactcattgcagaaaattcaggagatgacggtctagtctggtactgaattaaattatctacggtatttaatgttttactctagtagatttgctggtttggtgtctaccttaacttaaatatttagagaaaaatatggaaaagtttgtgagaaaatgaagtcttgtataaacatccttgtcctaattgttcacctttactgcagaaatcccagactggcaccagtgtggccgaagttcacactgtgttactataaatttacatgatgtagtggatgtcttaagaggtggaggcaatcccatattcaaaattgaaaacaaaaaaaatatttaaatacccaagtgagtaaaaatggactctcctggataagtctggaccatctttcaaagatattgagcgtctggaatttttatgtgcatttcgaggctgcagtttcctctgacagacaatccattgttattactggctgtaggcagtcctgaaagggcagagtcaggaaagacaaagaatttacagtacagaactttcaataatgtgttgatgtcaggaaaagagttgagccatttctgataagaaagaagtgttaatgttaagcagctgtaaatgtactttctgtgatctactcctgcaaagtaacagcagggtatttcttaggcttgggtcacaggatgaatttgagtaatcaatccttaag

SEQ ID NO: 94259 - DNA, 1034 bp, Homo sapiens
actcctcaaatattctttttcagttcttgttttgaaagggatccctctctcttgacttaaattctttaaacaacattgtttatatagtgatttaacatacagaactatttttcttagaactaggccacccagtttagaaagctgagggcctgaatacaatatgttactttcgtaagattcaaaagaatgttggtaaacaagagagggagatgtacactttgctaatttcttctgtttcccatggaaagtttatcaaactgtttgtgaaggaaatggtcaaaaagaagttttaagtgattaaccaagtagctttacagctgcagtcgtctttattgtatataaatatagataagagaggagaaaaatatttgagttaccagggcatgggaaatgatttaccttggcaaagttaataaattatgatttaatcattttctactaatgtagcactcatagaaagaaaatatacattattgtgcctggtgaaactgtaaaaggctaaaaggtctatgtagagtcctggcctgatagactagccccagagtgtttcagccaggggtgagcagagccacaggcttgtgactggacctgtgtcctggctagtgtcaagcatccccaccagtgaatgcgatacaggagcaaaatgatgcaactgctgttacagtgtttatgttacacaaaaccaaaataccagtatttataccagactcttattttaaaagtgttcagaattcaggaaatacaacagtgaaactaagtaatacgttttaaatgcaaattttaaaatagatattataaaatgtttctaatatctaagtgttagacataatcactctagcctaatttagataaaaatttttaagtattagaaaagaaattgatactacagtaaatgaataagttggttaatcatggaaaattgaaaatgaaaaagagtgcattgatgatgtcatcattaccataagagtattttttggagcaaattttttccagctgctataaaagcttccagtttctacactggtggcagagag

SEQ ID NO: 94260 - DNA, 1044 bp, Homo sapiens
gtgaagagtgaaagaacaaagcttccacagcgtggaaggcgacccaagcaggttgccgctgctggctctggcggtcagcttttattcctttatttggccccgcccacatcctgctgattggtgtgtttacaatcctctagctaggcagaaaagttttccaactccccacccgacccagaagcccagctggcttcacctctcagatcctgctcagggagcttagaatgaagaaggcagaagcaggagactagccaggaagggcggaagccaggcagacagtgctgcaaactcacatgtaaaaaacaaggtgggaggaaagggagaaggtccaaggtaattgcccaaaaagggatgccggtctggagatgggtggatgcatattatacagaaacaagtagaaatcttaatgccctttcaaaaatataagtataaatttaggtggtgagttgtttcaacaagatacatgatccttgtttggggtaggggacagtaaagctctcaaaagcattcttgggacagtggaggaaattaaaatagggactggatagtaaatgtttaaaagaattacatgaattttcttaggtgtgataaatggcattaaagtatagaaaacagcattcttattctcaggaaaggaattttagtatttagaagtcaagtgttaaggtatttccaacttaccttcacaaagttcaactacaatgccaaaaacaaacttatggggagagagggaggaaagaaaatatagcaaactttaactaggtggaattatgtagctatttgattgtactatgctttctatgtatgtaggaaaatttgtataataaaaagtagggggtcaaaagataagcatgtgtattagtccattttctcactgctgataaagacatagctgagactgggaaatttacaaaagaaagaggtttaatggacttacagttccacgtggctggggaggcctcacaatcttggtggaaggcaaggaggagcaagtcacatcttacatggatggcagcaggcaaagagagacagcttgtaaatgga

SEQ ID NO: 94261 - DNA, 1051 bp, Homo sapiens
gtgccaaaacggcttccgtatctgctgaaggaaaagagggagtgggaagaggggagaaatatttcattggaagataaaaaaagctctttccagcaatttcctttagaaacttgggggttgctgttagtctcatttgggtaatgggccccaaggaaaagtgacaaatggccttcttctggggtttaaacactaaaggtcagtgttggcccttttcacagttaagagggaaaaatctgagctgggctgggtggactttctccaactaagggattcttctgaaactcctaacctgatgggaatcattttgtttgcaggtggccaaagcccatcaagggaaatgcttgatggttactgtgcctgagctgcctgaagcctggtgtaggagtctcaacttgatcttgaggcagctgcaaatgttaggtcttgacacttgggatggcaacaagaccaggcagtgcccagagtggtcccagcggcctaggttagaggagggtagggggctggaatgtggccttagccagtcctctgagcagatgagaatacctgtcactatttcaggagatgagttgtggtcagagatatcagtcaggtgacttctctgagaggggcctggtccttctcacagcaagattgacaagtctgtgctgccagttgtccctaaatacccaatttatctcctggggtggagttggggaagtgcctctagcctggagcaaagagatctgcctgccatttcggaaggaaagaaaccagcacacatcctgtctttcattctctgtttcaaaggtaggtttttgtctgtttgcttgtttttaaatcaacacccagggctaaaggaaatcccgagtttccctgataatcaggatgatttcttattttgaaaggcctattttgccttcgaagtgtgtgtttctgacataggtttcatcctagttctagaaatcttgcttaattcataaaaggtaaaagtttaattagagagaaggctgatgtatcgtcttgtttcaaagggagactattcttgtctgtcatttgaattttttatatatat

SEQ ID NO: 94262 - DNA, 1059 bp, Homo sapiens
gatatgcagtcccttctctctgtggtcacatgggagaatcactcttgcctgctccccttgcattttggtggcatgttggactagttctgaggaatggcctgtgtccagactgcagccagagtccttgagtgagaatggtagagcctcctgctaccatgtgacaggcacgtaacatgagtgggaaacatgcttctgtgagtttgagccacagaacggcattcttacagagtgccttggagtaatgaaactcaaaactattttttaaattcatcatttagtattttccactaattcagactcattgtttagtgaaaagaatacagccatcggtaaggcacatgactgttattaacagtatgaatttagacaaattatgtaatagagttttagttttcttgtgtcaaaggcctcacctccacaaactacaaacaaaacttttgatgcttcaaattagtccataccagagtgtttagttttaattcactgctctttagtgcttgaaatgagattctttagaccaaagtggccttaaaggttcattcttgttgtatgcttattccacatttctctatatatttattttgtcacttctggtcactatatataggtttatttaagaaaaattcccttccatagtttatcaggcaggttaggctggtgctgcagtaacaaagatctccagaatctcggtggctcaaactcacagatgcgtattttccactcatgttacttgtccgtcacatggtggcagggtgctctgtgccatcctcactcaaggacggtggactgatgggctagatgcaggccattgatcagaataatcaaatgccccgcccaaatgctagggtagcaggtaagagtaatcctcccatgtagccacaaaaagaagagactgggtatgtgtgatcattaaaagtttctaactaaacatagataacagagtaggtaatatggtcgaatccagcatttcccatcagcttctttgaagcaccagttttgcagtatgttcacatgtactgttgataaagggcatctcctggtcaagtaaatctggagaat

SEQ ID NO: 94263 - DNA, 1101 bp, Homo sapiens
tgagaaatttaaaatgtgaatattttaaaaattacagaggatgattattcacattataaagtgactcatcatcccttttaaaaaggacttatcttttaagaggatattcctctggtgcatttgagtccttgtctgctcattgttttaaacaacttgcagtttttttaacaaattacagtatgacctgtgatattacccagacattcaattccgaggtatttaactagagatacctaggaatgaaatgaaaacacatattcgtacaaaaaaaatacacaaatgtttatagcagctttatttgtagtaaccccaaactggaaacaacctacatgtccatcatgggtgaatggataaacaaactgttgtagccatttaatggtatactattcagcagtaaaaacaaactattggtatatgtagcaacatcagtgaatctgagaataattatactgggtaagcagccagacaaaaaaagagttctaactgtatgattccatttatatagaaattacaaactaatctctagcgacagaaagcagatccatggtcgtctggaggtggagaataagggtaagtgaggatgggccaggaggcatggactccaaagaggcatgggaaacttaggagtgatgggtatgctcattttgttgatggcaatgatggtttcacaggtatatacataggtcaaaacttgccaaattgtgtaatatgcacattgtatatcagttatacctgaataaagctgtttttttttaaaaaaaaaaaaatgtcctgaaaaaagttctgtcttcccttgtctgccaattgcaccgttctttatatctcatccagcctgctcacagtcaagaacaggggcagaagtgggctgacaggtgtagtgcagtgtgtggaatgctgtgacaggtgtgggcacagaaggtacaatgaagaccccctggaggaggtgagcttgaggcgagtgtagagagggcatctcagaggcaattctgagaatcataggaggttgcaggtgtgtggcagaggttggtctggaggacagcagggaccatacatttggagcattgttttgaaagcgttgtacatcactgacgggtggtaagc

SEQ ID NO: 94264 - DNA, 1084 bp, Homo sapiens
gtttgctctgtaaaatggaggaaggtgagaggggtgccatgtttctgtctcataccgttttttgttatagagtgtattcatggttatactgtataataatgataataagttcttaaaccgtggtgatgagatctatttggcagaatgttttaaaataaacagtgtatttcccacgagtgaaatcttaaaaaacaattaatttccattatagtaagggtgaattttgctccttcaaagagtatagagcctggttgaatttgcccattaagaaaaaaaaatgtgtctattggactgtgttgtttgtaaagctagaatcaccttccagtggcgttttccatccttacaggaaagaggtttatctctgaatattgagaatggaggttcataatgggcattttagcgtttgaatgttgtaggaagaagatggctaaatcttcactgctcccctaaagtacacacgttagttctggtggggagtagccactctgagattttatatcagagacataatgaatgggacccatgatatgtgaaattctaattctttagtacagagaaatgtgctcttcatctttctgtcttctgaggcttttttcaagtgttcgaaactgccgttgcaaaactctaactgagacagtggaagagatctgtactaaccaactccatcttgcttctaacctccaagcagtccttgctctttcctgggcttaggccaaactaactttgagagggacttagtttgtagtttaaaacaaagatgataacaaaacccccttcttgcctggggactagattgcttttgtaggactagcaaattaaccacaacattagaaaatatggtttaggagtcatgctgctggaggctgcaagattctaaacctccccaaatggttcctgggaataacatcactattgcaaaacctaagatgagtgcttgtgacattttgcagaccctgtcctcgatggatcatttggcaccacccagatggataaactggcttatctggtcttgtggcccccacccaggactgactcaatgcaagaggacagcttcaactctgtattcatctccacccctaccaat

SEQ ID NO: 94265 - DNA, 1083 bp, Homo sapiens
gtagacttaggaagtttttcatttccccaaatgtggtcatcataaaggcctattggtgggtgtttggtgtctcagatggttctatttgttgccgttattaaattcacttacacagttaacccctttgccagttttctaccaaagtggacctgtgagaaagtactatcataggatgataaaaggtataaatttaatttatatataaggcacttgtaaagttatgtgtattttaaaaataaaacatgtcccatgataaaagcaaactcagaatgacacaaagtatatttttaaatttaacagtgcaacgcagctctctagaattttatttaacctccatcttcagtgataccattcaatttaattttctaattaggagagaaaattgatgctaggtagatgttaaatagtttcttaagttgcatttgatttttgataccaagtcaattaaagaagatagttgtgattattaagctataaattcaccagtagtttgacatgatcatattcaatagcagtccagtggagaggggtccaggtgacagcagagctaaatatttggtctatgtctaatgattgacttctgaaaaaaatcatgcttagaaaattatttttggttaggtccttctggttgtaaggaatacagattcacttgagttctctgaacaacaaagatatgtgtgtggtggatatggggtaaaagaaggagaggccgggagctgtggttcatgcctgttatcccagcactttgggaggctgaggtgggaggattgtttgagtccagtagttaaagaccagcctggccaacatagtgagaccctgtgtctctgaaaagtaaaaaaaattagctgaacacagtggcacacacctatagtcccagctacttgtgaggctgaggtgggaggattgcttcagcccaggaggctgaggctacagtgagccgtgattgtgccactgcacttcagactgggtgacagaacaagaccctgtctttaaaaaataaatacatacatacaagagagttattacaaagtttcatgcaaatgagccctgaaaaatctatgtgacagtggctgctgtggacct

SEQ ID NO: 94266 - DNA, 1042 bp, Homo sapiens
ataccttcagaagaggtgtccccaaacattggtgaggagctggaagccatatgtacagaacacatcagctccatccatccatagctcagaggcatctgactggcagttggaggatactgttggcatgcctaatgcagaagaattgtggtggggtggaggaaggcattttatagtaggacttttggggaaagagactggagtatcttggatgatcaagggaagggctaaatagccaatctgaagaaagggtgaagggcccctaggacaacagaaattaaggcttttcatctctccatctcttgttgttagtgaccttgtgtaagtgggcttctgtctctgccccttgtaggtagtcttctagatgacaggaaacatggctgccatctgctcctgggcttcactctctaccacctttcattttttctggttccagttggaaatattaggggtgtttgggagaaaggctgtaatttaccaggctttactcaaatgtctagagcagtgaactggagtatggagtgtggagggacataagagcatggcagctctccctggaaccacatggaactgtttcccccaaaggggaaagtttgctgggaagatgacagtaagtaacaatgaatgtttacgacacattttcagatagactgatgttcttgattcagagataaagacattttataaaatgcaaggtgatgtttaccattggttggttacttaaaaaaaaggagcccaataatggacagtttcatttaagatttttgaataaacaaaattaacaaagagaaacaaacattagcgtttcagtctttagaatatgcctttaacatggtgtttcatttgcattgaagttattgtcttgtgaatatgtgtggttgataacttggaaacagtctatcccaagcttgcatctttggattctcaagaaccaagcatcactcttagagcatgacaggtgcttagtactagagtgccattctagattctttagcagtacagtgatataagtactctattaacactttgttccttactcacatgt

SEQ ID NO: 94267 - DNA, 1094 bp, Homo sapiens
tacttttttgttgagacagggtcttgctctgtcatccagactggagtgcagtggtgcgattttggctcattgcgacctccaccttccgtactcaagtcatcctcccacctcagcctcataagtagctgggacaacaggcacacaccaccatgcccagctaatttttatatttgtttggtggagacgaattttggccatgttgtccaggctggtcttgaactcctgggctcaagaaatcagcccacgttggcttcccagagtgctgagataataggtgtgagccactgtgcgtggactctgtgtacattattgaaaacattatgagctgaatgtttgttcctcccactcaaactcatatggtgaaatcttaacccacaccatgagggtgttaggaggtgaggtctttggcgggtaattaggtcatgaaagtggagccctcgtgaatgggattcatgtccgtataaagtagacatgggaaatgatctttctccctaccatgtgagaatctgagaggatggctgtctgtaaaccaggaagaggtccttcaccaagaacccaaccatgctggcaccctgacttccagcctccagaactgtgagagagaaatggttgttggttaatctcccagtctgtggtattctgttttagcagtctgaactaagatgaatttttcttttctagtaataaacagaagtaagaccagctgattgatagaatcctggagtttaatctttctcctaccagaatatttgtcttagattttcattctggcagtgtctgtatgatgttaacatgctgcaatgttaacttggtagagatgggtttgggaaatttaaggcattgtttgctagcttagtagaagccattacacagtgactcacacgtcctttactgtggatttggcccctgccttcttttgtgctccaggtatctcaccctaaggtttttaccctttttggttaaaagaactaaagctaaagatttctttagttttctcttccttccttaggtcactgggatgtttctggagctcttccccctttgcctctttaccttccatgttccttggatatcaggggcactcagtagagggc

SEQ ID NO: 94268 - DNA, 1021 bp, Homo sapiens
aaccctggaagcagaggttgcagtgagccgagattgtgccattgcactccagcctgggcaataagagtgaaactctgtctcaaaaaaaaaaaaaaaaaaaagacttgtatctgtcctaaaacagtttataatattttccaagagcattatgtcctccatgctgcagcatatgacaggatttccttgcttttaagtaagattctgttgtatgtatataccaattttcagagattttctatttcggatcctttggttttagggaaaacattggaaaagccaagtgaatggctcatggtcacatagccagtcagtgttaaaagctgagaatggagtgtgcccttcacttctcttgagtctgtgtctggtgtactttccattattttaattaagcagataagactggtacacaagaagagataagcaatgctctcatagagtgtatgatatgtgctggacgacggaggctgacagtgctggtgtagagtttctaagaaggagccatcatcccagctgggtaatctgggaagccttcctagagaagggaaggctttgagctgggcttgaaggatgaatggacttgggactaaaaggtgaggggagggccaagagcagaggcatggaaagcccaagacaggtggggcactgatcagtttgggtgtagcagaggggacagttaggaggaagagatggggacagacatttattgaggatctgtcttgtgttgggcacagtatctggtctttgcccatgccatctcagtagcctgagcatgggaatgccatcctggtcatgcacttgtttgaggacatcactttctccctaccccttgggacttatcttccttacagtaaaagtcaggtgtactttgatcctgccagaaattacctggtttaaaatggggagataaagcaaagagggaagggtgttttatggtgtctgtaaagaaggtctcagaggtagctatagtatttattttacagtaatctggagcctgcctcctacttacgaggcagctggcagg

SEQ ID NO: 94269 - DNA, 1039 bp, Homo sapiens
tgatagtaatcggagacttttccgttacatgaggctcaacaaaagattgtaattccagcagctctgtttgggaaggcactaccgcggcgagtccagggcccggccgggggtcggcggctgccgggcggctggggcgaccgcggaccgtgcgggaccggtagggggtcgcgggccggctaggctcccccgcgcccctcctcgtggtatagcctgcatttctaatacaatgctgttatgctaatcaggtgacatcaccgcccagcacacggcgagtggctcctgataaaattacaaaccggcggccgccgcgggcagctgggaggaggtgtgcgcgctgcgcccgcgagctcccgggctcggcaaccgtggcatgcttaggattggccatatttaaaagttctgaagtagaacctgcgcctcctctctgcttctccctcctcctcagtaatttatttcgagcttccaggcaagggccacggaagaagggaaagcaagaaattagatgcctgtgtggtaactcctcgcggagctaaggtggactctcttgcagccaacttcccatcagatcaccctgctggacttgcagaccggaatggggctcgcctaaggagccgagcgctgcggaggctgctgcgtgttggatgggagtgggagggggctggagcgagatttccagggcgcagtcctccggggcgttacgccgggcataatggaattgcagaggacgtctagtatctccgggccgctgtcgccggcgtacacggggcaggtgccttacaactacaaccagctggaaggcagattcaagcagctgcaaggtaagccccctcccaaaggccgggcctgtcctgggtgccaacgggggttcttggaggctttatttgtgaccctaatgaagacgggcggcttcacagctcggccccagaccctgtggttggctgcgggcaccccattcacgacttagggaaggcagttgctcatactccactccagaagagctaccatttggagtccctgtctctccagcacctttttggct

SEQ ID NO: 94270 - DNA, 1036 bp, Homo sapiens
aagtgccgtgctcagacccagtcctgtagaacaatagcaaaggggaggagggaggggtctttttgttcctaagcctttggtaaattacagttttttattcagaagcttaattttaatttttctgatgtgttgggaagagccttcccatctatttagtgggctatataatttctaatgaaagccggttattgtcatttcaaccctatgggttggattagttggatcaattacaggtttcttggagtctttttaaggctcagacaattgaatgagtccaatattttactgaacatatttttagggagagcagaagcctgtgtgtgcaccagtgtgctgttttccctgcggcccctgcacccctcagctgtccctgcccagccagcaggccctggccagcagtgtctcagagcttatacatgaaaaaaggttcctaactgaaaacagaactccttccgtttggaagcccctggagtcagtagtaggctgggaatggctctagcactgtaaaaaagtagtattcgaggactgtgtgtttcttattttaacctcctcagtgctgcaaatgtggttcctgtgaggaggaggaaggaaggaagccgctcagccctagaatgtttttcattgggaagaggggggaggatgtctttcattcattggtttatttgtcttgtgaaatagttgacagtaatgacacttctctggaaaacgaggcagaacaggacgtgattttaaacatttgctgggctgtgccacattcctctggcagttagctcagaggaagctcccttcgctctggggaacggttctgtgtctctttggttcatttctcttgagctcttcggcagtcaaatttgcttttttgaaaacttaagctgggggcgcttgcaagtagtaaatagaggagttggggtgggggggggcgttcattatctaggtttgttaggggcctcacggttttcgggtcggagaatccactgcgtgctcctcctcttcccctggcccggactcccagcttcattgtgtcatcccgcctggg

SEQ ID NO: 94271 - DNA, 1024 bp, Homo sapiens
aagaatattgacagtcaagggaataccaactttttcttaaatctaatattttactaggaagaacattaaaaggattcttggaggctagttatatagaagaggaaggtgatagataactccttttgaggaaaagatagcacttttcttaggagagtcagcctaaaatctccctggctgctgagaaagctttctggatgatggttccatgtcatcacctctcctcactcctcattcttggaaaaaggggtctgcacagcctcactgctgcttcgtctgctttagtctcttttcatggcttcctaaagtgtccccatgcagttatcccagtctccccacagcagggccctgagaagagtgctccgtgcaaacatgtctgggattcatctttgctgggatttgactccagtcccagctgcagctgctgccacacctgtaccccacagaagttgtgattccttaaacctgccctgcattttggcacccttgacaccctgccctcttggtttcttctgcagggaatcatttcatgtgtcaggatcagtcttttgaggttcagttcagatgccacttattctaggcattccaggaggttggggaggtcaacatccctgcttggactcccttccttttaagatttgaagtttcagcgcttgatcattcacctgtgatttttcattactgccttttgttacagttccagtctttgtctttttgttttccctgtatttcgtgaagtctgggagcctgaagaccaaagtctgaatagtctgtcttacacatacaagccgctaaatatttgctaaagagcaaaattaatgaagtcagtgttatagactcccttattgctgtggttcccaaattgaggttctcaaaatgaggtccccaggtcagcatcagcatcatctgggaattggctagaaatgtaaaatctcagatctccacttctcacctactgaataagaaattctagggtgggtcctaccaataagtgtttccagctactctgccaggtggttctggtgca

SEQ ID NO: 94272 - DNA, 1022 bp, Homo sapiens
tttgcctgaaaatgcacccaactgaaaccattcccccccccctttagaaagattagaaggttcagtcacttgggcctggtgacttttgatgtagtttgaaggtcacaatgctggttcctctctcaagttcataaaagcctctggagcagctattgctgcagccagcgagcatccagcacttggtcagagagccgcctttgtcagagagcgctcctgtagccagactcatattaactgccccccatgggtgtgttgaatgcctctactgtgtttgcctttgaaaggcccttcttagcctttctctctcccccaaccccattttcaagaggcacaagacctttaagtagcaaatacagtaatcacagtagcatggagacacaggctggcctatatttggtttcacaaaggccttgtgaaagatctggccttaaagtccctttttaatgctgaaattatgcaagtggaaagttaatttgaggatcactgaggcacgctttattcatgaagaatgtgagcaaaacataaatacaaagtctggaggctctgttctacgctggtggcaaggaaattacataggtggtatctttatttggctgaatccccctccctccaccaagagtgcaactgtgatagaattttggagtgagagctattgttttaagcactgactggttgcaggtgtgtgtgtgcatgttgcctgaaactctctacaaaccatagacatgattttggtggaattggcgtgccaacagtggttacagctaagattgtagaagaccaaacattctgttggaatgtgaccttaacattttgaattatgtttcttaagtaagataaatttcgaaggtctattttatttttatctttattctttgaaggcctgctttaaagtttaccgtgtctttgaaagtctagtctgttgaactcttaaatcccagtgagttcctatagattgctagcttgagtgtatagtatttgagatgtgaataaagtctagtgcaaagtgtgtttcttgtgcttga

SEQ ID NO: 94273 - DNA, 1486 bp, Homo sapiens
attttggaggaattgacattgattgcaagtttttaaatatgacctggattagattatgagatgatgggtgcttgggggtaggggtgtacagagggagtcatgaaaccatggaggatgttggggaatggctagaattctacttgggacatcatgcaagttttttttccccttccatttcatttgttaatgcttattattagttgggggttttgcctcctttttgttagccaacagccagctaatcttggcacaggtcccgggaatcaggtgctgcttagcagctgatgttggttaaatgaccttggacaagtgacttgcatttcagttctctaacctgttagggttgtagattgtctgatacagatttgaaggcccctgcaaataaatgcatggccgtttactctggtcactttcattttaccgaatgtgctcccccaaggctcttctgggtagatgcccactgccaaaacattaagcatttttggcttctcatgctttgagctcacaaaatcagtcctgtgggaaacctaacaagctacaaaggagagggaaagcaaaagaaaaggtatatggattctcatgcaaagagagaaggaaagtaggtccctacctaaagtctagccctgtattggtggtggtactgataatggtaatagccaccaaaacttcttgatactccccttgtgcaggcattgtcctaagtactttgcagtattgattcatatgctcctcatagcgtccttgtgtgatgtgttatttccattttgaagatgaggaaactgaggcacaaaggaagctgtgcccaaggacacttaactagtaaatggagccaggattccaacccacgcagtgcgctttgggactcaatttttaaccatcttgctgtgctgcctgttgagcatttttcacctggtgcttttgtagatcccacattaggattttgttaggaccctgggcaaccttgatttagtgaaagcagttgttgagaggtagaaattcctgatccttttttcaatcttaaaggatttgctgagactctcactcttcattggtgatggtaacaaggagcagcatggtgaatgccatgtaaaattcaagccttgccttatcttggaggactttattcccttttctttgatggtactttggagattccagactataaaggactcagctgacagtacagactctcttgatctgtattttcccagtatatgaaattatttgtaatgtacccgtgagaacctggaataaactgtactggcactgaagtagaatcttggatttaaaagtacagtgttcactgctgcatcgttgagcatttgctacacagagaataaccttggagcaatgttcaaaggtgatggcattacccagaaacatggagttaggccaggaaaccacatctgaagttcagattattggagattgctgatttttcttgactttaaatattttcgactggttgagtgtttgttggtgtttt

SEQ ID NO: 94274 - DNA, 1052 bp, Homo sapiens
atttatcttttgtgttacaaacaatccaattatactcttagttatctttaaatgtacaattaacttattattgattaattcacactggttcccaccttagctctcatcttagaagaggtagttgtgttgctttgcctcttattttcggagaaagcccccatcataacctcagctccctccagagtcttggcttcttatggattgtgactttatgcggctcaccttgacgtacgactgtgacagaggcaggaccctggtgacagagcctcatttctcagttattgtgggtctcctctcagaagttgtgcctgcagtgccttggtctccacattggcaaactggggttgtgccgctcagaagaaaggccctctggaagctgcaggagggactgcccagcagatgcaacctgtaggtgccaggtcatagagagctcatggtgggttttgtagtcggcccatcagacagttactagcagacaattgcatatttgcttcacatgcatttagagcaaatatttacatgtgttttgtccatgatgcaagttaaacagttaaggaaactattgtaactcaaattctatttttatacaaatcagcaaacatgaatttaaggccttcagactagtccgtcacagggaggacttcagtcaaaagattagtttccttcctgttgctgcctcaagataacagttggattctctgttatcaatacagccagctgcctgtttccggcttcctgctctgtgtattttgcatgttactcatgggaaatgatttatttattttttcaagctaaggcatatagggggactccaccctaccactattcttttgttttgagttaagatccttttttattctttattttaaaacagttcaagaattaaactttaatatataaattgttaaagttgcaacaaattaagtcttgtgacaattgacctgattgggtcatgtttaaataatgttgtaatatgttacaatgatgtcctaatcacaccgttgtgtattttgcaacttcactttaccgtacaggtatgtggtggcaattgc

SEQ ID NO: 94275 - DNA, 1031 bp, Homo sapiens
gggcctcctgctcctcctcagactgtctggcccatatccccaagccttgctgggtggggagtgcaggggtgatgtcattgtgccttcccaggataggtggaacaaaggagggagtccccaaggacccgaagcctgatcctctactgagccaccaaatagatttcttttcccctctgtctccctccttccaacttcataagcatttgctgttctccaagtgctccattgtaagaggacacgctagttgactggggctttgtgtgtctctgttgagtccgtttcctgcccctcgtgtgttatgagggtgttgattctggtctggtccccggatggaatcttctgtgtcttttccaacgtgggggtgtgaacctgaggaacttagaccctgcgtgatttttccagcactcttgcacttcgtggggcctgctcctgactgtgaggagagttcgaagggaggggaacaggaagagagggcaggaacacaagagcttgtttttttatttttgacatctcttcctcctcttctttcctcccacctactttgagtttctaagaaccatgatagccctggggagccctcccggcacagatctcagtctgtttcagctctgttctctgcacccacccatgacctctccatttgcctctctgtagggaggagggttgggattgggctgtaactctttaggacagggcactaaggaagtatattgactgttgtttctggcaaatcctcagagtttccttgtgaaagaacctgttaattcaaaacctgaaagaagtctgggtgctcctttagtgagagattcacccaaaagagtgacaattggctgaggaacacattttgtgcttgtttatttagaaatattttaatccaagcaggttttcattttgatcttgctcccttgcttcattaaagacattttctgactccagtataacgcataaaggattttataattcacaaaaaaaattgttaaccctaaatacatataaactatgagttacttgcctccttgataagaggccat

SEQ ID NO: 94276 - DNA, 1764 bp, Homo sapiens
caagtattatggtatagggcaggactgcaaaggaccctgttgtcatctgcatcctgctgcctcttcagcagggatgggagaaaagaaaggggagcaaaggatgttctgctggcagtgtgcctgggagctcacatgtttaaggactggacagttcctacacagatgctccttgacttatgagattatatcccagtaaacccatcgtaaagtcaaaaaattgtaagttgaaccatcagtaatcagtgttctttctcaaagacatgaccgcagttaaggggcgctaagtagaggtgtccttggaggtcagttttgctgaccttcctctggctggggtcttgtggccctgctagcatgtgcctgctcctgccagttctgtggtcaatggtaaaacaagttcttctctgcttgcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctggtgagtggagaccttaggaagtgccgtgtgttgtaggtggaaaatatttttgaaaaatcaagtgtgacttgtctcctgttgaattctgcacttaatggttgatagttttgaggagaatcttgagaagtgagttgagcgcttcagggagagccttagtgtcacattctgagcgtggatgatgttcttgagctgtaataaagccactttgttctggtaatttgcaaggttgccacctttggtcagaaagaacttggctggggttcctgccaagaacagggcatggtgctggaatttgaagggccaggcttgggcgctggcttctagatgaacctgtgtcccacatgcgatgatggaatgttttctaaatttgtgtctttctggttgtctagaaaatctgagctgccatcttaaggtggcaagcattgaattcagtggccactgatgttttcttccctgcacgctttttattttgggagtggagggagaagctggtgttttgtcatctccttgggaaaggagcttctgatgaattcaccctgccttttcaggcaggaaagttgtcagcctgcaatgaaaattgtatccccaatctgtttcccagagctgctgcggccctctctgatgtgactcttgtttatgcaccttataccaaagaagcttaaagcagtcactgtgactgatccaacaggttttgtctcaccttggtttgaaaatggttgctgtatcctcccagagcacatgtagtgccataggtggaagtggtgccgagccagaagccaacgcccagaatggagaccacatctgtactgacatcaccaggaaaatatgatgctggcagttggcagggctgccagaaagccttatttttaacttgatctccaccctgtagcttgccagccgcagtaggcctgtgtgcagacctgccccacacctctgaccgcaggcaagggtctaaggttgtcccttgtcctatttgttatcagctcagagacagactgcctctttgagtctgggttgaaatggagccagaaaagtattctcttccctgcccttcagttcaagaacagggctctccagaagatagtgaagccctgtcttctctgtagtgagtttcatccatgccctttgttcctgagcatgtaggtcttgtggcctcattttctgtgagggtttgtcggtcacactagacaaactagacaaa

SEQ ID NO: 94277 - DNA, 1033 bp, Homo sapiens
gatgctttatgggttttgttatacttgaggaggaaggctctaagtatagaagtattttaagccggaaggtactctcaaggtcattttgtccacttctttcactttatgaagaaatcggggacccacagaaatttgaaaccttgcctctgatgacacagccagccagggctatagtgggtgcctctgaccccttaagagagagcgctcagccttttgggactgtgcaccaccacgagcctgattattggttctttctccaggctcatgcttcgtactcatgcgttccaattaaaattggaaaggcaggaacaactttgtaccatagtgtcaggtttctctgcgaacaaatattctaacagtcctgtctcctcagtgactgtgttctcttgccattccttcctgttctgcccctttaataaagatctgttttgatttttctgggtaaacaaaaacctcacacaaaaaggaaaaacgaaaaatcaaattataacttgctttgttttcttattgaaactctgaaatcagcctgtcaacagtcccttttccttctcacttgccctacgattgggcttcagttagtgtcgtgattatatatgtgggaagaaggggtaggggactagaatgagttacaggaagaaatatcttcctgcctggctggttcccaagctggctgatcatctgatgcctttgggaaacccttttaataattcaggttcccagggcccagccctagtagttctgattaagtaggtctgaagagagaaccactgttgaagatggtacaacatcattaaaggagttaattacagcaatcaaggacatttttccccagatagaactcttacatttctgttatttagttcctgaatgatttgaaaatggagtagccattgaatccactaattactgctcttgtgtcttatggcaacagaggtgaaattattagcagtacactcctctagcttcaccccagttttatggagtaaaatgttgtatttctgttagctttggcctgcaataatcagagcgtgga

SEQ ID NO: 94278 - DNA, 1099 bp, Homo sapiens
ttgtccttggcaggtaccccaatgtcaacattcacaatttcaccactagctggagggacggcatggccttcaatgcactgatacacaaacaccggtaagtccatacaaatcatcctagcaatcgtggggtaaaaggttgctgtccttccatagcagatttgggtgacttttccatatccgttggcttaactgtctcaccgtggtggaaatttctgcattccatgtgaggaaaatatgggagaatatataaattcttccaaacagaataaacaggttctcccttaatcttttttttcttaattaactttgaagtgtttattcaaaaatcaggtttcattgtttgatgattccatgatagtatattttagagttttactccactaattggtgattttaacctttttggagtaacagtcatgtttcattagtcatatttcttttcaagccatgatttttgttgtgtcccactgttgttctgcacaggcctgacctgatagattttgacaaactaaagaaatctaacgcacactacaacctgcagaatgcatttaatctggcagaacagcacctcggcctcactaaactgttggaccccgaaggtagggactcaagggattacaggtgggatttttagcatctgtaccatccaggtgttaatgtaaaatctgttttgtgtcagtctgtttcatttgggagttatcaaaggaagagcttaattttggttatgggaattttttgaggatttatggaaaggatgacactcaaaaaggccttgaaagatgaatacgatttaaacagagtctgaaggagagcgtgtgcgggcagagctactagcatgtgcaaaggtgcagaaccaggaaagaagaaggtatgcttgagggctaacaattcaatgggaatggtgtttagggtaatagcagggaataccactattcccttctgttagtggatgggatccccataggggcaacaggcaacagggagtcattgaaggttcttagcagctgtgctcgaagtagaaaagtagaaaacctggcataggctgttaatgaatacttgttggctgacatttatctgaaggtggcaagcaggttggatg

SEQ ID NO: 94279 - DNA, 1965 bp, Homo sapiens
atgtgaaggaaatcgggaaagctggtggagggagccattgtttcagggctggttatgtgacaggatgggtctgaaacatgagtgacaataaggattccataaataagggtcatcccaacttagactcagtgactagctgctggatactggtaacaaagagataaagatatccaaagactgattgacagggggcggtgctggtcctgtaggcagcaatgaggactcaagcagagctaacccagtatggtagtagggcaaggagaggaggaactatgtgtctgtggaaggcgtttcatgaatattcacataatggggaatcagtgagatggtttaaccctcattatccttgtaattaatgcacggatggcagaacactcaggtacaaacatgaagacgctgaactgttccatgttgaccagcagtcgttgcatttgttcctgctacctgggtggggcacagtagcatgcaacacactgaacagagtcttctctgggttacagacatcagcgtggaccatcctgatgagaagtccataatcacttatgtggtgacttattaccactacttctctaagatgaaggccttagctgttgaaggaaaacgaattggaaaggtgagctggtgccaattttgtgagttgtgagacataattaaggttaattgagccctcattctcccatgcactcataaaatttgccaatagcaatttgtagtggactctccggatggtagggaaatcggcagaagcctcttcatcctgaagggtaacaagaggtgggagagatggccaccatatttaggaaaggatctgggggctatctcaaacccagcaacatctttctcctcaactgctccaggaaattgggtattggaaatctgatcgagttgcctaatgtcatgggtgtgacatcctacttaccacagttgaaaaggccccagcatcgtgctttttacttctcatttggctgatgttcacctgccatgttttcaaaacacctcagaccagatgacattgtcctctcaatgcagtgaagtcaaaaattaatgggcatttatgggacaggatcaagctaaattgagccctttttgtttctctagggatttcagatgttaggctacagaaatcattcagaatctctttgcttgggggttggaaagttacagaaccaattacagttaagctgtcattgctcacaaataataatcacagtctgggcccctcttagcagatggttccttgagttaaaatgcttgtgcccaggtacagctgaactgtttcagagctggccaaactgtttcaaagccggtcgttttgtgtgcatgcactcgtatagggttacaatcgtatttaacttatggagtgacatgatcttttcaatttttctatcccttgttgccaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaagtaagatgcatattgtagtgtgatcattaatatggaaagacacatcactgtagccaacagatccctatgttctgatttctgtaatctcatctcttaactgaatgcctttcagtagtgtgtcctactccttttcatctgactctgttttgctgagatttatgatagatcatgctctctctgagcccttcccaatataaatgtgccactgacatacaggatatatgagaattccaagaaatggtacaagtccccaaccccttatccaaaaccattgtacctagtgtgtttcaggattccataatttttggattttaaaaaaacagcacagctcatatgttgtatattataagaccccagatgggactaaggcaatagcc

SEQ ID NO: 94280 - DNA, 2372 bp, Homo sapiens
ttttttttttaggtgaagaaatagatttcctaggaatgaatttaatatggacagtaggtcaggattttgaaagaaatttcagatgtgtaaattttttaaaagtggcccagggtggaatgaatgagaaattcatatgaattcttagaagaatcatttatcttttttatatgatcaaagctatttaagataatttatttcctcttaaagtaagagatttataatttacttatattgcttcatagctacagttttgttttccaagtacaacacagaatctttagatttagatgacggaagagtgttcccatgaggatacactgagagaaaaacccgtttttttcctcaaggcttgagagtcagtgagagtgggaatgggatttcccattcaagctgtcaggtccttttgagaaatattagctgttgactgtaaccacggaagtttccttgaacactgcaggaaactgtgtttgtgtgtgtgtgtattttcatttttgtaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggttctgctcttgacattattaaaaagactgttgctagggtaatctagaaacacagaccatccccaggggcatagggccagaggacagctgcttatcgacattcattattctggaggaacgtcaggtcaccttggccccttcccattaagaggatgtttataatttctaatatacatttctatttatctaacttttcatagatttggaagcagctcaagcagagtttgttttagagccattgagtgtgtgtgaactgttcacatttataagttttaacagtttctctcttttctttaatctttgaccaactaatcctacgaggcagttagactggttgtgaaataaacaaaaatggcttgcttttccacctggcttgacataagctatcacctgctctagcttttcagtaaggtactagatacgaactgggcccttctgcaaaatgagcagttactagtttgctttgaggagggcatctaagctcaaggcagagaccagtggggtgggggactcaggagtcagatttggctttaagaccaccagggattaatgtgtgctcaagatttcatgtctgttctttttccttttttggagggggggtggcgcgggaaataggttttttggttttgtttttgttttgtttttgaggcagagtttcactcttgtcattcaggctggagtgcagtggcgcaatctcggctcactgcaacctctgcttcccaggttcaagcgattttcctgccttagcctaccaagtagctggcattacaggcacgtgccaccacgcccggctaatttttgtatttttagtagagacagggtttcacaatgttggccaggctagtctcgaactcctgacctcaagtgatctgcccgcctcggcctcccaaagtgctgggattacaagcatgagctactgtgcccgggtggattttttattttccttcttttcattccgtttctctgtaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtaaaacctgaccgaaaggaaggacgacagagctgatccaaccagggctctcttttctgtgactcattcactaaacccctacgtacagctgtgtgccttgtctaactgcccacatgtacagctagagaggagccacatcacccatgggaagattgctagctcaggaattaaatgagacgtgaagtgtgaaaaagttgtagagaccagttcagtagccagagctctgtttctgtgacttagatatattccagtgtagggaatcaatcacattgtggttttctttatttttaagttttcagggttaaactaacttaccgtttcattgatctgtgagtgagtggtactactttgggcaggggtcccggagaggtggtatggggagaagggaggagtggtaggtgccatggacagaggagaggtcaggaaccaggcagccagagttct

SEQ ID NO: 94281 - DNA, 4603 bp, Homo sapiens
gatggaagaaacaagaaaatatcagtgggttcaaacttaaactctagaagttgcttggggtctactaagcaagacagccacctgaccctgctctccttattggtttaaagatgtggcttgtaagcttttcaagtagattgttttcccattgattgtgtaagtacagtagaggcataccaataagctcctaacagaggaaaaacattcacttacaggctcagcaacttctaaaagatttctttcaactttgaagtgaccaagtctatcacctttatttatttatttttgagtagttgttgcagcggtttcttcttgaagctccagtttatattttggaatctttcatacagcacccccgcccacgctccccactgccccctcccccccaccctggccccgctggccctcaccatctttttcttctattctgcactttttagtgtagatttgacttacttattccaagtttggtgatccttagtttgtgatagctctcctgactcaggccttcaggtatgatttgttttgttctggtttgttggccatcatcttcccctgaaggtgtggggtccatggcagactagagggaaggcatagcttcattgctggctctctgcttgtcgaaagatgatgtgatgctgaagtcaaggctatagtcacagatgtccttttggttgcttcttgtgcacaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggtaaggatggcccattccaagcattacctccgggtcaccagagattcatatttatagaaacacagtggggcttttgaagttactgtgccactatacattcctggtgggtttgtcatgggagcatgaaatacggtggagtggccttctgaacactaactccatcttgtttttctggaattgatacatcctttccttaaatacgcaaatgctgcctttgctttgagtggcttggtgtttggcagtgagactttgtcatacctcagtctctctggccatgcaccgacaccctggtgtggctgttccagcagctcctggctttcacagctggttgcatatacctctctttggaggatgtttagaatgatttggttatgcttcgtgtatttctagaaacaattatatgcagctgcctttttcatatgattcaagtgctttcttgcaggaggatgatcactttgtctgcggtttggccaaaaaaaaataatgtttatcattgccctcactcctgttctagtcaagttgttagaaggtgctccattgccttatcgcatggccctgcatttacatttagcagtgagctggtaatcataagaatatggggtgtagcttactgcctgccagtgagcctgcacccatgctgagctccctcacacagccacgttccttccttgatgttaaacaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacaggtgagcggggcgctggtcagccactggcctgttccttgtgaccaccagtggcccaggaggtgaccaccctgtcaaattgccatttcagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtgagcacgtggccagcagtgtgccagcctcccacgtgtgggactggggagggtgaggtcactcatcgagctttgctgttgggaatttcccacatggggtcatcgacattgcaacactgatgtcatggcattggcacctgccttttgacatgtccttgttttgtaagaagtgtctctcagggcaacatcattggttgcaggaggattatctgagtcagcccagcatctgcccctcgccacaccaaagttagggccttggtttgacctgtgtccagtgtagaaggtattaagatgacacctgtgctatccattttatagtaacttcaggaacaggactctagcatgtttaacacttaatttgccaatgaaagtcctgattgtcagggcagacctttgttccagtcttatctttctgttgagtaaacatgtttgagtaggttatggcacctggccccagttttgaaggttaccatcagtcttagatttggaaaacgttcattaggtagagttcagagatgtgtaaaatgtgtcacagacatgaattaattgactctgggaatggatatcttgtaattgctcacattggagctctgtaacacattcctcttcgtgacaggctttttccagattacattgcatccctgagctatttccattatatttggtgttcacagtttgagtgagatgattttccaaaaaagcatgtagtcaaagcacagatggagaaaacagataagcagcattaacccatcactgttccttttgcaatccagccatggtcagtcttccctttttcacactcgctgtctgcccctgcactcacaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggtaaggtttgttcctgcctttgcttcctttcggtgaaagcagccctggctgccttttgaaatgttttggctggggcagctggtttaaaccacacctgtatggaattatatggataatttagagactgatttttttttccccatactcttaaggcattgaaatccatcacgttgtaggggacaggaattgaaagttgccataagagctgctttgccttacaaagtactgtttgatttcaactgccattgaggatctcttatgtgttcatagtatgtcttcataattgaggtattgatccaatttaaaagatacagtgagggccaggcatgatgactcactcctgtaatcccagctcttggggaggctgggacaggagaatcacttgagcccagcaggt

SEQ ID NO: 94282 - DNA, 1213 bp, Homo sapiens
ttgagaccagtctgtcttcttgctctagaagggtcagggacttcacctgaggacacaaagtagagattagagaaataaaaacagctgaggatagtcaccaacttcagggctgttactgtctcaaagagagagtatgaagggtacattgctgttgccttgataggcacgtgagaggacccttgaggctgatacacaaagctttggttcctttcctcactctctttggaaaaaaaaatttagagcattaacccctgagggaaattcggtcagttacagtgtcccactgggtttttttcctcctaacttttaatttgatgtgatttaattatttcatgtaagtgtaatgaagaaagtgttgtgaactatgttgcacggaaatgtagaacacaggaaaatgagatccttcattgatctgctatgatttgttcctctttttaaataaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacaggtacagttttctgaggttcttaagggagccttgcaccttggggctctcaaacttctgaatcattggccagaagcccttgggagtttaggtataaatttcccagtgggcagaatatgggtgcccagcagaagttcatctacccatacagaaaattagtgagctgtgcatgactgcctgagaatgtgggtctggtgagacatgtacaagtgtccacaaaaggaaagaaagcctgagaagccaagctaattcttaaccgaggacctgtaagagccgtagtgctgcatcgcgatcaggtgtaagccatgccctttgaggattaacacacgcttgtgtcacctgataggacccctggcgccaggtattcccagccaagcccgtgttccccttcatccatgagaaagaagcctgtcaggagagtgggaagggagggtgaagcttgcttgttctgagtacctggcaaagctacaaaggaacattacctggacttttttagaaaattggcttggatagtgctgtaataggatctttttcatgatggagaggtaaataagagcaaaggttattttc

SEQ ID NO: 94283 - DNA, 1240 bp, Homo sapiens
attgtggaatagagaataacttatgttaattataattttgtatctgttgcttttaaaacagctgcaaaaaagaaaaataaatccaccaaaccctccttaaatgagcatgagaaacagcaattgggcaaagcattcataacctagggaaaaagaatttcctttttttgtaatattaactctgagtattttgtaaataagatatcctatgtacttccatgttagatgcacacagctggtttcctgcaggcgggcttggctgttagggatgtgtgcattcaggcaggcatgcagctgccttgctgcttcctcggtttctttttatgtccccagtgctgcaactgcacaaagctgttggaagcagatgatgctgtctagactcctggatatgataaaacgtttcagcagcagcagccctcagttgtggcttaaccttcattttgcccttgaccaagagcctgggctactggtgttccagagcttccttaggattcctcagttttaaaaatgaaacgtaaagataaccctgtactatcaataagcataataaagatggaaggagggagctttccgatgacctgccatcaggagaactacattttcttatttttctccattgatgttaactgaattctgatttcactttaatatccccagaggcccacagaattgaaactgaccctagagggtacttgtcagttatgaaaacacacacatctgtgagttccaggtgctgtaggagcacaaactaagtaaacatctaaaccttcagatataatccccgctcctcgaaacatcctgacactgtggtgaagcgattctcctagaatgtaaagtcattataatgtgcttacgttcaggaagtttcctgagttgttgaaagagtaccagaacaaagacactgactctaacagatgtgggtggggcatgagtggccttcaaagtgcctgtgagtgggaagagactgtcctcagcctgccccaggggatgtgaacagggagggagggagctcctgaccaagagggaaattccagccacagcacagttcatggggagcaaggaacagtatccagcttcataaagcaagaccctgtctcacaccggaaaacaggctcagaagttacccagctgtttcactcaggcacctggggttcttgactattcacagaaaccagaacacccgcatctgcttcatgtgatgagggagcttttttgagtcttattacagggagagaaagtgaga

SEQ ID NO: 94284 - DNA, 1046 bp, Homo sapiens
ttcattcctttttgttgtatttttggtgagtttttttcaagatgagaaactctttatcaggaaacatttgtttaaagccagttacatgattatatatattttcttagccttgtatgtgtcacccagttatgagcttcttgaaaataagtttccacttctcccccggtgcctaaaataaggacttgtacaaagcgtgtgctcatatttttttcttaacaccagattaggaagcaacaaatttgtatagatcatttgacagtatgttcggcctgttgtgtggtttgggcagatttttgggtctctctgggaccatggcttactcctttggaggatgctaaaatctctttatcttgtctccttcacattattgagaactgcaagcaaactctttttagcatagttaggaattcaggaaataaattgatttgtattctgtatttcaagattctctacttccttttttaaaaattatttttgttaccattctaatagacataggaagaatcgtgagacagccagtgaacttttgatgaggttgaaggacaacagggatctacagaaattcctgcaagattgtcaagaggtatgttactctttaatccctctattcctgtgttccagtaatagcaattgccagccagcatttagcacaagagccttttgaattataaaattaatgaaaccagaaatccatagcacccatttgactcgcaggcagggatacgtggcacttcatcagttctccagcctacaaggtacagcttaattagatcattataatctagactattatattaatagtatagtactgcactgttcattacagtagacaccagccacaatgtctttatggttggttggctatttcattttaaattaactataattacataaaactaagagcgtggttcttccatcactagctgtattttaagtgctcagtagccaactttgactagtggctaccatgttggacaacacagatatagaacatttctgtcgtcaaaggaagttgtattggatattgatgtcctagaatattgtgc

SEQ ID NO: 94285 - DNA, 1740 bp, Homo sapiens
ttagcattcagtattccgttgccccagttgagactatttcagcatgtaacatttattgcttaattcccatgaaacccttgtaatgtacacaacctaggggtcgttgttgattttattgagcagtaacttcatgtggaaagactgtgtgtattgagtgaatggttaaatcacagatcaaatgtcctaggtttgtttttcacagtgacattttttctgtagcaaacttgtttatttacaaccatgttggttttgttttccaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacaggcaagtggacaagccatcatggacttgggtgtatttctgttttacagccatagtccttagagtcttttctcacccactgcattatcaggagtccaccttccatgggaaggcatttttaacccaaaatattacttgctctaacagcatcgtagaacatttccagaatagaaagacacttgtccaaactagaaagacacagtattaggagtattgggtgttggctgtctgtgtatgggattgataattttcttagttaatgggtattatcaccgtttaacagttaaataaatgttcatctcattcaattctgcattttacacgaaagaaatattctcatactttgttgtttaacatcgtgatttgtgacagttatctgagttgttcaaggcactttataggtaataaaaataactgtttatattatatcaccgtagagggctttaagggcaaatgaatttacctcagatttacttgaaaacagttccattgatgttgaaaagcaagtcagtggcaaaatgtttgagtggctcccatggctggctttgcggtgtggccaagtcccaggcccagcagttctgcttagagccagtcactgcaaaagatagtctgtgctgagcgctgaggctgcttctctgccctcagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcgtgagtcgacccctactgcacacatggcttttccacgagcccccttgcctgtgctaaagcccacattctcacttctcagtcatcctcaccttgggccacgttggcaagctgagctgccaaagtccacgctctggatggtctaaagtttctttcccttttcaccctaaatgtaactccattggtcctctcacgttatctagggatactgtaggattttaatggccctaaaacagactttttaaaagtaatgaggactcacagtgagtttgaccttgaggatgaggtagagttggaaagactctccctagccctgtctcggagaacaagggcgtgcttccccagacagccc

SEQ ID NO: 94286 - DNA, 1812 bp, Homo sapiens
cccagttgtgggttggagagaggatgcctttggcaacttccacggatcatggccacaacctccagactgtgcagctgttaataaagaaaaatcaggtaagcctttctgctcgagctagttctgtctgataaataattgctctaaattatgagactgggaatggcagagagctttgaagccttgctatttctttctggccctaacagcttgacataagcagcagacggctgccatttagcaagcctttgtgtgtattttccgctccctccagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggtgagaggaggcgggaagcatccctgtcccaggagagcctcagattcaaaccctgggcacactttctgctggcggctctgtctgtataaaaacttcccttgtagcctttgagtgttaaggggacaccatgtgcatgaaggtgtctgaaatccagctgctggtttccctttggtgcagcattttcttatctgaatcctagtgtgccattaagaacaggttcatcctttcatctttgaaatatgccagagtccttcctgctgtctatttataggttccctaaactttacaaaatacaggatggcttggagacaatttgaaagtattgcaaggttccaggaatgctgccatttacatacttgagggaccttgaggaattccagcgaaccaggcacacttggtctgcccaagcttttctctgagaggggccctgctcattctgcgttctccttgtgtttatcttctgcacaggcttctgtggtccagtccatatggaagctcttggaacacttctgtgttccactgtccgtactgcacctctggagtttttctttctactgatccttcctcctaccctgctgagcagctggtctgtcactccttaaggggtagggccagaggggaccgctatggttgtgatgttctcctgtctttgcaggatgagcagagtgctgtctccatgttgaagaagcaccagatcttagaacaagctgtggaggactatgcagagaccgtgcatcagctctccaagaccagccgggccctggtggccgacagccatcctgaaaggtgagcgctgcttcatgagtgtgagacccggctctcgattcctctcagttagggtctcttgctaacccccaccaaaagaaaatgtcagcattcatcatgacttgctggtaaggcaaatctttgagaagcatttttaaaacagacccatcatttaaaacatcctatcatgattaggatgggtgaactgttatattaggaaattgctcttgtgggttaaatatctcccgttggccaaggctctcctgaaagaatattggtgtcgtgagtcaaaagtacaggttgactaggctgggcagtcaacgtaaagtggcttacacttgtaatcccagcactttaccaagccaaggtgggaggattgcttgagcccagggggccaaagaccaatctcggcaatgtggcgaaacctcatctctacaaaaaatacaaaaaatcagctgggtgtggtggcacacgtctgtactactcagctattc

SEQ ID NO: 94287 - DNA, 2801 bp, Homo sapiens
gtccctctggcagcatggtaccagagaatgcaagaccactctggattttgcattaacttattttctcttttgtcaccttcctgactgggaagattttgcattaacttttaacatcaaaggaaatcctgatttgcagagccagaggtgcagagagaattttcccctttccccgctaaattctcctgcccccactattcactgcagcagaatgaggcactacccatccctagtgtaatagtagggataggtgaatgtagtttacatattggctcttttgtttacatattggctcttcacgacttcaaattgtggccaatttcagaattttatttttcatgctaagtgggttaaccagagtttcctttgagaaatatgatgtaatatgctctcccattatctccacctcatttgtttttcccctgaagaaacttgacatttaagatcctttttctccccattgctccttttctttttcagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacggcaagtacttgaggcagtgcatgagttggttgtgcagtaagcgatggtgtggaaggccatttgcattccttgtctgtgagcagataaaatgccctggactccaatcagaggtcttggggtttagttttaaggtggtgtttcttttataagctggtgactcgcatttaggttggctaacctctctgtgcaccccttcctccggtagtaaaaggaggtggaggtagtgcctcactctgctgcagtgagcaagaaaggaaacccagttgctaagaggttctcgagctaagatctattgttctgaagtcatgagtattattggctacatcttgcttagaggcagtttctttccaaagggtattcatgtgatcaagaaatacagagttcacagtgggctctctgatttccttacccatccccgtttcagatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgggtatggcagccacccaggggtgctggggaggctttttctccatagaacatctttgggcatctgtaagtatctccctgttccttggctcttcaaaagaattgccccaattaagcacatacatgtacccactttgtaatagtgctccatttgggagaacttatcagtccataaaggtctacgtttgccacatttgtgaacattagatgagtgcccccatgattaaaataaataaaccagatgcatacacagatgtttgcaagttataggcctcagcaagtgtttttattatgttagcatatccatccagaacaatttccaaaataatattttactatttttcatcaaccaggttctaagttgtatgtctggaaaaagaaaaaaacaggattctgacattttatcatgcctcgtccccagtatgaaatgactggcactaagactttgtttaaaagatgtttgacaaagtagtaacaatataacagaatctagtgtaatcactctctagtttcctttctgatctctgcacagtttcttgtttagtcttatgccttttagttgaaaaacaaattgtattttttttcttctaagtttcatggccctagagaagaagccaattttattaaagatgttatccctgattatgtcaagggttcttgttgttaagagtatattgagtatctaagttatctcagctttttctgttaaaggccaaatagtgtttttcgctttatgagatacatactctgttgcagctctgccctctgtcattgtagaataaagcagccatagacagtgagaagatgaatgagcgtagctgtgttccaataaatctttatttacagaaacaggccacccagatatggccttgggctgacccagtctagtgcctcagcctctaaatagctttggtatactttgggatttgttctatgaagggaccaccttgatagttgttctctctcacttccccttaattcttaattcctgtcactatgatggcaagtttaatttacctctctaagctttggttccctaatagtttaaggattgaggtgcaaaacatatgacatagtgagatctctagaaatgttttctaattattattatataacaaaagtttagggaaacatgggatatctagagatagaattagaaaacaccttgacaacataggtctttcctctgcacctctaaaatcatttacttttagaactgcaagacacttgagagacagtggagttgctctctcattttttcattaaatcccttcacctcattagacttagagatgaggaagccaaagaagggtctcggaa

SEQ ID NO: 94288 - DNA, 1149 bp, Homo sapiens
gtcattttcaaaatgtgctcttcatggcagtttcccattcatcataaaaacatttatctttaccccgagatagcagattaggtatttattttttggactgtatctgaatatgtcccactcagatatcccaggctgcctccaggggactttccctgactaaactctcctgcctgtcttcctgtagcatttcatttgttttatcattcataaagaacttaataatgtagttgaacagatttatagaaaacgggtttttgtgacttggatctccccagtgaaattgagggctccttaaggggcatgggccatattttgactctgtgctccctttagtgtatgagcagaacagaatagggcttggggtgatggtgggaaggccgccatgggctgacctggctcatcccctacatggcttcacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaaggtaacgctttcagcccaaaggaaattggacttattggcgcttggttaaaacacaggagtcttccagagagaagcaggagccttgaaagcgttcctgcctgagcgcttcaaggccagagtgggggtggggcggtgcttggagtgcggcaccactgcttgcctcgtgcacttggctcgtgcacaccatcaccagggaatgtgggagcctggggttatcaaagcctgtcccattctccctactcctggctcccttgacccacagtcactcaggccctcttgcccacatatgtgcttgaagtaggaccttgggcttcaagtagccacgtaccttggacatgactaactgccccgtctttgcaatgagatgacttttctgagttatttttctgtgcctgctttttggattaaagaccactctatccctttccatgcacattactaaaggtgtcaccctcaacatctgctttaatatggtgtccttgggt

SEQ ID NO: 94289 - DNA, 1783 bp, Homo sapiens
attgcggcacctcttgctgcttctctactttctagaagagagtctttctgacttgcatttcaaagtaaaagtttgaacagaaaaccattgctttttctggcacccacctagcaaccattttgaattattcaggcacacacacaaaaacaaaagcagccatattctacagtttggttacctggctggtactgaactgtgctgtcactgtgctttggctccagtggcccagcctaagctcagggagtgattcagacctgaaagaccatcagtttctttcaaggccatcagtttctttcaaattaattgtgtgttttaaaacctacacattttttgaaaagcttgatctcctaacggaggcatcgtttgtctaattttagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggaggtaggttgctactttgctttggagctgcagctggcgtcaagatgtaaaatgactttgttttatatgtttgtgtgtgtcagagatactgtgtttacattcttatacacacacacatatgttttaaaactcctttcctgtgcgtctagaataatgcaattatgcaagactctaggcccaggctggtaaatctctggcacagaagacaatttttgagggctacaaaatggactccgcatcctccccaatcagtactctttctaggtgacgccaatgtccattgactatgccctagatcagtttgctgttgagtgcatggttggtgattctggttaggatggtggtaataaagaggtaaattattaggtgcgtgtgtggccccctgcatgggaatgggcatcctctccaagaggtcagggctttgtccgtcttgctgtccctctcctgaacgtgtttgccgcagggagcctcctcacgacaaaacagctttggcagggcttccgcgccttcctccagccccttctggaaggagcagtgctatgcttttctttcctctcccagtcctcagacagactgagcagtccttagatatctcccagcttaatggtggtctttgcagaaaatgtatttttctagtataaaatgaccccatcaagaggatgtggtgcattccattaagatgtcccggggatcctctttttcatacagatcaaggaaaaattactgcagttgacggaaaagaggaaagaaatgatcgacaagtgggaagaccgatgggaatggttaagactgagtaaggatgtagtttatctttctgctcttttgggtatcaatggaaaacatgcacgtttattttcttgctttaattcattaatgttatcatttaaagattgttcgagttgtagatgcctttttagtgccccgtttcaccatttcatggtaaatactacttttaagaagcttcctatggcgtagtcatttttcacctcttgattgatctcagtgtcataggtgggatttggatgttctttagggatgacagagggcacctccctgggagaatacagatagaagccctctcccccatttgtcttcaagaattcttactacagaatcaagttggaaagttgatctcattaagtcatatttggtgctcttagtggaatgttgataacataataaaaactaacatctattaaaattttgctgtgaatgaggcattgttctaagtggttttttaatgtatttctgtgtttattccccaaagtga

SEQ ID NO: 94290 - DNA, 3089 bp, Homo sapiens
gtagacctgcgctgagcagtatgatagctgctttcccacgtgtggctcttgagaacttgaaatgtctcaaattgagatgggcagtgaatgtgtgccgtaaaatgcacatcagatttagatttagaagaaaaaagattgtaacagatctcaatagtttttttcatattgattacatgttgtaataattttatacatattatgtgaaatacactattaaagttaatttcacctatttatttttactctttttaatgtggctactggaaaagtcaaagttgcaagtgtggctcacattacatttacattggacagggctaatttagagtagacgatagactggttatgcaggtagccatcaccagagggcagcagtgccaagaggtaaggccatatgactgcccggcacctcctggtcaacgtgtactaactcatggtaccctgtgcagttctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacagtaagtggccgctgggccctttgtctgttggtgccctgggcagccttttcttcctgcttgcctcttagaccagggaattcacacgattgcttgtttttgttttttgggtttttttcaagtagtgaagatcatcttaaaatgggtggctcctgtggagcaggacctagggagagggtcaggactgttacctcctcagtcacatcctgggcacctggatttatgatcccttatagtagcttcctgcctgggggttgattggtggtgtttgcttttttcttcgaatctttcattctcccctatctcataaaagctttgttctcaagggggcatggcctcaaaattttcttcagaatttcagaattagaattcccatcaaatggaagcttaatcctagcctgttgttaagtccccagtcctgatcccctcttctgtcaacataaaggccttagaataggatttgtgcactggtgtttcctctcccaagacttttgcattcctggtagaaagctgatcctttgcagtgtacaaaaatggtgtttctggtttccagttctgggtgtttaaaatgtacctgcatacatttgtgttaaaacagagtacttctggtacatccatatgactcatgaaatggctttgtttcagttagactattctgtggctttttaatgtgttgtttgggttttggctgaacacagatccccaccacagcacaagcggcttccttgagaattattgcagctctgtccctggtgtttgtctgagctctcctggggagtccagcatgaaccctcaggctcaggtacttttctcctcagcagagttgagagttgcatagttactttagaaattaaacccaagctcccaggggtcctacaaacaactcacaggaattttgccagcccatggaatagactatttcctgtagttttaggttgtagctgcagttcctgtgaacctaattccatttggctcaggatgttagagcttcttgtccagtgtggtccagtttagcaaactagacaggaggacttcctgggttcctagaacctttttctgaaaagaggcagagtttgggactctaccaaacatcactctattttctcttagttggagttactggaagtgcgcagacagcaagaggaagaggagaggaagaggcggccgccttctcccgagccgagcacgaaggtttcagaggaagccgagtcccagcagcagtggtgagtcccagcagctccagaggctggacccttagcctcggtggccaatgaggtttatggggcatctttctgaagccttgcattgctaggcctaaccacatgccctgcctactgattgcttccatagactgtttaaaggctgtacagttatccctaaataaccttggagggcactgatttgtccacagtcacataggtatgtaggtggcagaagtagaatgtagacagtgccctttctcatcctgtgtgcacacacacaggatgctcagaacttccatatgattaaatgcatggagtgaactgcccagattttaggccagtgattttgtggtgatgcgttttttgagagttctaagtaacttcacacagagggcagcaattattctctacttccaaagggctaattattttgctatggtaagagttccatggcaacctctaatgctgcctttatgtggtggagcggggcatagggcattcctgtagtcgtatttttctgtctagagtctatttaaaacacttggaagtttcagatttaaaaagaattaaattatgtgaaaaggttgcacgtaataaaattgagtgatgatgttctcccaccctttcttactgtttcctctttctcctcttcttcctttcccttcctccttttcccctcttccctaacagggatacttcaaaaggagaacaagtttcccaaaacggtttgccagctgaacagggatctccacgggttagttaccgctctcaaacctaccaaaactacaaaaactttaatagcagacggacagccagtgaccagccatggtctggactgtgaagttcactaccatttgtcaagaatcaccctttccaaatcctctgggttttgactttttggcttccacttcacccaaaatgttaaaatttttacttaattcatagccttccttggtttcatatttgtttgcatttaattcatgtttgagtctcttaactgatggatgcccacttgccttaaagcagcatacttattttttgtttatttattgtgagctttttactttattaagattttacagcgaaacccttacatgagtaattgaaatgaaattaaatgagattacagcataatgaagaagaaaactagaatctaacaggtatgacacattcagttattctaacagggcacagtactgtgctatatgtagccgcctttacagatgttattaacctatagtagttta

SEQ ID NO: 94291 - DNA, 3062 bp, Homo sapiens
tgtcacgttgcattcatgttcacctcctgatttaagtatctcgggtgtgcccagccactaaagcactctggactaatcgctaaagagaagcaacgtggggggtggggttgcgagggatgtgttcacatgtacccatcatttgatcatagcactgtgattgcttttgatgtgtgtctctagtggtgtgctgtctgttggcatgcttaaagcacatgtccattaaaattcattttgttccttttattttccttgttttcttggttagtgattcatttgcataaacattaatgatctctgcatactggtttggggttttctctttccttctaactctaaagaaaaaatttttgctgcagaattatcctcagaagaggcttccctggccttcatctaccttgcagtctgaccaagtatgataaattttagccgttttcaaggaaacatctctctacccaggtcattgctgtcactagcagctttcaagtcaaacctgcagcactaaatttttttttatcctggtttctctacatactaaccccatgtctctctggactcacacctggctcaggccttccagaccaaactcatacttcctcctcaccagaagtttccgaatctcacactagagaagatttgtcacctttaaagtccactcacattattttgactcagggttttgttttttgtctatttcccctcctgcaactctcctttaaaagtgaaaagagagagaatggtttaagtagtctgttgctcataagcacgtgtctgcagtctgtcacttgcaaggccttggtgatcaccatgcagcacttgtgcgcacacacacccccacaagtcttttttcctaataatccattttccacattgccatgagggtaaagggttccaatcaaaaccaccattaaactgcatagtttctagtcttccctcagccctgatgctaattatgatagtttgcatagacataacttaaacttgtgattctccctccttccagagctttttgtagccctttttccccccaaaattagttttgttcaaaatcaagcattgggcccagccattaagataagacctaataagtgagagatacagttcccaagagtttacagatccaggtgttcacatggtggtggccagtctaccgtttatcttgtcaaggttgttactgctaatttggtgtcactttggtcttgggcagcagtggtgggcgacgtatctaatgagcgtgccattgacttctccatgtttgtctgtgtacgaggggtgcaggttgtctgtaatccactaaagtgtcagccacacccagctttagtaactcgctaatcgcacaccctgggtgtatcagccaggggctgctacagttaatggtacacagttgatggtacacaggctgaaaatgataatgaatcaagaccctactacatttccaaagccgaaaagccatgagggttacaatttaaatgagcttgggaaggaacgctcccgaagacgtctccagcctgaagggtcagagccgctggaagcctggctgtctctgggctttctcgtctcagtgcagcaaggcaccgtgatcaaccaacccgtgatggggaaggccctggttctgtctttgtttgggggtaaatagctgtgtggtgttgagtgactgtgattggcttttccagctcctttaacacaaactacaacccactcacgatacaacttcggcagatgtggtcaaattgatgtttgttgacttgcctcatttccttccagctcttaagttccaaagtctaactgggatggtagatgtgaaatgcatgattgtcgtcctaatttctgcatgtgtttatgacaatgtgttgaggggagggggaggagagccagagagcattttcaggaaccgaggtctttccttgtcttactctgggggaatgccatgtagctctgatagagttgtctatcggtctgtttgtgaatgccctttcgcttaaacttccagcccttctggtggcatccttggttgtaaggtggctgctgtataacgtccactctctttcatatttaatatgtgtgattgttactgttgtctttttgttttaaagtaaccataagaggagatgatctgagttatatttattgatcagaggaatagagtgcagtaaaactcatactggcatttcgcttttctcatttccctgtaaatgggcgggtattaatccattcccaccttctaatgtccttgatgtccagctggctttgtgggtgtgcaatggttttactgtactgcctcgatctgtgccaggcatttatacacagccacatgtgcgagtcaggtagagcgtatgtggtcacccccatggctcacggagttagctgaatggcctctccgctgtccctagatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtaacagcagcagaggctgccacagtaagatgggaagtcagcctgtgaagggataaggcgggccactcttgaattggaagagaagtatgtgctcatgtagttttattcctttggtagcttcctggacattgcattcttcttgggctgacgctggaaagcaggagtagaatgctggttattcactgagagaagaagagttgagtttggatgggagtagctagaaggggctttagtagttcatctagagaaggaatttgctagattgagactgaagagtcttctttactttaagtgattgatttcatttaggactccttgtgggttttttgtaaaaagccattaaccatttcccctgccctgatctccatatcagcctttatatatattcattgtctctcaacagccccaatttttttatttaacagatggggaacag

SEQ ID NO: 94292 - DNA, 2181 bp, Homo sapiens
ccagctgtttaatgggtgtgtacctcacctcaaggaaagagagagtccattgatggaaaaacaacacctgtaatgctttaaatgtgaaaaagcaccttctagggtgggatctgaccacctcacagattgagactggtcttccagctgttacaagtttgtagggccacatactagggtgatgagtagaactgaattctcatgagaagctgaaccaggttccctctcctgtactgataaggcagaggtgcatttggggacagtgcccagaagtgactctgcttacccctcagttggccagatgcgccattcccaagccttggagccagaacccctcatgcctactcttagttgagtctcacctgtgtcccttcctctgtccaggaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatctagcacggtgactagttgttgttcttcctctgctgcgtgtgcatgcccagtagggaaactgcaaagggagaaatgacaaacaagaaacattttacaaccagtctgggctcacttttgcattttttatgcatgtctggtgcacaagctttgaaaactacagcaaacagtaataaatgtgactgttttgtagttatacattcaggctttatcttttatttatgaaaaagttaccagagcacttgtgaaacctgaactctgagataggggttggcaaatttgttctgtaaagggacagagatagtaaatattttaggctttgtaggccgtaactgtctctgttgctcaattctgctgttgcgtaatacaaaggcagccattgacggtatgtgaatgcctgggcatggctgtgttccagtaaaactatttaaggacataaatttgaatttcatataactttgacatgccatacaatatttt

SEQ ID NO: 94293 - DNA, 1032 bp, Homo sapiens
gaaaatctgttgaagtgtttataagagggaagtgaagtccagatgtctgcagagattgtaaggcagcatctgccagctctaactaaatttgtctttcctggcctagaagagttttacccaaacatacagaagtagggcttcgagggaagacccctggagaaagtgacttttgaaggctgaagagcggtttggcagggaggtggaaaaagaatggggaaggagggaaagacagggcaggaacagcttatgcagaggctcaggggcttaaaatagcagggtcccttgaagcaagaataagtagctcaatgttaccagaatgacagatgagagtgaggagggtacggtgggagatgaagctggaataagtgggctggagctagatagctaagggatttaccgctcattccacaagttatggagaccagtgagttcatttaaacaaggcaagagaaggccaatttacattttaggaagatcattgcaggagtatttcactttgtttttattaaccttttcttctgattcctttctcctcttttccttcaatgccagacttctcagaagagggagcgtggcattgtgcatggggattggggtcccatgggattgaacactgcatgggctctgtctctaaccagacatgtgactttgggcatggcagttaccttttctgggcctcggtttcctcatttataaatccctaagatccttccaaaatctcttctaagttaaagtcatgaggttcttagttgtctccatttactgcccccgttttctttatctctcattcacttttcaacatagtgaactggtttctacttccgccagccactggagttctctggagcgacttcagtgacctccattgctaggtggagccacatcgtgcttaacctcttcacagcactgggtcagctgatcaccttctcctcagtgcctatccttttctttcctcatcattgtggtcccctggttttctcttacctcccctgccctttgcctcctctccctaggcctacctgatacatacag

SEQ ID NO: 94294 - DNA, 1101 bp, Homo sapiens
cactatcaaattcaatttgttttgccaaatgtaattttatctgggttttctttcttatatgaagaagtaagtttctatctttcccttatacaaacaaaccttgacagagaatcactgcttttgtcctggaattcggaagatttcaaagatgggaggtgtacatgagatccattctctctccccattgctttgaagttgagggagcatttttttttttttttttttttttactagaaaaagaatctgggacagactgaaagatggaagttactctgtgtctgggaaatacaaacctcctgaatctagaagcatgaggcttagtatgatgaatggtgaccaataatgtttttattaatctgggaagtactgagtttggtaatcagtatctttgaggtttatgctagtgaagttaatcccaaggcatttgagaaactagatttcagcttctctgctttatggttttaattccactttattcttagtggtagtgcagccaaatgataataactctcatcattgttgagaaattgttttccatatggttatttcatctgagaatatgattttaaacagactaccaaagtcatagtactcccagtttgtggaacggacttgtttaatgttataaacttgaattttgcagttttgtgaaccaaaaaatatgataataaacaatacgctttgtttcttttttattaatgcttaactgaaaaaaaagcataaatgaaggtgcttatttttattaattggggaaataccagggattaaacaaagcttagtccttcagtgtttataatttctggtaagaaagttgaataaggtatttccccttttcagagcagcttactagttttatctgaggtatataatatgtgaatgtaattaaattatcaaatttggttgatcatttaaaaaatcacaaaggcataaaagtggacatttatgaatcacattgcaatttggtcaaaagtgattctttcactaacataaatcataaactctgtggatatagcttgactttaatttgtctgaattatgatatggaaatgtttaaaatggtcaaaaatagttgaggtacctatgctttaagtttaaaatata

SEQ ID NO: 94295 - DNA, 1035 bp, Homo sapiens
cagtgtatgaaatgttttgttttttcatggaagaaattttgacatttgtgttgttttcatacagccgatggaaaatgtctggtgtcggttggtttagacgattttcacagtattgtattttgggactggaaaaagggagaaaagatagccacaacaaggtaagaagctgccgggatcttacggtatcctgctgataccacggttcagtaaaggtcaatagttttcattttctggtaagatttcatcttcaaactcaggtgaaattgacgtagaaggcttagcacctaagtgaaaaaatactgcagtatttcatggtgccaaacctgacttagagcaggtcatgtttgttgcggtgaatcagaaaattccgaaatcctctgcagagagtcattcaccgcttcattttgagtggtctgtgtaatctgtatcaaagcacttcagcaatagaaaagcagcttttctcaggctggtgccttgccccttgtttttcttctgtcctagcatctggtgaaggattgtcaatgtcaccagaatcagaagcaccgtttgtcatgaggctgcagcatgctggaaaggaggccccaccgtgtgcatctgccacttgctttcaaagcaggcaaattgtttccctaatcttccgtcttataaatagattttttgagaccgactgctgtttatagaccacctgtcctcccttaccccagccttcctgcctgctgaatcagcactaagtctgaacacgactttccactcctacttacattgagctcagctgtttgcccaaccctgatcaggggtcaaaatagttggcagccaaggcccagcaatacaatttgttgccgaggcgtgttgtcagtgtacctccctgctcgttcttctctgcattaatgatgtcctttctgtcttgcgatataaaatcattttgaagttaatagccttgaaccccaatattcactttttaaagtaatattttcctctacaatattaaataggaaaaaagttttgtggggatttaatgaatgaagatttataaat

SEQ ID NO: 94296 - DNA, 1083 bp, Homo sapiens
gtcttttgaagctggttattgtgcttggccagggtaggtttcagtaagtgtgcctggaccccctgtgccctgggaaactgccggtgacaaatgtgaactgattcacatttatgagaagtttgttttcacttagtcatctcgagcaatttttacaacttcctgcttgttttcattgaatcatgtccatttttaagtttaatttggaactttctgatgctggtgttgagtgcttcactgttggaaacgtgacttattttagctattgttttcccttgacgcttcctcattgccattgctcacccaatgcaggtgatattacggaaaccccaggtaaggctgttccatccgtgagtagtttgaatctgcagagcaaaatcatgtcattctatcatgtttgctgattgtatcttgccgaattgcagatacaaatcattgacctcaccagtttccttcgtataaaatcctctgcaagtgtgtgtgtgttgaacataaatgtccgtagggctctgcctttaaaagcaaatttcctctagtctttctcctctggccaggtcaggctataggtctcttatgcccaatgactgtaacagccctaaacatttgtcttaaaaaaggcttttgcaggccgggcggcagtggctcacatttgtaatcccagcactttgggaggcgggcggatcacctgaggtcaggagtttgagaccagcctggccaacatggtgaaatgctgtctctgctgaaaatacaaaaattagctgggtgtggtggtgcgtgcctgtaatcccagctactcgggaggctgaggcacgaggatcgtgtgaacccaggacgtggaggttgcggtgagctgagctggtgccactgcactctggcctgggcaacagagcaagactctgtctaaaaaaaaaaaaaaaaaggcttttacatgaacataagcatcgccttggctctgccatttgtcagccttacttctttgtcatgcctctccacactcagggacaacaccttccatccacatatgggacgccatgaccaaacacaccctctccatgctgcggtgcttccactccaagggggtgaatt

SEQ ID NO: 94297 - DNA, 1030 bp, Homo sapiens
tttgagtgtttagcacagaaccagggatcacagcatgctcccatgcctacaaaggcctgcaagccctgcacggttaaggccacttcttttttatattaaaacaagtctgtatcccctgcattggggtgaccaattcatttacgtcttttactcctagcttgttcacaattgggttggtgctgctttgaaggggtgttagcacttcacagggagctgctggcggtactatctcaagggctataagtgccagaagtagccagcacagcaggctggagatgggggctcccaggcaggccatgagaaatacacagtgcttttgagtgggaagtgggttgagattctttataggtgcctttcttacaacctaactcagaccaccaggaagtatcagaaggcctgtatttcatctttatcccctcaggagttttgcttgggctgaatagaacccagtattcatgctacaatgaagctcatcagaaatggggaagctgagtgagttagaatgacctagacctgttcctctatactctatttagagtaaataaagaaattcccaacactggtgatcaactgggagttcttaaaaggacatatagatgaatttgcattctaacctcctgattatgcacaaaagcccatgggctgccaagagcttctactcaaatcagccatctcgggtgtcatccacctgtccctttcccccagcagtgcccagagtagctatcacatgcccatgccatcccaggacagctccagtcacaaccattgggttgacagtcaccaaagagtaaatgccttatcttggaaagtacttgccttcatgaggactcatggaatttcctgtttattagccccacatcagccctcctcatgcccctgggagaggctgacccacgggatgcctgagatggggagggagagctggccaggcctgtggagtaagaactgggtcagctacgttagtacctgcagtcgtctcctccagtgctgaccacatacttgtcatcataagagaaacggatgttcgtca

SEQ ID NO: 94298 - DNA, 3731 bp, Homo sapiens
ctaaataatcactgtagctggtggcatcatgtttgttacctactaagtaggtcaaagtgattgccagacatacacatgaaggccttgaattagaaagcaaaggaactgatgatgaccaatgtttaacaaaattcagactgactttgtgcctgatccttcaaaggctagaggtgatatttttggtacctgaaacgtaatttccctgataagtactctttgcccaattattgcttatcagctgagatattaatgtctgaattattcagctcatatatcttcaagcactcaactagttcatactttgaaatcaattctaatagacaattctcataacacctttatagtcttcccatttaaaaggtaaatgttgttagggctggaggggtaagatgcacccttggtatattgtctgatctcagcagaatcaactacttggtagtgtagtccagagaaaatgggtcaaatctattaattattttaggattttgaaattcataattgagactcgtgacttaatagtgaactgctcatggtactttacccagtcttcaagttgtatgccttttgtaggtaggcatttagatgggatgcttttgaaagcataattaagaaactttacttgaattttgtttataatgggctaatgttattttcttatagtttgcagtgttgatgtgggtatttacctatgttggtgccttgtttaatggtctgacactactgattttgggtaagtctacaaagccattgggatgaaaaattgctggaaagattgtgtgccaggagcttagacattttagtggagaatattctcattgtatgaaaagtaggggatgaaaatgtgggccgggcgcggtagctcatgcctgtaatcccagcactttgggaggccaaggtgggcggatcacctggggccaggagttcgagaccagcctggctaacatggtgaaaccccatttctactaaaaatagaaaaaattagctgggcgtggtggcgcacgcctgtaatcccagctactccggaggctgaggcaggagaatcacttgagcccaagaggcagaggttgcagtgagcggagatcgtgccattgcactccaggttgggcaacaagagtgaaactccatctcaaaataagtttgaggttgtattctctttaaataagttggtgatactgcttcccggtttattgaaatgctaccttagttgctgaagacagctcctactaacaaacagtgataaaccagataaagggtggctttatatgatggtgcagtcataaatctaaccagggatacctttattttatgaaatctcactgtgatatgatttgaagctagaaatggttcctagctctaataactgcagcctcacacagttcattcattcctctggagtggctcctcaacagcagatgcatccagagatccttatgtttttattcattcattaggaacactgcttggttatcttgagttgccagtttaatagttttttgagtgtttattcctcccaaatcattccgttctttttgaaaagttgtatatttcccttttcagctctcatttcactcttcagtgttcctgttatttatgaacggcatcaggtaatttcctaactaactgctgacttcagaatagagcactcactctattacatgggatttacggatgtattagtgcccattttcaatgtcttacaaaaatgagaagtgtgatggtttcttaagcctttagcttgacacatagtagtggttaataagattctttagcaacggtaataattcctttatacctctctttcaggcacagatagatcattatctaggacttgcaaataagaatgttaaagatgctatggctaagtaagtatttaaaatctgcagtgtttttactaggataaggtgtgctggattgtgagaacagtattttcatattgcaggcataatgagtaacaaatctctatcagaccttaagtgtgacttcagagttgccaaaagattgtttttctaacatttggaccattcgtttctgggtttattatgtgtttaaggctttgtttaaatctaattcatgaggccaaggtggcaaaattatagcttagaattaggcagctttaaggatttcatttattgtattagctgaataacatacaagtagttcttggaagatggtattttaagcagcagcaaacaaaactgatatttacattgactttttcattttcagaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaatatgctttggtattttcatttcatgaaattgcagcagattaaaaatgcacacagtgggtaaactgcttcaaccagcgaatggtagcttgtgcttttagaagggtttttttcagctgatggtgcagctgtttgtttgtttactgtggaaacaaaagtcaacaaatgtgtttacataatcaaattttatttgacacataaaatgtttaagtgatgtgttttatactttgaaaataaattcatgcaccaatgttttaactcacatatatcatacagtgcaggatttatgaacatacataaaatcaaaatcataccatataaacgtttacaaataagtttttcatgacacacggacactattgctctttaaatatggttgtacatgtcatcattaatcgattcattgttcttccacatggttatttcaatgcaagatccgatcagcatgaagagtctagtacaagataggcagacatggttatcactctgcatcaccag

SEQ ID NO: 94299 - DNA, 1415 bp, Homo sapiens
ccaccatgcccagcctacaattatgactatttccatgtgaaaccatcttcctcagaaattgaaattttagagccgctcttgctagcatgtgaaaccttttccttgcttattgccttttggcgggggcagtgaaggaggagcctggcctttcaaaatgtgatcaaaaaaataaccaaactccagggctcattagtccttttataaacaccggtgtgaaatgatgggtatccgtgtgcctggtccaagtttcctggtggttgacttgggcgaataaaaataagacatgttctgcagagttctccttttaaattcttgtgtaatattccgtttgttttgctcctttgcaattaactacaaacttctaagtcctagaaaagatttcaagtatttatagagtgagcaacgatcattttcctagtcaaatagtatggcaaaaatcactgttttaaaaagttgtggcattaaactataaatcctccctcccctcgcttcccacccgcaattatgaaagaaaagcatatgacaatgcctactgggctcagcttttgggctaattgagtctgactgagccttcttagcaggttcctgtcttttgaaacctcaaatcccaaaaagctgtctaataattttacttttttagggactaagaccaggtattttcagcagaggttcttacttttctgtaattgaggcgcaactataatgttccagaacacaatcttaaatctgaaagtgagaggaagaaaaaaaaaaaaacggcctgagctccagaaatagctgacccagaagaacactaaaatctagctctcaggctcataggcagctgttaacattcacattttgacagcttcctttcaggtttcttgagctctcagaaaaattagaaggaagtgggctggggatatagagagagtccaaactaccaactaatgaatgaatctgaaggagacacagaagggcaagtagagtttagagtttgagagtgcaggaaagttttgaaatggtcagaactgccagagtaatttctgagatcttactaagcactctcccaccgtttgccttaaagataccccttcccccaaattgaaacatcacaaatctgcagagctctttaatcaggtgtgttatacacagtgaatttaattctcttattgccctggaagaaagataaaccagatgtggcccttgccccttttcagtaagtatttgttagatcttcattacattttaggcctccttcctccagtctcgatactgtgcaatggagagataagctttgacctcttcagttaataagtattggctataatgttgcaaagtatttgccatggaatcgtgtagaatttgttaagtccaaaatgagagcagcctgtttgcttctttaaagtgtttattgaccttattcctgccatgtt

SEQ ID NO: 94300 - DNA, 1109 bp, Homo sapiens
ctttgttaggaaaacgtgatgagacaacatagtgtcaactttaagaaaaaaaaaaaaacaaccatagtcataactaccatttactgagtgcatccttgtgctcagttgcattaggcacttttctcactgaattctcatgataatctccactttataaatgaggaaactaagtttagagggaagaataaataactttgcaaaattacctagccaggtaagtggcagagcatcagattcaagcccagatcagtctggcttcaaagtgtatgctttttctgtgctagtcagcagacagtgcatatcaaggaaataccccttactgctgagtttttatattgcccctaatttggaaacagttggcttttatagtagaatattttcttaatttcttacagatatataatttctgattgacatttaggggaaaatcactccaattagtgacaattatgatgtgttttgttttctagggcatatctggaatctgaagttgctatatctgaggagttggttcagaagtacagtaattctgctcttggtcatgtgaactgcacgataaaggaactcaggcgcctcttcttagttgatgatttagttgattctctgaaggtaagtttattttgcctttcatttttgatatacccagaatttagtatcaagagagttgagtgtaaaattctgttcttctatattcaagtaaatgataaatattaattaaatcacatggctgtaaacttgtgttttaaaattcagaatccaatcaaataaggatgaagaagtgctattccctttttttttctggtcatacttaatacagagagtcctgtattcctttttaaaggagaataagttataaatcatacttgtgggccgggtgtggtggctcacacctgtaatcctagcactttgggaggccgaggcgggtggattacctgaggtcaggagtttgagactagcctggccaacatggagaaaccccgtctctactaaaaatacaaaattagccaggcgtggtggtgcatgcctgtaatcccagctactcaggaagctgaggcacaggagaatcgcttgaacccgggaggcagaggtttcggtgagctgaggtcacg

SEQ ID NO: 94301 - DNA, 1346 bp, Homo sapiens
tccacctgcctcagcctcccacagtgctgggattacaggcatgaaccaccgcacccagcccccaagattattttaagtaactccttgttttggattagaagtcttctaggctttggagacatttaatcattgtgtatggctagaatgatttggttatgcagaaataaatttgaataaaaaacatttcgtggtcaaaaataaaggtgttatactaatatacaactaagagtgggtttaaaatgtgggttataaagttagtgtttctttaacttagtgtttctttaaatttttaggtttgattttactttatgtagtagcgtttttgttttcatagatggagcaaatccaaattgataaaataacattctaatttcagatttctttttcaatttttagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcaggtgagatgtctggaaaacaaggcatgcattggcaatagtgtaaacaggattggtattaagacttcatctactgtctatagagttacaagcatgcatttttttgttaaagataattgcagttatttgcttgagctataccaaaaacatctgcttttgagattttctaaaagtcgttttaaaggctcatgatggaggagactgtttatgtatcattaaactaactctgctacttgttaggaatatttattagagttaagcattggttatcttacttgaatgagtgttgtatctttttaacatgggtaggtttgatgaggatattctttattgctttttatgctgtctgataacgtgctttctgatatttcgtatctttctagtatgctgatgttttctgttatgcttttctttatgtattttctttatctagtttcttctcgtttcttaaggctttactttttaattattttttggagagctttatttcagcatctccttgtctctcaactatcatcttctacccttgttttcacaagtatactatagcattatatagttgctatggagacacaacctcagcttgagtcttctgccctcacctcatactctgcgtgtttttccccctcttttttaattgacatataattcatataccataaaactcattggtttttagtatattcacagaattctacaaccatcactattttcatcgcacaaaaagaaacttcctacttattaa

SEQ ID NO: 94302 - DNA, 1963 bp, Homo sapiens
ccacctgcctcggccttctaaagtgctgagattacaggcgtgagccaccacgcccggccatatgtttaatttcttaagtgagaatatactgtgagtctttttgtaacatgctgttttcatttatcattatggacatgtttctgtgataatgtagatctgtatcacttttttttaatggctacacatttctcttgcataaatataccctgattttatttaattagattcacatagtttttaaaagtcatttttcaacaacttaattatagttctctactgtgggaaagtacttatcaaatatattggagtaaagccctgttctcggtttttgggtctaacagtaggtgaaatattcacattaaaatttgtcccttattgattaaactatcttgttaatttcacttagcttttcttcttggcctttatgattcatcttgcatgttgtaattatctgcctacactttgcccatttgttatgcatgcacacgtataacattttgaagcactttaatcagctaagccttcaatttggcatcatacaatggagaatatgagtttttatccataggaatcctgggttcagatccatgttctgccacttattaatgatgtgatctgggtctagtcatgtaggagctgggtttcactctttcaagcctacctttcattaggtttgtttgtttgtttaagagatgaggggtctctgtgtttcccagcctggtctcaaactcctggcctcccacctcggcctcccaaagtgctggaattacaggcataacccactttgcatagtggctcattaggttttaataattgaaagagataatgttgtataggctactgcagtgtttggcataaaggaggtgtggagattggagaatgtagatcagcaatcaaaacatctatcaggcttaagcgtatcatttttcaaacttttaaaaagtttctctcatacagttgccataatgatagagtttataattgcttgaaaaattgtaggaatatgaatttgttattttcctaaagttttaataatgtctggtacttaagatatttctaggaaggttcaaatcagaagactggtatgaataaaaatatttaagcttccttctccccaaaaaaatctagatctaaaaaggaaggaaatattttaaaattatattgagcacagataatgccccagtagtaaaacttcatcggtttggatccactgacagggaatttgaatgcagtactaatgtgtgtatctttgtactgactgtgggtcatgttaattccttaagggaaaagagagattagaagattaatgccctttatggacgataaaactgaaggccagagaggttggagtcgtatccaaaatcacacaattgctgagctggtacatgctaggatgtgggtctcttgaatcccagtcctgatatttccttctaccatattcatttaggtagaaattatagactaattataaataattcatatatagtcactacacctgtttaaacagtaactctgttataatattaggaagtttgattagacattaatttatgttgtacagtgcaaacctctcaaatctaaagtcattgatttcatggccaggttttactgagtagtttttaatgatggtaaaaaatagcaagtacatctgcatttactttaacttctcaccaatagtgattttgaaggttaattaatgtttctgagcagtttgagaaccacttttataaaggagcatttgttcatatgaaaaatagatttgagaggccgggcatggtagcccacgcctgtaatcccagcactttgagaggccgaggcgggcggatcatgaggtcagcagatcgagaccatccttcctaacacggtgaaaccccgtctctactaaaaaaacaaaaaatcagccgggcatggtggcgggcgcctgccccagctactcgggaggctgaggcaggagaatgccatg

SEQ ID NO: 94303 - DNA, 1646 bp, Homo sapiens
ttccaatatggatgccttgtatgtctttttcttggccagttgcactgcatagcacccccaggaccagaagtggcaagaatggatgtacttgtcttgttcctagtcttagggggaaagatttttaccatttagtttgatgttagctgtgggtttttgtagatgctctttatcaggttgataatgttccattttgttcctagtatgttaaatgttttatcttgaaagggtgttggagtttgtgagatgctttttctgcatctgttgggatgatcatgtggtttttgtccttatcctattaatatgatttattgtgttgattgattttcgtatgtttaatcaatcttgtatttctgagataaaggccacttggccatggtgtataatcttttttatatgttgctcgatccagtttgcttgtattttgttggggattattgcatctatattcataagggatatttatctgtagttttcctttcttgtgatgtctttgtctgattttggtatcaggattgaacaaacttctaagttaactaataaatctaaattaactaataattctcttgttgaccattagaagcaacagtatttttctcagaaaaacactatatttctcagaagggattttaataaagttctatacattcctcctattgagaatcatttatcctgtataaacaatctttcaaaatttttttattaaaaccaatttgaggaatctgtaagggactagaaattttgttggcaaatgtcaattaagtcagccacactgtttggtatcaactaatatttttttcattcttgcagcttcactaacaatcttttcagcttctttacggaaaaagatggaaattcttctgtactttgcacagtggggttggtggcagtgtagattgcctctcaggtgttcctattctaggatatattcatattatcttatgtgtgactatcagtgcctagttgtctcatttctcttggctgttcttccctttttgttttcctccagggctctaaagggtctgatggctccaccagagcattcctagtacttgtttcagtatgtctgtcatgatacctgctttgagctactctcatgtagctgcttacatatttttattcagtatgtgtgggcttacgtatgtaattttcagagcttttccatttattgaaaagaccgtgttcctaggaaccatatgacaagaggaaaggaagtggtaggttagggcttactatcattgagtactgctgggccttatacatgactattctggtatcattaactttgggaaaattgacttgattcaacgcagaacaccagaatcatcaacttagttatatactgctagaattttaactgttggctggatccaaatatttattaacctaacagacagggtgttctttttccaataggaaagcctactgggaaaaataacactcataagactcttcagtagtaccgaatagaaacagaatggggtgaatttttttctgattatagtcatgattcatgcttgccattagagtgggaccatttcagatggcacagaaaagagtaaagaagcaagtaaaactcattgataatcccgttatgcagagataaaaacactgcttagtagatatactttcagacttcatagttatat

SEQ ID NO: 94304 - DNA, 1031 bp, Homo sapiens
agaccttgtctcagcgacaataacaacaacaaaaagataagaaacaaagataaaagagttttctagtttaagctcttaactttgagtctttcggccgttatgagttaacttttatgtgtgatatgaagtagaagaatccaacgtcatttgttttgcagttggatatccagttgtcctagcaccatttgtttaaaagactgtttttttcttattgagttgccttggcacccttgtgaaagtcagttgaccataaatgtaatggtttatttctgggttatcagttgtattccactaatctacctgtttgtccttgtgtaactactctactgtcttgattactatatctttttaggaagttttgatatagggaggttcgagtcctccaacctttgttgtactttttcaagtttttcttgattttttggatcccttatatttccatatgaattttgcaattggcatgtcaattttcgctaaaagacagctgggattttgatagtgtttgtattttagatcaatttgaggagtgttactgtcttaatgtctttcaattcatgaacaggagtctttccaattatttaagtcatctttaatttctttcgacagtgtgttatgtatagttcatatgtcttgaaattcttttcgctgtattcctaagtatcttattttttctatgctattacaaatggaattatttaattcattttcagattgtttattgctagtgtatagaaatacaatttttgtatattgatattgtgtcctacagccttgctggactctcattcattatttctagtagctttttgtggattccttagaatttttaaaatacatacaacagaccctcatatcattgttttgttcagtgttgtttcgttataatgtgcatgaggaagagaaaaaaaaacaattccttgctggggccactgtctgtatgggatttgtatgttctccccatgtctgcatggggttttctctgggtactctgtggtttcttcccacattctaaagatgtacacattaggttc

SEQ ID NO: 94305 - DNA, 1035 bp, Homo sapiens
cttcttaaaggaacaattcagcaactgaaggaacttctgtagattcagaatttttagagtattcctgcagataaggcattctgttaatcatttattccaactttcctgttttactgacaaggaaaccaagaaaacgagagatttaaatatttgtcaggcccacacaggaccatgccacaggtccatggtggcatgaagcctttgtttttattttataatttatatttgcacttgaataaccaaagattgaaaagtatataagctaaaacggcccatgttttgatattttatttgtgcatagtctacttgtggcatgttattgaatgtcgtatacttctttcgtattgtcctcactgcaataaaaaaggcaggcagttgtctgtcacactaatcatggaagaaggtaggtgtggttagtcatttagtacaggtattgtcaaaaggttaaacctagtgggagttctctgggccaggagaataatttcttttcatctttcaggattggattacatgctgggatgtaggcagaatatctaggcagagaatagaattcttaaatttgttctccggttgtcccctaagttccctttttatgtacagccatctcagtatctgcaggagattatttccagccctccaccccgcgtccccctacaccatggataccaaaatccacagatgcccacgtctcttatataaaatggtgcagtattttcgtaaaacctacgcacatcttgttgagatcatctctgagttactttttacaatgtaggtagttgttatattgttcagggaataatgacaggaaaaaagtctgtacttgcttagttacagatgcagtcatcataggtctagctacatttttccatccacagttagttgaatccgcagatgtggaacctgcagacatagagggctgactgtattcacttggtcccatctcttgctagaatttgggctaagggatgatgtttaatttaggcaatacttttctttgcatccttggagcagtgatctgacaccacatttatactt

SEQ ID NO: 94306 - DNA, 2325 bp, Homo sapiens
tatgacaaatgacatttacatagtattcgattactggggttatatggaaaattttgattaaggtagtcaaaagatttttaggagcttaaaataggaaggaatgggtaggcctagggatttggatggggtaggagaatgatataaccactaaaaagctatagttgagacagtaaataactttctgggtagaacagaatatttaggacaggagttgaaagataagattggtgtggtcaaggaatgtagaaaatttagatgaactagattaggtttcctcatacttctctgtagatgagaatcatctagtgcttcttaaaaatgcagattccttgggtcgtgacctaccaaatcagattttgtagggcctggcaatctgcatattaagcatcctggtgtaattcatattgttgggcaaattcgggaaacagtgatctagggtttaagccttggttctggtatattttgattttggctagaataagaaacttacctttttggttttaatttcctcatttgcgtgctgcccagggttccagttgagaggttctctggttttatggaagagataccctgggccagaccgcagaagacattgagttttggatttgattgtaaaagaaataaaaaggatttggaagttttaaagtagggaatggtaaatgatagcagttggtttagggtgctgcataagatcaactgggggagaataacctatagccacaccagttaggatgactgtagttgtgcccagatttaaagtagataggcttgaatttggcctgaaataggaaggaagaagaagcggcagatttgagaaattcaaggaaggaatacttggcatttggtatagatttgcaggacaaggatgaggtgtaaagactcaaggggcaacatgaagtttgaattagagtgaaatattggcaatgacagtcctttagtattagtagaaatagagctaaaatagaaaagatgccaagttgagtttcagacgctttgaatttgaagtgatgatagaacatctcggaagctcagataaatgacaggtttaatgataaagaattgggagtcaaatgcagagtgaggcaggtgaatactatgtgaggagatttgcactgaaagaactattaagaaagaaaagcctaaaacctgcgttatggaggtctgcggctttagggaaaatgaggaggttctagagcagtaaaagaagcaggatagtgtaactgatactaaggggggaaagaattttcaagaaggaatgggcaattaaatacttagagaagctggttaatatgagtgagaaatggatgtgaatcttgttaaattttaaaagtaggtgcaacactgttctttattgttacagtactctttggatttgtcagttaatgtgccagaggtaatctttgagagaagtttctgtaggatagggaaagaaatgttcctagcattaaaactcaatataattatatctcaagacaaactagttttggaccatttctgcagcatacttccgtgtagagattcttttagggctctctgatctttacttatgataagctactttcattttttgaaagccttgaataaagctcatactgacattttggtagagagtagcaggggtcttgctgtttgaaatgccttactcgggaaggccaaaaaatgcccaacaagggaactttggcattaattaattatggggcctactgattggaacgactctcctttcagttctaaactttgttaaaaccgaatatttaggcattcattagatacattttctagatcttgggttagtagtgcagcactacataggtatgtgttatagagaatttagaaggtaagtagaagagtaaaactcacatcgcatagagaatagttttggggtatctttttaacagggtaatgtgtgttgggagggttttgtggtatattttattctgtagtctttttcctccattaagtatttattttttaaatactgtacgctattttaatgactacaatattttaattccatctagttaaatcaggttattgctaaagtttgcaagtacaggttgaacatccctaatctgaaaatctaaaagccaaaatgctccaaagtctgaaacattttgagcgctgatgtgataccacaagtagaaaattccacacataaatacttaacacaatctttgtttcatgcacagaattatgtaaaatattgcataaaattacttccagcctatgggtataacatgtagatgaaacagaatgaatttcatgtttagacttgggcctcactcccaagatacctcattacgtatatgcaagtattccaaaata

SEQ ID NO: 94307 - DNA, 1727 bp, Homo sapiens
aaaagatattaggaagattaagttgctaaagttttctgttcaaataatatgttcaataaacattagtaatttgacttttattttctgtttatctcttcataaggtgcaaaatgctgaatgttttacgtcttaatgaacttaggagcaattaaggagactcatcatttcacaagcttgaaatttaggctattaatatttgatcagtccatttttatcttattaggtaaccattaattttagagttttaaatgaaactgaaaaccagtagcataattcgaccatctgttaaaaaaagaaagaaaaaaaaactgcatatggctttaattgcatttcagatacattcagtggttagttctaagaacaacccttatttcctttcttttggtagcctgccctctccctgcaaatgcagctccatttggtatgagcaacaaggcaaatgcctaaaacaatcaacagatagaaggaaagcattaatgctggagtattagtagcctagttacagattgcactgcgtcagactgttccacacccagaagacgtcaggtgacttcagtcctgctgcagttgtgcagcagaggagactgcagacttcggttgaggaaacgggtatttcatgtctcagggagtaggtttgtgcagttacagcttttctgttggtatgcataattaataattggagctgcaaagcagatcgtgacaagagatggacggtcagaagaaaaattggaaggacaagggtatatctgctttttaatttcttattcagtttttatatgtgaccactaatatatttctatgaataagctttggaatttagatattttggattgaaagtgaaacctctgaagagttgaagtctaaaggattaaaacggctatctcacgtgtttttacatttggttgtataccagaaaatgtcatgctgttctgtttcactggcattcggtttagtcttttcagtcctgccgtttaggttctgttctctaatcttgcacattgtaaacaatatagatctaacagatttcatttgttcgtcacttggatgtggtaaatacacattgctgtttttgtgtttcacagtgacatattttccgtgactattttaaaaaaccttacttggtgtagttgaaattctgtgcaaaggtttgtaggtagcaagatattgtgtttgcagtaagcctcttctttgaaaatctgatttgaacctttaaaattattaccaactttcttttaatcagattatgtgcatcttgaaatcattcaaattacacagtataattacgcagtaattttaaatgcatgtctatatttaagtcactaacctttgtccttgtaataaccaatcagtgattttgatcccttttcctcccccttgaaagcccagatcctttcaaatctcagtggatcattgtgtaagaatttaagcctgtaaatggtaaaatgttgactagaatatttaaagaatattttattatgtagatggttaaatctacctttttttctttaaaagaaagtggtaggctgtatatctgaccacttataataaattacctttaaattattagagctatttttaagtagtccaaaatagacattctacgtaagcaatttttttcctggctacattcaagttttataattaaaaaaaattatttccttctagcaggattggcaacaatatttctaaaagtatgtagagctaattacagtaacttttacaatgtc

SEQ ID NO: 94308 - DNA, 1029 bp, Homo sapiens
tgccaaacttaaaacaagtctagttgaaaaactttgtgagaaagaactgggcaaaatgtcagttgatttccacaagctagttttccttgtacacttacaaagaccataaaaattaaagaagtagatgtcactatgtaggctgaaatgtttactaaacttcagggctcctattttgactttttaatctgtcaggggtgctattaagtatgtttaatgtttagatgagtgggtatgtcttattacacattcttgcccctctcagacttttttctttaattgttaagccaaatcaagtaccacggaagatacaagtagtcttaagtgccgagtaacttgatcacagtaaaacttttttcttctactagtgaagtaatctctgacttgaaaatagtgtttgagtactatagttgagtgttttattctaatgctcgttatttattggctttcagttttaagggacttgttattagaaagtcagtattttgtatttactaaatagtttgagattctgaatgttgcgtggagaggccagacattttcaggccatgatatggcttgctgaccgggttctcaaatatcacattatgcaggggttcagtgaataaagtttaaagttaaatattaactcgagctgagaatactgggctcttttaaaaattacttttctttatttatgtttggagttagagaggcagatagggaaataaatgtgtcattgatattcaagccacttcctttttcccctctcattttcctaattttagttctttctatgtttaagtcttacatgttttgtttttagtttttttgggtacataataggagtatatattaatatcaagccacttctgatattaaggattttgcagcccacagatagcaggttccagaaaatattatctctatttcattttagctatacagtcttaagtatgtatttttgtacataggctacgtatcttatagtattttcgcaaattgcattttaaaatattttagctgatttgttagtgccttttctgcttaggc

SEQ ID NO: 94309 - DNA, 2200 bp, Homo sapiens
tttgattattagtgaatgtgaacatgttggcagtttgtatttcttctgtgatttttgcttgttcatactctttgcccatttttaaatgtaggtgttcatttttttccctgattttatgagagttctttacatataaaggatgtaaactcttgtgttatagttttccctcagttttctaaaagatttttagtttacatttcagtggacattttcagttttcacaaaggaaaatatattttttatttacttatagttttaattttacacttagttctgatctatttaaaattgattttggattccgattagggattattttgccccacgtatttttttggtgttagagttgttttcctattcccatactctgatctagctgcctagggccaggcagcaatcttgtggaaaagccagaaagttaatgtttgccagattgccttccatgaactgggcaatcaactgtagactacgggtgttggtgccatctagtgttgcagatggaagatcaagtctgtggaatgatctataattgactatgtggaataaattcagttggacagagaaatttagcgagctgtgaatatcgttttgcactaacagatgagtttaaaatttttataaacaattttgaatattgacatcttgtaccaaatcaaacaaatgctttaatcatactactataaacattatgaaatgaccttaaagattccccccaaacctggatacttaaatgaagacattaaagtttaagaagatctgtttagggcctagtgactattaattcttgaattcagaatttaaaaatgcgtgcttgaggccaggtgcagtggctcacgtctgtaatcccagcactttgggaggctaaggcgggcagatcacgaggtcaggagatccagaccatcctggccaacatggtgaatcctcgtctctactaaaaatacaaaaattagctgggcttggtggcacgcacctgtagtcccagccacttgggaggctaggcaggagaatcacttgaacccgggaggtggaggttgcagtgagccaagatcgtgccactgcattccagcctggtgacagagcgagactctgtctccaaaaaaaaaaaaatgcttgcttcagcagcacatactaaaattggaattatacagagaagattagcatagcccctgcacaagaatgacgcatagaatttgtgaagtgtttcatatttttatataaaaaatttttaaaaatgctttgggtgtttaagaatatttgtatgttttagattataatgtaagaagttagcatattagttttcataaatagtgtcactttcagtttatgaattttagtattcatttttggtaccttatgttaaattttttatagactttaaaatgctcgttgttttgctattttaacttgtactgtcattcattttctagactaaaatctttttccagttcttaagatttaattcagtaatgttgaagtgctgtaatttagtccatagagggcattatattacagcatatggtagggttttaaaaattaactcctttcagtattgaaacatgttaatttcatacctttgtgtagctcagaatagttaaattttgaaataagcttaaaactactgtgtagctataattgtttcttattttttaaaaaacatgcctattttctgtggctggaaagtataaattattttagctctcaagagcagtgtacataagcagtctctaactttcagagtagcattttcaatccaaatgattgctgctttcccaccctctttcccttgcatctctaaatgttgtaaagaaaaacgaagcaaaacaaaaacctgagtttttcctgggtgcagaagtagaggaaagaaagaaatggaaaaggaagaatgtcttagaataagagctggctggggtggacttaacaccttgcctagtgctgcctgttctaaaatctaaaatataactttctactgtctgaaatcttgccagttagataccaccccccctacaccctcccccccccccaaaaaaaaacccaccaaaaaacatacacacagtttctgaggtcataaaagagtttcttgtttagtaggaattgatttatgcgtatttcctacttaacaggtaagtgcatgaaggaaacgagggtttggtctgagatgtgagaaaagaaaccgtgtaggtaattttacagcatattaccc

SEQ ID NO: 94310 - DNA, 1105 bp, Homo sapiens
atccattttccacatacctgatttgcataaggtgatttgcacaaggtgatttgcacatgtgctctttattagcattctgatttagctgcgttttctctaaaatagtgattatgataaatttactgaatatacttatgtatttaagtgctggtgcttcagcagtacagtccagctcatcaccattggaacagtggtagaccagttgctgtaatctaagaaagaggagattatgaacattcaggcagtgggatgagcacagagacataggacttggtgtttgacggatagggacataaaggatgaggggaagaggtaaagatgaccccaggaaccctggatttcatttctggcatgtgcacttgtatgggtggcagtatgagaaactgagatagggaacatgagagattaaagtaggtttaagagggaagatacaaatttggttttggatatgttggtattgatgtacatacctctaagatatccagtaagttatggatattatacacatgaagctcttgagagagatcttggctgtatgtgtctgtcatgggcttagagatagaaattaaagccccagataccaattaggaagaatcaagagaagaggactacttgaaggtggaagaaatggtcaaaattatcaaatactggagaggtcagttaaggattgcaagttggtcaaaaaggagggaagatattgtcatgacagcggcaaatggtgtggtgtgcatgggcatggctaggattgagaagtgaatgagacttgagtaagtggttattaaatgttgattactcttaagaagtttgagatttttattggagaaaaattaaaatattagcaagcaggaaggagagtatgcagtggaggtaggactttttttttaaggtgggaaggggaaaatctgattacaggtgctggcagaaagtcagaaggggatggggatgtgctgcctagttcaggtggaagaattagtgttagagagaaggaacgatagagctttgattgtagtgagtggaaaggaaagtatggggtattgatactgttagggttttgtgactgaaagttgagggaattatttgatggtttatgtttgttctttaaagc

SEQ ID NO: 94311 - DNA, 5470 bp, Homo sapiens
ttaactatattgtctagataaaaaagacaaccattttgttaagaattggttaactgttatttagatggagcagctgcgtaattatttggttctgctctttgaccctcaaatttcagttttatacaagctaataattcattattttagctgaagggaactttccttcattttacaaatgagaaactgtaatttaagatcacatagcaagtaatcttttaaatatgtgtacacatatatatgcactttatttaaaaatcttataagccattatgttacccctttgactggatagcccatcctacctagtgctctaggttggaggaaacccttttaaacacacatcataaatttcccgtcatcaccctcatctaggaatcctttaagtatgacttcatgcccagtatatatttatctaaaatatataagaccttgtgaagttagctctcctaattcattaagggtaatatgcttggaagacaagtccgtattcatgttagctacatttcttggatttttatctgttttgatcagccttgtctagcttgtccatccagatgaaattgtctaaatttattaggttctctctgttaaaggaatatcaccttccagtcatctctcaggctgtttcaaattgtctgatggtagaggcctttctctagtgtaaaccatggaagatctttagcttaggatctcccaactgcaggtacaagatgacattgtacaaagttaatattaccaatatagagtgtattagttagcttgggctgccgtaacaaaataccataggctgggtggctgaacagaaatttacttctcacaattctggaggctggtaagtctaagatcaaggtgctggcaaggtagatttctttttgaggcctcttctcctggcttataggtgaccaccatctcactgtgtgcacacatgacctcttgtgtgtgcctggggagacagggagcatgacagcaagctctctggtgtctcttcttgtaagggcattaatccccttggcccagggccccaccctgactgcatttaaccctaatcacctcccaaagtccccatcttcagatactatcactttaggggttggggctttaacatgagttttgtaggaaatataagcattcagttctgtaacatacagtgattaaggaaatgggctctggaattgaattgccttagtctctcacttactagttgtgtatacaaataacaagtagccctcacttaggttaattttaagcaaaaccaataatggtgtcatcctaaaggcagttaattttttttttttttgtattttggactctggcatttggacattggcacaggactaatgtcttcaaagagcaatgtacaatgactgtaacaacttagaatgtaagagaaaatgcataattctttaaaagtgtttctttaaattgaatatatgccaataacaaaagattaaacatttgtagttgttaattgtattcaaattcagctttttgtttttggcctgaatagaacaagacaatttacctatgtgaaaacctgagtgaaagcttgggatgtgatatgttaagtagaacagtattttaaagccactttgattcataagtttctttaacataaacaggttgtattgcctcttgaaaaatgataggttctatggataacatttaattagctttataatacatatgatgatttaacctgaattaatggtactactttttctgacttccttttgatcttggccctttctctgtaaagttttttgttaacttattacaaactgaaccctggcttgctcctcttatctttagtctcctttcaatctgtctttatttctgctgaggttatattctatttgtttttcagatgagaccctttttgctcttcctgctgcatctgagcctgtgatacgctcctctgcaggcaagttctttctgccagccttttatcctctctgtattctaactttaactctttagtgtgttaacactatgcagagtagtttgggtttactaaaaattagcatggttccgagaatgttttgtctactggaaaagttgaaatgtgcattttatatggtatgcccaagggaaaaatgagcaaaatctgatgaatacttggaagtacataaggaattcttggacccttgaattacatttacatatttaccattccctttctccaaatacagtttgagtatagccagaaaggctttcctgtaaataaataccagtctatggcatttacccagtgccccttctttcctatgctgtcaccgaaactcttttcacagatattcttctcttctctaaaactagctattagtatcttagttgataacatttgaggtttactcagacttgatttgtctttgcacagcatgtaattgcctctgtagccatgcatatgttatatttacaatagcttaatattttcagtaatgattgaagtctactctattgttacttattaattgctattaacatttcattttagtaaacagtaagtctttactaacactattttggatctgtcataaaacttgcattaactctgagaacactggcattctctaactttcctttctgtccatggtcacagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcaggtaatccaatctatatgcagttttgtgctttcatgccacttttggatttagggaacattccactacattttgtgttttatattatgtttatagtgtctcatatgtcacattggtaagaagtcttctccactttttcagttaaaggttttagtgctttttctaactctcttgcactcagcattcacccttaacttttccacacagttacacttttatattgcactatggaactattaatagaaaatatttttgtttataagaattggctttagtacctatttctttctttctttcttttttcacttgtgtttcttgataacatgaagagcaagagatattaaaatattttcagatgtgtttttgttatcccagaaattaccatatttaatttttaaagaaaatttctatagtatgttttaaatatttctatataatatagtacttttccagtggtaggtataaagttaggca

SEQ ID NO: 94312 - DNA, 1003 bp, Homo sapiens
agacaggatctattctaagctttgagggtatagcaataagcaagacacatgctcccccttgggagagtacagataataagcacataaataaagaacccagaatagtggtgttatgaggaaaataaacaggataatggcatagagaatgatggggatttatgggggcttttttaggttaggtgacactaagacaggcttagaaggtgagatttgagctgcagagagaaaacatttccaagcaacttcagggcaaaaccctgaggcaggaatgagctctttgtgtctgagaatctagtgtaagactagtgagaaaaactagtgggagagtgaagaggtggccttacccacccagatcattgggggtctctaacaggcaatggtaaaaatgtttagctttttaaaaaaataaaaatatgcttattaaataattatattgtgattttggaactaaaataagtttggaagattcagggctactgagaggactgatgtgagacaaaggtgagaaatgtgcagagcagggttagaagcatagactagcctgcctggaagagagggtttctagatcactgacacttgtctgtttaacattgctgtttacgttatttatgagtaagccctgattttcatctgttaataagttgtaattttactgtttgctgttgtgcccagagcatctccatcgcaatgcagtaactgaagtgagactaaaacctctcacttgagggccatttttcatgggaaaatacttggcttagtggttggttaagttaggctttgaggatatgcgcagaaaactctggctagaaatcgatttgagagcagtgcaaacataattaagggtgacttcgaactggtctctggacatgttctaaaccaaggttaattaagaccgaaaatatgtagatctggattctgaaagatactgaatgccaaattaaggaatttggattttatcattccactttaatccatgctctgctatccagttgcccttgctttt

SEQ ID NO: 94313 - DNA, 2378 bp, Homo sapiens
gaagggtggggcggcccttggagcccgggtttgttcttattgtccgtcttggtttcggggaacacgtgcaccgctcccggctcccactttcaccctgtgtgatgcccagcgtacggattctcggaagttaggcacccacccgtagtaggagccgggtatatacccgagagccagggttgtggatttatcgggttggttgggcttcgaggtgaggaaggaaaggccttggcacccagatatttttaggaggtgcttttgtctacccgtctgggttgctcctttggaaaaggtgcagttttgctgcgggtctgttggcctgcattctgccccgggctccctcctcacctcctggctggcgtgggtggcccctttgcgcttcccctccccctcctcctgtgctcgtggggagctggccgagtggaaaacgtccacattgacccaaccgcagtgaagggagagcgcctccagtggtgtggtgcgtggagaaatgggaaggagagagttctggtaaagtcctgccaccgcccagctccccggggtgtgatgtggactgctccccaccagctaaaccgagccagggaaaggggatctaggcattgtgttcgagggggcgtagttctgccggggtttcagctgcagggtcggaggaattgctgttagtgtggacttggcccagcctcttagtgcatcataattgaatcttacagaaaaaaataaaaggcaaaatggttgacattcctaaagaagggaaaacctgtggattccttgccaggaattggctaattgaactcgtggcagatttaccatgagacacagagaaatgttttgagacagacattttcatatatattggttagaaatactgtttttcagaaggatatgttttaggttacagaatcaaaatacggtcacgtgcctcataacgacgtttaggtcaaggacagaccgcatttgcaacggtggctccataaggttgtaatggagctgaaaaattcctgccgcctagcgacgtcttgatcttgaccctgtgtaggcctagggtaatgcgtttgtatcttagtttttaacaaaagttaaaaaaaaaatagaaaaaagcttatagaataagaatataaaatttcttttctatagctttaaaatgtgtttgtgttttaagttaaacgttattacaaaagagccaaaaagtttataaaatagaaaagatacagtaagctaaggttgatttattattgaaaaaatatatctaaagataaatttagtgtagcctaaccgtagagtgtctgtaagttgtacagtagtacatggtaatgtcctaggccttcacattcactcactactcacgtccacagcagcttccaggctggcaagctctgttcatggccagtgccctgcacacgtgtgccatcttttaatcctttgtacagtgttattttaggtatgtttagataaacactacacaaataccattgtgttacagttgcctacagtaacatcctgtataggttagtagcctaggagcaattgattataccatatagcctacatataggtatgtagtaggctctaccatctaggtttctgtaagtatactgtgaggtttgcacaacgacagaattgcctaacaatacatttctcagatcctgttccccctgttcagcgaggcatgactatgtatggtctgtaaaatagttttcaagttctttcattcacctaagttcctgattgtatgttattattagtcacgttgttttattgccgttttcatcttgggaaattattttggaagcgaaaaaaatcacgtttgttagagattgagaatgcataatattagatacattcataagtacttgctacttcggggacagaaagtgtcccactagcagtaggacctttatgtataaaaggtcaagaatcaagtagtgtaactgcctgcttggaaatcttcatagccttgtaggatgttagaggtgattcatttcttaaaagaaaatcagtctgatttttttttttctcaattcacttctccataatgggggaaaataagccaattgcgatgctttttagtaatattttgatgttgacggactcctcacccccatactactcaaaacactaattgccatattaaaggtcttagaagatgaggagtaactcaatcttttcctttttctttatgaaaaagacatacttgagggaaactgaggtaagagaaaaatatgaaatatatttttaaacaggaattttttttttttttttttgagatagtctcccccttgtcaccaggctggagtgcaatgacgcaatcttggctcactgcaacctccgcctcccaggttcaagtgattctcctgcctcagcctcccgagtagctgggatta

SEQ ID NO: 94314 - DNA, 1056 bp, Homo sapiens
cccagccggtaagagagaggaagtgccgtagtccccacccactttcatctccttccctttctgttggcccggctggtcgcctatcttctcgatcctgtagccgattggctctctccctcccgcgccagtccctgccctcccctggggagggtgagtcacgccaaactgggcggagagtccgctggcctcactcctagctcatctgggcggcggcggcaagtggggacagggcgggtggcgcatcaccggcgcggaggcaggaggagcagtctcattgttccgggagccgtcaccacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtgggtgagtgccgcgacctctcgcttcgcgccgcccctcgcgcccctccctcttttgtgtgcagccccagatgctttgg

SEQ ID NO: 94315 - DNA, 1034 bp, Homo sapiens
taattattaatctagactagcactgtccaaaagaaatataatgtgagccattatgtatttaaaaaactctagaagctgctttaaaaggaacaagtaaaattaatttaataatattatacttatcccaatatatccaaaatatcaatttcaacattcagtcaacaggaaagctgagatattttacatttcggaggtactaattcttgaaatccagtgcgcattttacacttacagcacatctaatttcagcctagctacatacattccgagtgttcaatcagtagccacaagtagccagtacctgtcaggtacagcacagatttagactttgagcaacttgaaagcaggttatcctcttctctccagggcctccagagtaggcatgcagtgaatatttttgaaaggtaaatcagaaagataaaaggatcctgattcttacaaagatgttctgcaactactctctttaaactctccagcctcataaaaagtggaatggggatcatgcttattcctgcatatcaaaccaatgactatggggcttcctgactcccagaaagcctgaatcatccgaaatgttgactcatgaacctaaggtgactgaaatgtaacgtgaaccaaattagctttccaaggcatctttgtatttccactttcctgtctccccgctgcctctctctttgggtgactcactctcttaccatgtaagagtccagcaggcaaggccccaaactctctttggaagaagagcagactttcaaatggtcggccccagatccctagttaattcagcacagctgttttcctcccaatttcgggggctgcggtttagactgagtgagcctaactgtcaaaaaacaatttttttcttattttagggtggtagtagtagtgatgtagtttggaactttgagtgaacaaataatcttttatttcaaaaatctttaaaaatccttagggcccacttcccagtcccgctaatacctttctccagtcgggtttcttcctttcccgggaggaaagtttccactctcagt

SEQ ID NO: 94316 - DNA, 1027 bp, Homo sapiens
ccccagcttggaggaagggcccgttgtaaagcctgggccggaggaaggttggcaaggcagggcccaagcctgggctctagtttccctgagcctgccagggtgcccagccaggagtttccttctgtctgtgcccaccctggtgagctggagatagggggaaacctgctgggaaaagtggcttcggagagctaaagtgaggggggcaggaagcattgctttccttctaagaacctttgcttccttcggcctcagcatctgcctggggtgacacagggttgctttcttcagagatgcggctgtgctgttcagcccctccttaggttctgccaaggcaaggcctgggtgtccagagtgggcatgggaatcattcacccaccccacctctcagtgccgtgggccagtctgggcctcacgcagcccacagcgaggcatgggtttgcattttacagtcacttgcaatgactgcgcttttttccagttcatgggagcaaatggagaggtgttctgggaatcccatcttcaccctcctgcatctgaggctggtgagcagctgagagaaggagaaatgagaagccagctggtcaatggtctgactcctccacccctgcataattatgggttggccatgtagctaatcccgttttctcaacagccctatgacatgagggaggaggaggtggttgtggaaaccacatgccctagatcctagtggtgctccagcagtctgggagcaaggttgccctgggagatccctggggaactattgacttctctccctgatcttttgcttttttgccccctgtaatactttcatcattttcactatggctaagcgagattccaagttgggctggtcactctgcccagagaatacaagttctatgaagaaaagtgctctataaatccaaggcattatgaaatttacttctactataaggcttttatacttgcatccaataagtctgtgtcccctatctaagggatgaagccagccagctatcacacgagctctctgttcttaaataga

SEQ ID NO: 94317 - DNA, 1042 bp, Homo sapiens
gcgatggtgatgcaaaagccaggatttgagggatagacagatgtttggagtggacacagttccccgtggggcggggtgggggagggtcactgttggttgagttcagaaggccatatggaggaaggtgtgctgtgggatttagtctctttgtgctcctgctcagtcccatgtgaaccagacataactaagaggagggattgacataggatggtgtcagagcatgtgctgtgggagatgagctgggaccgttggcaaactctggctaataagtggtagggccagattgtaagccaggctcacctggctccaaagccattcccttccacaaaactccattggctcctggccacctgtctcagatatctgagggcaaaggagtggaatctgcccagagaaggtggctcctagcagaaaaggtggctgcagagcccttggtgtagagcactggtaccaacactaacctcaaggtgtacttaggctggttgtggtgggtacagcacagtgccctttttttcctaacctctgcctttggctgaaataccatctgaaattgaactcaccctttttcatgtagaagcctgcaatgtttctggttcccagcaccgcagaggacaacaaagctcagaaaaggaaagactttgtctgggggagactcactgcatacccaggtccctctcccctcttgcactttgaggatacagcaagtctcctgttatgcatgtgacccacttgttcagaagaatagaggcaggggtcgctgaggattgggtttctgtcctggggcttccagaaggcccagatttctggcaataacacttatctggaagctgttaactttgccctagttcattttattacatgcatacttcccttttaaagatactttcagacgatgggtgtggtggctgatgagttaaaacctgtcttaattatgcactgaagcccggtttcggagtgttattacttgcttaatgatagcagcttgcaaaacagtttccatggctctcagcacagctaggcctgcattgccatacatctgctc

SEQ ID NO: 94318 - DNA, 1744 bp, Homo sapiens
tccagtcctcacctgagtccttttctccaaacaccgacttcagtgcttagagatagtaactagggaatctgggaggtggaactgcatcttgggacaagtagtccaaggtagaagaaagcagtggagaactacagttcccagaatgcacttccatttcctacctcttccccaagaggcccccctcgacctccttttaaaaattctcttagccacgttgattgtacgggaaaagcctttttaaaacatcttttacgttgcttaaacctacagtttcgaaagcattccgaaggctaaagtgagaaataagcccaggctagggagaggagaaacgaagttcacgtcctagtctggcaccgggttggattgtcgctgggacggcagtcaggcatttggtgtggtcgcctaaggggtgggtccttcggcgggagctccgggaaaccccgtgggcctgcgcggcgttcttccttttcgatccgccatctgcggtgggtgtctgcacttcggctgctctcgggttagcaccctatggtgccttctcttgtgatccctgacctaacctgtctcttccttttcctcaacctcaggtggagccgccaccaaaatgcagattttcgtgaaaacccttacggggaagaccatcaccctcgaggtacgggccgggtggtcatgaggaagccaaggtccgaataaggtcctgaggtggattttaggaccggcgctgctttccatgtcttagaccatgattccgaatttgggttctaaaacttaagctttgaaatgagtaccttttgctgagcaacgacctagaggtgattttcggtggccaaaggctggacctgtctcctctcgaggggttccagctagttagttaaaacggaggagctgcggtggggaaggagacgctctgcccgccgggtgcgagcacgtgtggccctgcggccgccgcccgctctgggctggggagatgaaggtgctttccggtagccgacttgggaggttgcccactgggtgggtaataggtctctcgagtaggtctcagccctgtcgctggttcggttcagtggtaattgtcaaactaaatgagttctgctgtagttccttaatgtgtaaccaacatgctttcactttaacactcataggttgaaccctcggatacgatagaaaatgtaaaggccaagatccaggataaggaaggcaagtagtattttgtagttaagaaaacttaacctgcggagacttcggcctacctgtaggtgctagacatacctgctcttggtgatgggggaaggggtcagattgacaaagcgaaatacttgtggaataacacaatagacattggtgatcggggagcacagtacctagattggaatccttgaggtgtatttcacttgcgtgaatttggacacttatttatttattttgtgtgagatggagtctcctctgtcgcccaggctggagtgcattcgcttgtcccggcttactgcagcctccgcctcccgggttcaagtgatttttgtgcttcagcctccctattagtggggattacaggcgtgcaccaccatgcctggctaatttattgtatttttagtagagactgggttttaccttgttggccaggctggttttgaacttttcacatcaagtgatctgcccacctcgacctcccaaagtattggtattacaggtgtcagccactgcagacaaccaagtattgtccctaatattaaatgcggtaaaatgtgac

SEQ ID NO: 94319 - DNA, 1189 bp, Homo sapiens
tgtattctggacattttgacacacaaaaagggaaaatggcattcgaatagcagtagatttttaggtaactcctatactgatacttgagaagcactgctatagttctcccattatgaattttgcaagttgtatcccatggtgtaatgtaatgcattctttaatgtccctataaactgtcagttaagaatctgatactttattgggtttgggggctgcaagattccctcaaatgttattgtgtgctgctactgcttttaattagaaaatgcataatgttgggtgtgcccattcttagtggaatcatgaaagcttgcttcattcttccattaacaggagtctactcttcatcttgtgttgagacttcgtggtggtgctaagaaaaggaagaagaagtcttacaccactcccaagaagaataagcacaagagaaagaaggttaagctggctgtcctgaaatattataaggtgagccagttaaagggcagaatgtcagcaaagtcttggcttatttggaaaacttaatctttatagtacttgtcaatattttcttggacttaaacacccaatattatcccactttggtttaaatgaggtattctggaaatgagaaattcagactttctggggtttttcctgtttggtatttgaaatcagttatgtaatagggttctgagtttaaagtcgggtttgggttcaggtctttacctttgtctaccacttgcaaagctggcctttagtgttcaaaagtcccaagacttctgaatgttttcattgtagcaatgataactggtgagaatttagggtgctttggtttgtaagcaccaaaaccaccagtattacacagttaaaagcttaaatattttgagtcacttaaattagacttcagaatgtgttgtaaaattatcttaacagcaggtttgtgcttttcaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaactaacatttattgttgggttttattgcagtaaaaagaatggtttttaagcaccaaattgatggtcacaccatttccttttagt

SEQ ID NO: 94320 - DNA, 1689 bp, Homo sapiens
tgcttgctgtctgttgtacaacgcttgggaatttaatgtttgttcaggatggatccctataaaggaatgattacttatttgtactgttaacagtaaaagacagtttagtttcaagcaggactggggtagcctatcttccttcggagctcaattcagggaaagctggttcacttgataagcctcttaactaaagcatacacttgaaagaaatcggtgatgtataaataacaattcacttttaccatattgccagtctttccattcaaggatttctagttggaggcatccttaaataaggtttcctatttctgagcactttgacagtttgtgcaaatgcatatgaacacatggtaaaacaacttagatactttttggccagtagtagtgcatttctaccttcaaacaaacaacacgttgagttatttacatttttaatgtaattttaaaatcctggatcccaagaagtcttggcttgaatttgcttttcttcataacaaacaattctgtctcccacttgaaattccatattgtcttcatctaaactgagaccacaatccattcccgttttgacaattgaaatgtcatctttatggtgtttcaatgaggttaatgagccttaaaaaagataatttaaggttagtatattcaataaatgataagtacctactaaatactacattatgtggtgttaaccaggaaattacactgaaattcttaaaaattttatggtcttgtcaagttaaatgatgggactaaataccaggggaaccccctcaaaaatgaagtttgctgtgaataagacttgatttgtaacaaaataacctaaatctcctatttcaaaggtagacataaactttttgctgaggacaggatggtactcaggacttgaatgggtaaaaccaacatacatctcaggcaaagggaacccatcaactacagacaatttaggggtttcaatagcaataagaaatggcctgagctgagattatgggcatgaaagatgaacagatttcagatggttatatagtcaacaggtcttggtgactggatatgctattataggagattttgatgttgcttacccttccaaattacatgtccattacgggttagtttaaattttttttgtttttctaactgtcccttttggactctgcagccagccacaggaacttttttcttcccttctgttacagagaaggtagctagtatagatgcctcacctttaggaagaagagaacattaatgtgcagaaaactaaagattctgataaatacgtaatttctgacattctgtggtataagaattaaaggtatgacaaaaatccaaattcatgcctagaaaaaagtctgggtttctttaactccaattttattttcctgaccaatattaagaataaaaatgaatgaaaatctttggctattcttttccttttctttttttctttttttttttttttttttgagacagagtctcactctgtcatccaggctggagtgcagtggtgtgatcttggctcactgcaacctccacctccggggtttaagcgattctcatgcctcagcctcccgagtagctgggattacaggcgcccacaaccacatccagctgatttttatattgttagtagagacggggtttcaccatgttggccaggctggtctcaaactcctgacctcaagtgatcca

SEQ ID NO: 94321 - DNA, 1036 bp, Homo sapiens
ggtcaggagtttgagaccagcctggccaacatggtgaaaccccgtctctactaacaatataaaaatcagctggatgtggttgtgggcgcctgtaatcccagctactcgggaggctgaggcatgagaatcgcttaaaccccggaggtggaggttgcagtgagccaagatcacaccactgcactccagcctggatgacagagtgagactctgtctcaaaaaaaaaaaaaaaaaaagaaaaaaagaaaaggaaaagaatagccaaagattttcattcatttttattcttaatattggtcaggaaaataaaattggagttaaagaaacccagacttttttctaggcatgaatttggatttttgtcatacctttaattcttataccacagaatgtcagaaattacgtatttatcagaatctttagttttctgcacattaatgttctcttcttcctaaaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggtaagcaacatcaaaatctcctataatagcatatccagtcaccaagacctgttgactatataaccatctgaaatctgttcatctttcatgcccataatctcagctcaggccatttcttattgctattgaaacccctaaattgtctgtagttgatgggttccctttgcctgagatgtatgttggttttacccattcaagtcctgagtaccatcctgtcctcagcaaaaagtttatgtctacctttgaaataggagatttaggttattttgttacaaatcaagtcttattcacagcaaacttcatttttgagggggttcccctggtatttagtcccatcatttaacttgacaagaccataaaatttttaagaatttcagtgtaatttcctggttaacaccacataatgtagtatttagtaggtacttatcatttattgaatat

SEQ ID NO: 94322 - DNA, 1710 bp, Homo sapiens
tcaaactcgtgagctcaagcaatccacccaccttggccttcaaaagtgctgggattacagccgtgagccaccacacctggccaatttccttctttttaaagactgtataatattcctttgtatgtaaaatccacattttctttggaagaaatgtccatttgtcttttgatggacatttgagttgcttctacttcttggctatcgcaaataaatttgtttaaaatggtcttgataggctgactttgaactcctgggctcaggtgatcctcttgccttagcctgctgaatagctgggattgcagatgtgccactgcacccagctttgaaatgtttttatagtatgaaaaactgcttaagttaagaagtggtggaattaatcttgtgtatacacatgtttatataacttaaacttcataaagatatctttgctctacttaaagtacattatgacattgaaaatatacttttattttcattttagtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgaggtgtatcaagcttaattcctatatattagatataatataatgattttaaatgccagtttacaatgttataccaaatatgtgtattaatgttaacaaatctagattataaggggctgtgaggatgcaagttgtgctattttagcattagactatagaattttgggggtggggataagatttttaaatcatttcaattatacaagctctcaaattaaaattttacatgtttcttgaaacttataaaagtagtagtttcatacatgagttaagctaatttcctaatgcaggacaacacaaaggctttaatctagcagttattgatgtctatttcattaaataatacgtttttcccctataaagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtatctttttaaagattttacattacagttcattctttgaatatatgtttttttattctcatagtttgggcctttacatttacatgaaaattatttcaatattttaggagagtttttcttagtcaacatatttcttgctgattttgttgtaaatgtacgtttggctcattatatgctattaagtcaagtagatatgtgtaatgctaagcctaaataaaagtggatttagtgataaatgacattcctatcatggctttaaatagattattgtcatttttatgtctgctgatgtctaactcttaaaagcaacaattataaactttttctgtatttaggtgatgttgatggttctgttgaggccattttgaacattatagatacctatgatgcttcacacgagtgtgaactaga

SEQ ID NO: 94323 - DNA, 3387 bp, Homo sapiens
gaaatgcataaaacaaaattatgtgttgatcagttgatgaaatgtgactaaaggcttgcaggaacccaactctatatttcccctcagaacagtggttcaatatttgctaattcaatagttttggtgactttatagaacataattattgcaaataatggcaattgattgtatatacacacacacattcgtgtatacatgacatttgtgaccttaaatttttagagaaatagactacaatcaattattataaatactaaatttatcttaatgttttattgatgattcagatggcttagaatacataaatattcaaatatttatgaatatgcggaaaagtcagttaatagaaatgtatcatattttaaataattaaaaaacattttttagcttccttgtgatttgttaatattagagaaacagtttgcatagttattcctctcattgagtgtactgtttatatagacatttattaatagagattacttcttgagcatttaattaatgatcctaaaaggttttattttattccaatcagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggtaaaacttaactgtatatactggcagggtttgggggagactacatagttatatttacactttttaatggaaagatttgctttaaaatttcttttgtaataaagatatgtgtgtataaacttcgaagtacttaaagcattagaaagtgtattatacattcaagttattataaaactttaaggattttttaaaaatttgctgaatgtatacattggtctgaattttcaaatttgattcagttctgctcattgttatgaaaatgcaaaccacaggtaggtaggcagttattaaatagtctgtcatatgtataggagggggaaataggtctaatccacactgaatattgggttttattgttaatggtagttcacagggataaatgtgaaccaattcacaggctataaagtatttctgatatttaagaaatgaaactcttttgctgttaattgtaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttggtatgaacacaaattaccttacaatgtgcttgggaaccccacttattttcttaaactaaatgtcatagtatgaaatatacaaattcaaagtacaagagaaggctaaagcttgcagtcattagtttgatgaaatgtagagcaagtggttagtaaagctgtgttttgtactttctataagaagaagattgtgttaactgttaacttttttttttttttttttctttttgagacagagtctcactctgtcacccaggctggagtgcagtggtgcaatcttggctcactgcaacctctgcctccccagttcaagcagttctcctgcctcagcctcccaagtagctgggactacaggtgtgcaccaccgtgcctggctaatttttgtatttttagttgagacagggtttccccatgttggccaggctggtctcaaactcctgaccttgtggtccgcctgcctcagcctcccaaagtgttgggattacaggtgtgagccatcgtgcctggcttaatttttttgtatttttagtagagacggggttttgccatgttggccaggctggtgtcgaacccttgacctcaagtgatctgcccatcttgacctcccaaagtgctaggattacaggtgtgagccaccgcgcctggctgaaaattgtgttaacttttaattctagctcattcttagtttgatttaatgagtctacaatttttttattaattatgtttatataacttcctttgctaggttgtgataatattgctgataataattaaataatagtcccatttacgagcacctagcatgtttccagtactgtgctgagcaccttatatgttttgtcttttttatcttgacaacaacatcataaggtaggtattaatagttgcacttacaaataaggaagccgatacttcttcgagttaagcagctttcccacagtatatagccagtaagtagcatagccaggatttaaacccaaggtcaatggactcaaatcgtgagctactgcctactaaattgcctctctgtggctcagggagttgtgcaactctgatttgctaatgtgagggtggctgcctgtacaacaattggtctgttctgtctctaaaatagatatatcagttgatacatttatgaaagtagttatgttctagaattatggagactttagtttgaaatttttacatggaaaaaaacccataagaatctcactggcattttatcacttttcattgtgaaatgatgatctgtgttctgattaagattaatggaaggaataaaattattttaaagaattattgatggtttctgataatgtcgcatatattctttggtattaaggaagtacatgtttgaatccttgatgttcttgaatttctgtttccacagtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacagggtactgtgtggctgacttaatggatctactacataaagtcaaagttctggggccatttacatatagctcatttagtcttcacaacaatcccagagttattatacgtgtattacagataagcctcaaagataaattgttttcccacagacttataactaataggaagagtatagcaggattcaacttgggagttgtgaccataagtacagaccacaggtacaatctttcctctactatgccctttttttttcaactttttatcatagaaattttaaacagatacaaaagtaagaaaagaataatgaaattcgatctatccatcacataaattcattaggagttgcatagtggttatattctgttatttcctgttaatttattatgtggaattcttctctaaagagaaactttcccttctgctttaaataagttcttatctgatcaaatgtataaaattcagacttttggaaaatcacttaaccatcttctcccttatttcttca

SEQ ID NO: 94324 - DNA, 1049 bp, Homo sapiens
gcaatgagctgtgaccataccactgcattccagcctccagcctggatgatagagtgagacccggtttcaaaaaagaagtttcagggtgtttaacagaaatgttatcatttggaattcgcactttagaaacattactctagttgtgatttggttagttgatatttcaagagtgaaaaaagagccttttacaagttgttattgtatttcaattctatcatagtggtaacattaacagtaataataatagctagtatttagagagtacttgttatggaatcccatctcttgatgagactgagatttttcagggcaggaacccagttttactcattgttgtaagtctagtgagctaagtgtagtccagtgctatgcatatagtaaatatccaattaatatttgctaacttgatttgaatattattttaaaaccttttttttttccccaggagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcactggggctgctttatctcagtataggcttctagtaacaaaaaaggtagttacagatttctttttttttttttttgagatggagtctcaccctgtcaccccggctggagtgccgtggcgcgatctcagctcaccgcaacctacgcctcttgggtttaagcaattctcctgcctcagcctcctgagtagctggggttacaggcattagccaccgcacccgctatagttacagatttctgtaagttattttattactcggtctaaaatgaaagtgcctagaaccatgagtacaaatccattttgagtaatttatcatttacagaatatttattacttaatgcaataaagtattactccaagcaatagagctttgtgagaaagggaagttccggttaattgtgtggtgctgatgaatttggttcct

SEQ ID NO: 94325 - DNA, 1082 bp, Homo sapiens
cgccaccgtacccggctaatttttgtacttttagtagagagggggtttcaccatgttggccaggctggtctcgaactcctgacctcaggtgatccgcccgcctcgacctcccaaagtgctaggattacaggcatgagccatcacgcccagcctgaatttctaaatcttaatgtgtttatttcgttggcattaagttagatttttccttgatctttactcgaataagccttttaaggtaaaatgcttgctcgattacacacacatacacaacctcataattgtccgaaggtaaacaagttaatgacttgtgaatatttttaacttataagcaatgaatcctcaaagcttataagcgagtatcaagacatgtgatatggttttaaaatagctgatgataaagtatatacatcatctcattttctcctcttagtcttgtaataggaaggacagatattcaaacacttatttatttatttatttttaacagagatccggaaaatgaggcccataggaaacaagtgacttgctgagtccagataacactgactgtcagagtgagtgtccacctaaggttcctttgttgcctaataagatactttctttgctatactgtacttgtttctgttatcatttcttttctttcttttaaaaaatattcagtataggccaggcgcggtggctcacgcctgtaatcccagcactttgggaggccaaggcggatagatcacctgaggtcaggagttcaagaccagcctggccaacacggtgaaaccccgtctctactaaaaatacaaaataattagccgggtgtgctggcaggcacctgtaatcccagcgacttgggaggctgaggcaggagaatcccctgaacccagcaggtggaggttgtagtgagccaagatcacgccattgcactccagcctgagcgatgagcaaaactccatctcaaaaaaaaaaattcagtatattctatttaccatgtcagaaccatacatttactatgtcagaaccataaaatacactttgggaagattggttgaaatgtaacatttaggctaggcgtggtggctcacgcctgtaat

SEQ ID NO: 94326 - DNA, 1659 bp, Homo sapiens
gtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacgttaaatcattttgaaaatcttggatgaaaggtgctatgtaaatggaaatacaaaggattcttactaacatacaaaaataatgcacaacagaaatatctaaaaccttttccgtagactttgaaacatctctctctctcataactccctggattcaagtagcacattggtaataggtatcagagcagtctagagacaattgcatgtcaaaaaatgtacattcatttttaggtggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattacagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtct

SEQ ID NO: 94327 - DNA, 1034 bp, Homo sapiens
cactttaaatttaattttactagtgaattatgttctaggaattacttttttagtttgaagccttttgtggtaggaatacaacttccccacagttttcttgaaaattaatgactaaatgcctattctatgatgagccactcaaaaattatctctgattgtctgtcattctcattcttatagaaatacctggtgcatgctgttcttatagtggctgctctgtattttgtgtctctcttatctttaagcttttcttatattttctttcttctttctaccttccaactaaatacagagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaa

SEQ ID NO: 94328 - DNA, 1366 bp, Homo sapiens
aaatacacattggcattctctctggaatgttttttgccatttggatttagcctatagctgataaggactcagcctggcacctggaaggaatgccttcaaatgtgaccatgtggggatgaaattatgttatacttgttgttgttgttgttgtattaagtggttattaactggaccaaagaaaaaatctgtagagaatatttcctaatgaaatttgtctcctttgtaatcacactttttttccgatagctattacaaaaaaaaaaaaaaatggttctggtacaggtaatcaaatgaacacaatcagaggattgtcatattttagtaccacctaatatactttttgcatccttctattttattgtcagttacttcccagtcagtcctgacatttcaaatatatttggtgctaatattttcccttttgttttttcataggccagtaacaaaacttaatagtaaacatagctgagattaaatgggggcagtatatgacacaaatgttataattagtgttatttcttttccacactgagtcaaagattatttcacagctatttcaactttttagatatcataattctgaccataacacttcaaaatattgtatttattcattcaaaattcattgaaaaatcacatgctattatattaaaattatgtgattattttacaaaattagacttacagaaaagaactatttcctacccaaaaagctatatgtttatatgcagcatgtttccaaaaaaaaaaaaaatacactgtgcatataagagaaatatgtatcatgtccatgtgtcctgaggactgttggaaaatacagtctggacttcagaaatcatcacctgctgtggagtcataaaattccccccaaaacaccactagttctttttgtttgtttgtttgagatggaatctcactctgtagcctaggctggagtacagtggcgtgatatcatctcactgaaacctctgcctcctggattcaggcaattctcctgcctcagcctcccaagcagctgggattacaggagcatgccaccacgcccagcaaatttttgtatttttagtagagacggtgtttcaccatgttggccaagctagtctccaactcctgaccagcttcccaaagtgctgggattacaggcgtgagccactgcgactggccacaacactagttcttatcaacgttttttcatagcatttggaatcaaatttttagtggtgaaaataccttagaaatcatatggaaccgatgtgtcccaaacatttaagaaaaaaaacaatactttctgtaagtgaaatcttacatagatgccccaaattttaaaaaatgaatttcatttaaagtaaaagtgaaacaactctga

SEQ ID NO: 94329 - DNA, 1086 bp, Homo sapiens
accttaatttagatgaacaccacaagttaaatttctgtaattgaacttcagagctttttttttttggtaagttaaggagtattaagaggtaccacaattttatattgcacagtctgctaaatcaggaaagtaaaaacatggcactatattcactaatctgctttgaatttttttttaaacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctagtgagtaccatttacaccagtggtcctctcatatacttgacatcccaacacatactataggttcttgtgcccaaaatgatttagctatagacatgcctgagcctctatatgcccaggctagaaactcaagaacaggaaggtcacattttctaaaccaaacttttgccactattaggatgcctagtgatgcattcggaatgttggcaaaagatagcataggaccatttactgtggcccattcatctcagccattcttatccctgaatacagaattagttagtaacataagtgggttacctcctaggccagttatcagaataactgaccaggcttctgcctctttggataaacctgcacagaaagaaaatgaacagttttctgatcatcagaaccctagtaacagtaacctacagttttctataaatagcaacaatcttgtcactt

SEQ ID NO: 94330 - DNA, 1033 bp, Homo sapiens
aaatgtttttacatccagtagaaaaatgtagtctgaaaataggatttttttttttctgatttgaaaatttaagaaactcttacttttgtaaaatgttacataacttgagccaaattctttcgtggcccactttactctctgtgactgggaaacaatggaaagttgcattttctgttttgatgtacagtttgttcgtgatcaaaacaaatccgtactcttaaggaacaccatagatttgagggagtttaattctagaactagcaaattttcattttatatagttgcttaatgtcaactgagtcttttaaggttatataggcaccatatcaacagtggacagcaagaacaataagatgatcaagacatttaaaaaagaataaagcactacatatttgattgtatacttttactgaaatgttgtaagtaattgcttcatatctttatttaactttccttatgtgtatgctctttaaatttttttaaatgtttaaagttatccatgcaggatgaacagagaagccttcaagtagtaatgaggacttcttagataagcaaataattaaaatagaattttctgcatttagaacagtttttggtcttaacatactgaaataatataaaattcacctaatgagccaggtgcggtggctcacacctgtaatcccagcactttgtgaggccgaggtgggcagatcacctgaggtcaggagttacagaccaacctggccaacatggtgaagccccgtctctactaaaagtacaaaaattagcctggcatgggggcgcatgcctgtaatcccagctacttgggaggcagaggcaagagaatcacttgaacccaggaggcgggggttgtagtgagctgagatcgtgccactgcattccagcctgggtgacacagtgagaccccatctcaaaaaaaaaaaatacacacatatgtatatttatatataatatatatttatatataatatatattatatatatttatatataatatataaatttatatattatatattatatatttata

SEQ ID NO: 94331 - DNA, 1550 bp, Homo sapiens
attagtttaaaatattaaaaatatctgttttaaaggatgaactttaagaaaccaatttttgggccagggacagtggctcacgcctgtaatcctagcactttgggaggccacggcatgcggatcacctgaggtcaggagttcgagaccagcctggccaacatggagaaaccccatctctactaaaaatacaaaagttagctgggtgtggtggcaggcacctgtaatcccagctacttgggaggctgaggcaggagaatcgcttgaacccaggaggcggaggttgcagtgagccaagattgtgtcattgcactccagcctgggcgacagagtgagactctgactcaaaaagaaaccagtttttgggcaatgttgagtatttcagatattttccatttctgtctggaaaatcatatctcaccaaactattggcaataagtggataacatgttaaaggaattttaatgtaaacagggttttaagagttagcatagggcagtgttaattatacagttgttacccttgttacagataggaatacaggacattaactgtatagatgcttgtattcctcctcttcttgacatctctgcaatgtgcagagttccttgtctgatctgttgtaggtgacccaatcaatagcattttgggggatctggggggatatgtcattctatttaactaaaacactcctggcatatccatctagaactcattttcaaatctaaatatgcactttatcctcctctttgaatctcaactattgtttcagaagtgtcctattctaaagtgtctcaatgaactatctggaaatttgctttctaatctgggcatgctcatcttgtgaaagtatgcatgattgcttcctcaaagcattctgtaatcagaatgtaaaagctcatcagcatcatcagctagaagttttatcacactgtctcctggttttttcatttagcttcaagaccagccagccttgatagtggcagaacatccactagcaatagcaataataatgcttcactacatgaagtcaaaggtatgctgtaggtaaatttattaatgcgctctatccatttccagtatttaaaggtgggagatgggatgaagtttctggggtaaagcatgaaatccaaatcatctatgtttggaacatagttgtttggaacattttatacttttcacattgtaatacaaatgtatttcaatgtatacaaatgtaaaaacaggagcagttatttagtttcactttttcatcttcatagataaaagtcttatagtaatatttatacttcaaaattatctatatgtccttattttactgacattttgtctttgacatgaaaatgattgtccttcattttcttatgacgcatggacactcacattactcatattttagaaatatgtttggcttaatttatccacaaaataaggggaaggattttgtgtttaatttgagaaacaactatttgtgtatatatatattgaacaagaactatatgaatgcatttggctcatataaggaattatttcaagattttttttcttaattt

SEQ ID NO: 94332 - DNA, 1051 bp, Homo sapiens
ttggcacatgcctgtaattccagctactagggaggctgaggcaggagaatcgcaggcggaggttgcagtgagccgagatcgtgccattgcactccagcctgggcaacaagagcaaaactccgtctcaaaaaaaaaaaaaaaaaagtatatgttcctcatcattgtcttcagtgcttttccaagtattttaaaatatcaaagtacatatttcatatttcattatcactcagcagcatgagaataatagccttaatatagcatacatagctaaaactcaaacattcatttctgtccttaatttcaacatttaactcccatctgttcttctcccttttttctttcatctccctgtttctgtttttcctcatgctctgacattaaagtggttgcactgaaaagactgccctttttgaggaacagaccgaaggataaagacaaaatgaaggcctgctaccgtcgttccatgtgtaagactttatgacagttcagcttctttcaactgactacactggctttcattactaatttttcactaacctttctctggactgtgccaatttccttattttgcagaggtcagtcttcctctaatataaggagctagaagaattttttttttcaagtggcactgaatttgcattatgtatatgtccactgatacatatacgtgcatatttctagtcatacatgtaacttactcgtaaatttccagtgctttctaaaaattggcaggaaaaaaaccctttattttatatgccatagagattttttcccaaagaagtttacttaagaagaatataacaaaatgtttagcattagaagttaatttcctttaatgaaccagattaattaaataaataaagtggccaaaaacccttgaaaatgcttgtcattctttaaataataatattctggattttctttttttatgtggcatgggtagttacataatcacattaagtgtctgtcactttagatatcatctctttcaggtttttattgaatggtatacttattgagtcataaaatgaataatttcttcagtaacctg

SEQ ID NO: 94333 - DNA, 1253 bp, Homo sapiens
cagcctgggtgacacagcaagaccccgtctcaaaataaaatagagatgtgggggccagttacagtggctcatgcatgtaatccctgcactttgagaggccaaagcaggatcacatgaggccaggagttcaagaccagcctgggcaacatagtgagacactgtctctattatttaaaaaaaattaggccgggaacggtggctcacgcctgtaatcccagcactttggatggcgaggcgggcggatcacctgaggttgggagttggagaccagcctgaccaacatggagaaaccccgtctctactaaaaatacaaaattagccgggcgttgtggtgcatgcctataatcccagctacttgggaggctgaggcaggagagtcgcttgaacctgggaggcagaggctgaggctgagattgcaccattgcactccagcctgggcaacaagagtgaaactctctctcaaaaaaaaaaaaaaaaattaggtgaagagatacatatttgtttataaacttatgatataatttttattacaaatttagaagtaccgcattataatatgctctatacaattataaccttttaatttcattactagtatgcttaaacagtaaaaccaaagtaaaagctttggaagtatattccaagaaaatcagaaaatttttttaaagatgtctaagaagttgactactatcaaagttcttacaaaatatgtgaacaggatactttgaatcctctcacactatcactaatgtcactaattgaacacacacacacacagacacattctattcttttgaaatagcaggtaaatgcagctgctgcttctcccaggggtagactctccaaatgggcaactctcaaagcactcaaaaaactattcacagtgttttggcttaggtgaattatctctggaaacatagtattttagggtataggatattaggcattaattatgggctataggccaggcgcggtggctcatgcctgtaatcccagcactttgggaggctgaggcgggcagatcacttgaggtcaggagtttaggaccagtctggccaacatggtgaaacttcgtgtctactaaaaatccaaaattagcccagtgtggtggcatgcaccagctactcaggaggctgaggcaggagaatcgcttgaacctggaaggtgaagatagcagtaagccaatattgcaccactgcactccagcctaggtgacagggcgagactttgtctcaaaaaaattaaataaaatt

SEQ ID NO: 94334 - DNA, 1023 bp, Homo sapiens
aaacaatgttttaattttttgctgatataaattgtaataggtcacctttcttccaaaaaggaaaaaaaaatgtaaatttttaaaaaaggagaaacatggaaaaattcccattgttaactacctgatgaaatcttagttgccaaccatggtatctgtatttttttatgttttggggagacattagatcacagtcaccaaataatttaatattcatagctgtacaaaatatgatgcctgtcctaaaaggtaatttttattttatagtgataagttaaatgaattaagacgtcagaaggagaaactagaagagaaaattatggatcaatacaaattttatgacccatctcctcctagaaggtaccattaaccaaattttatgaattcttattctgaaaaaaaacactaggttatttctaatattgtgatgacttctacttttgtgaaggatttgtatgttgaattttaaactgataacaatttttaaaattctgttaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcagtgagtgcttaaactctttaaacatcgtattgatttagaatcctttctaaagattttttaaaacttcagtagtcctttgggggaatagtctgatgaatggcatttctttttaatttaacatcataaaattaattgtgtactgcattagtgtacagccacacaattttctgaggtaaatcatacacagatatactatcatttggccagaggggtaaaatattgcagaaagaaagttaaaataagagctggaatacctctgccacttgctatttctgttaatatgggcaagccttttacctttgcttcatacttc

SEQ ID NO: 94335 - DNA, 1050 bp, Homo sapiens
cagccttgttgggtgggagctatcctcatttcatagatctgagaacttacttgtctaacatttcatagaaataaaatattagatatttgaatctagcttttggactatactataagttaaacagttttaaagacagaaagcagtgtttggggagtagataatatattatatattagacccagtgtttgtgaaaattaagaaaatatttatatagagagagagacagcatgtaacccagtgctgtaggtgtcatcactaaaataatcatgctctgataaaagtacaatcatctaattgttcaaacagtggaacacttaaatctttgtgtagtacttcatatttttcagttgatttatgttaaatgtaaatgttgattttttaaaaaatgtttgtgtttaaacagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacatgtaggtaccaaataattttgcactctgaaatatgttactcatgattttatcattgccatacccagtggcagagaaaattcatgctaatttttactgattttcaacaaatatttttgagtgcttatattccaggcactattctaataatcagaaatactaacatgaaaacacatgcatcttgctcttaaagaattagtagtctaaagtgagaaatacaaataaacatttaaatacagtaattctataatggaagtatatgtaggaggccatagaaatatagcacatataggggcaggaatatcttagtctgggagaggcaaggtgaactttccaaagatgagatttgagtggagatttataggttcgataggaatttgcttgaggaggcatgccagcccaggagagctgcaatacaaagtcatggaagtgtgatgaaagtatgttgtggtgtggtataggacctaaaaattaattgttctttctggagcaaaattgaggaaa

SEQ ID NO: 94336 - DNA, 1072 bp, Homo sapiens
ggcaacagagtaagactccatctccaaaaaaaaaagagagagagagataggatcttactcttttgcccaagctgaagttcagtagcatgatcatagcttactgcaacctcaaactactatgcttaagcaatccttccaccttagcccctcaggtagctggaactgctggcacacaccaccatgcctagctaatttttaatttttttattttaatatttagtttttgtagaaatagggtctcctgtgatccccacggttgctcacaaactcctggcctcaagtgatcctcctgcttctacctcccaaaatgctgggattacagacatggaccatcaataaccagccaatactttcttattaatacttgaaactttgagtacctatacttcaacatatttaaagactaaaaaattcttttcccagtgtggagatgggtggatgaaaaaaggaaattaaaaattattttcaagggaaaggtactcagaattttaaaaaatctagtttttacagaatagaaactgatttttgataagtttagtaacttgtaaaacagtcttttattctaagtatgccttaatgttatttatatcatttcatattgtataaattacaccaaaagctattaagataatctaattatatttctatgatttctaattataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgaggtgagcttaaaaagtttaatcactgtgtccttcatttaggcaccaagacatgcctaagaaataaatgactagattacaatgacaatactagtatatatttagtggcatatatctaaaagaatttggtctaggatcactgaaacttacatgtaattcagaacaacttcccatatcattaattacaatattttaaaaactattagcttaaacttatgtccaaat

SEQ ID NO: 94337 - DNA, 1462 bp, Homo sapiens
aatttggactcttgaaaaatttctaaaagtaatttttcacttctatcaacttctatcaccaaattctagaaatgataaactagtacttcaaattctatacattttcatttgtaatataatacaaatggttgctaatcaccttcatttaaaataaattcaacccaaaacatacaatacatatatatgtctatatatacacacatacatatgtatatatacacttccaaaagtcaaaattaaatgatagccttattctttgggaagctaaaatccacgtcttcccagtataatgtaaatatgtgtgctgtgattcatttagagctttctttaattaacattgtaatcttgtattttgaaaaagaacatgaactgtttttcttatgtctgataacaatatatattcttataggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccggtaatttattatattttgttgtactgtgaatttaaaatgaattttcttcaagtagtataataaattttatatattaaacacatctaatgttagtttacataagaaatttatataaatttacatgtgttttaaatgatactcattactcatttccttcatttctaaaatttcttttttgtaaatattataaaccaaatgccttttttccccccagttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggtaataaatatatattatatataacaaacattttatatagaaagtatatacatatatatgtgtatatatatgttttttcaaaattatgtattatttcttacatccaaactatatactgcccctttgtagtaccaagcatagtttgaattcggaattttaaaaaatagaataggctgggtgcagtggctcacacctgtaattccagcactttgggaggccgaggcaggtagatcacctgagtcaggagtttgagaccagcctgaccaacatggtgaaacctcgtctctactaaaaatacaaaaattagccaggcttggtggcgtgcacctgtagtcccagctacttgggtgggtgagacaggagaattgcttaaacctgagaggcaaaggttgcagtgagtcgagatcgcgccactgc

SEQ ID NO: 94338 - DNA, 1030 bp, Homo sapiens
actactcacttaggtatatatttgcctttgggtaaattagaaaagttagacctccatggttggacacagccccatttattctgggcattctgggaaccttcaagcagtattaaaaccatacaactgacaattcctttctagtttttgtgttaataaatatatttagaatgggatattttatttttaggatattataatgcagacaagacacaggcacaatattaaagttttaatatcattgccttctttctgataaatgtctgtttacaatttgggatgggggaaatgttttggttttttttctcttttaagattgttggggcttttatggattataatgctaataaatactcattgtataaaattcagtatactatagaaacatatttgatgttgccattattgttaatatgtttggttttggtttttgtttttcaagaatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgtaatataatattttgggaatatgcaaccaaactcttgaattatgctattaaaataagggagggtaaacatggaaacattgtttcttagtgaatgaacttaaagataaatgaaaatatttttatttagtgccatgccaaattttcacacatcagtttttaattttaaatattaataaattcagtcaatacatctgaataaagataaattatatttatggtctttctaccatttcattaagtcgattgtaaaaaattaggtagaaacccttgctttagagtatgcttgcagcatactattccttatttcatttgtatagcttttttttgtcagtttagttactgaaaagcaggacaacatgagaattttgtctttagacctctcctaagttcaaaggatccatctttcacttaacaccgccagtgtc

SEQ ID NO: 94339 - DNA, 1430 bp, Homo sapiens
tgcggtgagccgagattatgccattgcactccagcctgggctacaagagcaaaactccatctcaaaacaaaacaaaacaaaacaaaacaaaacaaaacaaaacaaaggagtcttcattaataaaaaggatattttgggactttggtcttccgggttccttgagaattaattattgcttttgataatctaagccataatccggagctctgttcactcaatgattttgttgcttcattaccaggattagttttaaagggagaatggggcagtaagaagaggataatttcatttgcctctttaacaaaaatgcttttataagacccatttatggcatgaatatttgtggtcataaattatctttaaaaataattttctgacctccaataatgaactacattactttgtacttggatagtaggtataaacttttggaatcaaaattagaatccactcttaagaagtctcttgaaataaaagaagaaaaaattgctgctttagaagctcgattagaagaatccacgaattataaccagcaattgcgccaagaacttaaaacagtaagtgattttcttggaaagaattttaaggatcatttattatataaatatttggacagaaaaatataaagtagaaaataaaaatataaacattttattgatatttagtctatttcttcctttttcataaacttgagaatattcttaaacagatctctgtcatatgaatatggtatagcttattcagtgctatttcatgtgtgtaatattcctgcctgctgttagggatatatcagaagtgtgtgggtggaatgaggaagaggcaggcttattttattgggaaaagctctcattgtgatactgacatttcactctgtcactctttcctatcgaggatccaggggaaattctgctaagcaaaatatgagtgtgagtataccaagttagaggaaaatcatatgtgtgttatataagacagcacctgatctcataaatttgatgtcttttctagatctgttttccttgtgatatttgaaagtattcagtgaagtaagtaagcaaggcagaggcaactgtttattttccctaaggaagtaaatcaaaatataagggactttcccattccacagggctagtagatggtagattggtagagtcatgttctggtttattcacccttttatcatctctgcagtgccaccaggagtggtctcaaggttaactaaacacttagactgataagattactgtaggctacatttagaatcgctgtactcagaacactataagaaatacaaatagatagcagggcagtgtcagtccatcctcttcacgtagttgtctgagaatcatcttcccaccagatggttttggtataagatgagattcacactgggtgtgtgcgggagctttcctggctttgaatccgtatac

SEQ ID NO: 94340 - DNA, 1050 bp, Homo sapiens
ttttcttctgtagacttataaacatgaacaacaagttccttgtgcctaaacttctaagaacatcctctagttcttcagatcagtatcatagggcctctttcactgggagaagggatcttgtgggagagaagtattatagtcaacatatatttataagaagaaatgtgcactaaagttcaggctcattattaaaaagtaaatggatatgattttccccagttttcaaacctaaatgtgtattcacaagtaaagagttactactcccttttaaggttttgtttaaagtattagcaaaaaaaaggaaaaaagttatttcaactaggttataactttaactacattttaataatgaaggaatggtttaatgacatttcctggttcaaattacatgtattcctagatggtggtaattagaatcttagctgactttcttagatgtttatacccttgacacttaggtgagttttgcatttcttttaaaataaggatttggtgagtgaaaagttgaagacccaacagatgaacaatgatctcgaaaaattaactcatgagcttgagaagatagggttaaataaggagcgactcttacatgatgaacaaagtactgatgacaggtgagtactaagtctacttggcaaacagttgaaaatttttttttttttttgctcatacatgaattctttctgtactagctatagaaaacatttatatatttcaccctatttctggttccttccttcccttaaggaaagttctgtagccgggtgcggtggctcacacctataatcccagcactttgggaggctgaagcgggcggatcacctgaggtcgggagttcgagatcagcctgaccaacatggggaaaccctgtctttactaaaaatacaaaaaaaattagctgggcatggtggtgcatgcctgtaattccagctactcaggacgctgaggcaggagaattgcttgaacttgggaggctgaggttgcggtgagctgagatcgtgccgttgcactccagcctgggcaacaagagcgaaactccatctcaaaaag

SEQ ID NO: 94341 - DNA, 1700 bp, Homo sapiens
gaatttgaagcatgtaactgtaaataatctgaagaccattatgattaatagaaaatacatttctcaaccgttcctttaaactgtgaacttcctaaaaacatgaactttaatgacctcacagtaagtgtacacagtggtcttcagtaaatgacctcacagtaagtgtacacagtggtcttcagtaaatacttgtcagaattaaaagtaagacatgttctagcaccctttttttgttccccttttcttggtagtttttggaagagataaaccatagttagtttttcctcaattacagcttttaattattttcttttcaaattagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggtaaatatgtttacctaaattaaggcaaatttttttttatatttttaactcaaggtttctttaagttttattggaatctatcagtaatttgcatcatttattttatggttcagtagaattttggaattagaactagaaatagcttccaagtttcctactttgttaaactaagaaatacctataaattgtatttttaaaagaatttgtagtaataaagtttcctagtggtatctgacttattacattataattttaaacctttatttcaatataataatgtttgatcaagacactaaattctaagtat

SEQ ID NO: 94342 - DNA, 1099 bp, Homo sapiens
gtctcatatttcatttgtaaatcctaatgttcttatatcagcaaaatatttaatgggtctgcttgaactccaatttcttcaatctaaattttatgctttttttaactagaatgctgtggatgcattaaaagttaaacatgtatctcttagctgggtgcagcggctcatgcctgtaatcccagcactttgggaggccaaggcaggaggattgcttgagctcaggagttcgagaccagcctaagtaacagagacccagtctttactaaaaaataaaaaaattagctggctgtacctgcagtcccggccgcttgggagactgaggtgggaggatcccttcagaccaggcgtttgaggctgcagtgagctaggagcacatcactgcactccagcctgggtgacagagagagaccccgtctctttaaaaaaaagaaaaaaagaaaaggaaaaaaaagatttacttcttttatcttgtttatcttatataacctcattgaatttttaataaagttaaggatcagatgatgcaatgcatatacactcaactttttaaatagtaaagagtaaacatagtaaaaacagtaaagagtaaatacaatggtgtatttttcaatattatagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggtaaattaaaatgtagtgtttattttaatgttaaaaaaacttgtaaaagtgtaaataaatagcccatttattttccactttttaaatgcacgctcaatgttattttaacttgttatgaaaattttcaaatatacacaaatatggtgtgaatgaaccctatactcattattcagcttcagcaattaagaacttactagctgatcttggccaggtgcgggggctcacgcctgtaatcccagcactttgggaggccaaggcagatggataacctgaggtcgggagtttgtgaccagcct

SEQ ID NO: 94343 - DNA, 1841 bp, Homo sapiens
tcaaggtgtatttatataaaatatttattaatagagccttggtttatgatttatgtgagttctggtttaagtcttggtattttactgcaaaaacctcaagcccttcacttccaagttatagctccaagtacagagaaatatttaaatctatttcagtcaatacattaagccttgattccatggagaattgtatcttaaatatctggaagactccttgtacttagttaattccttatccttgtgactaaggaagttaaatataccccgacaatttaatgtgaagttatagtagtattatatatcttaagaactgagtgttttgtttgcattctggggtaaaaaggaagccaagaaaacattaattgtatttctattactcagtaggtttcctcatgcatagaactgttgataaagatggcttaatgttttatgataatctgtatgttccataactttaaaaaattaacagatattaacacatttgtgataaacatttataggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggtaagttttaagaggtagatcagttacatggcctttaaggaaaacttctaagattcagctgatttccctgtattggcaaggatggctagtgtccttgaggctttaacagagaagagagagctaaataaattagatgcctccaactttatataaatataaaagtagtagaaatttctgcttttgttacagaagcatgttacttactaatgttgtcttcaaccttttaataccacaataaataagctattgtgtaaacatgtctttaaaaatacagaaatctgattgctaaaatttagcattggttcataattcttttgttgtatcactaaaacagtatgttgactatgaagaagaattttcattgtgtccccaaagatcagcttaaaaggatgtcagacacttaatcagtataatgaccggtaataattataattgccttcaaaactgaaaaatttaaagaactcataattattactgagtttctgataaataaaagttgtgagaaataaagtatttgctcaaaattgtactgtttcttagcttttttctctccctaatccttgccaataaaaaaggaacgagatatggatagaaaaaagattgaagaattaatggaagaaaatatgactttggaaatggcacagaaacaaagtatggatgaatcattacatcttggctgggaactggaacagatatccagaactagtgaactttccgaaggtattcccaatttttttaatttaaatagataatcgaatcatgaagttgtatttatgtttacttgcagttctttattttccgcagtgggagatatctcagaagactacctgtctccatagatatgatttcacacagtaatatattgtttgcattttcttgggtctggtccctagctttacatgtcttacaactgaatttcatgaatgcaataacagatttaattggtttcttagccactatttcatgttaatatcctaagaggctgcaatatcagtttattaatgtattttaagaaatatagccatctaataaatagaacagaaaagtcgtattagtggtcagcatgttctttgactataggtaaacccaaataggaagttaaagcataatgggcaaattttcagaggaaaatatagttagaattagttaatttaaggatcttcatgactacttgtaatatgtatagtctccatt

SEQ ID NO: 94344 - DNA, 1050 bp, Homo sapiens
ggcgcctgtaatcccagctactgaggcaggagaattgcttgaacctgggaggcagaggttgcagtgagtcaagtttgcgccattgcactccagcctgggtgacagagccagactccgtctcaaaaaaaattcttagcttaactgtctgtgactgcagagagtgaggaagagagaaagaagagtggaaatggaagggcaggaaagatgaaaagagagaaagagaaaaactgtattacatactatgagaacattagcctttggaaaacattagggaagaggttttattaatggcatctaattatataaattcctaatatctatctttttttttttatcttctagattagggttatggctaatactatgtccaactagttatttagtgatgatgatacatttatattaacgcagatgatgatcacagttttcaaaaatagtatacttaatgaatatatttttgcatttaagggaggaaaagactgagcagttgttggattgtaaacaagaacttgagcaaatggaaatagaactcaaaaggctgcaacaagaggtttgtacctggaatatctgttatttaggaccaccaagtaattggaaattgattttcttccttgtaatttataacctttacttcaatgctttatgtaaataaaagaggttcctgaggcttcaagagattggatgactttttcagagtctctctcttcaaaaatgtcagagccaaactttcttccatattaatgctgttcaaactctgctaagattcaaaagagctacttaggactgaggtagttccacatttttctttttgatgtgtttggcttctgtggccttggaagctagaacacctctactgtaaactgtgctctttatgtgtatctctctgtgtctctgctccctgatagtgctttatgctaactcatatgtaatagaatgttttttgatttttttcacttttcctattaaataagattaaaactttttaaaaagtatctttattttacagcagcttcttcttttttcaccttaaaccaagagtaattaatagtt

SEQ ID NO: 94345 - DNA, 1050 bp, Homo sapiens
cacttataagtggaagctgaacaatgagaatacacggacacagggaggggaacaacactcactggagcctgtcaggggaggccaggtcgggaaaacattagggaaaagagctaatgcatgctgggcttaatacctaggtgatgggtttttaggtgcagcagactaccatggcacacatttacctatgtaacaaacatgcataccctgcacgtgtaccccagaactttaaaaataaataaataaataaataaaaaactaggaagggaaaagcattattatcttgttaagtgtcatttgctaagtagcccatgcatgaactgttgaatgaaagttaagaatgacaactaaatatgatagttaagatgtttttgaccagtgaattgtttttgatatggcagtacaattcttagacctagtggatcatgttgatgtgtttagtttgctaatatgtagaatactgaaagtgattctgtgtgtatttctagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattgtaagttgctgatttttgaggttcattgaatttatatggtcccaaaggtgacctaaacaatatttttaagcttatggaaatattgctagcttgtgtcagtgttttcacaagtaaatgagaaaaataaggaggttggcataaggttttcctattgttaaatcttaacagtttaaaggatgccttttattctggatttatggcctttctagcattctagtatgtatttttttaaataaaataatgtcctcatttggcaaattggggctcttagttttttgtctttacattccttgaaatccaaattactaggaactactgatggagatcaataagtctaataactcttttaaaattaatgttttacacctattctgccccccaaaatttaatgt

SEQ ID NO: 94346 - DNA, 1052 bp, Homo sapiens
gagtcagactattttgaaaatgtataggaagccttgaactcaagaagttactgccattagagaaatgtcaaaatatctaaataatctttaatggaaaatactctgggaactcttaacttttaaaataccaggtttctttctttctttttaatattttgtaatatgtagttcattgacttctagaagctcttgatagatatctccatttcaccacctactaagttcaaatgtagtatctgtcttctgtattttctcctgttcttaattttgtgaattgcttaattgaatatttttgagcacccatttttgtgtaaaatactatgctagataaaattagagattgagagatacaaaggaggtgtaagaaagattgtatctggtttattgagaaaactacattatttgtaagtacaaaatatgagctagcatataattaagtgctagtttatttgtgcatgagacaaatattaaatactattatctgtcagctttgttagagtcaggagatgttagaaagcaagattaaagataattgagacagtaagaaaatacacaaataaaagttgactccaagtatgtggagcctgggctactatggagattaataacactactcacagagagatagggaagttgggatgagcatgctgatagagggatagaactgaatagtgtccttggacagaggaaccatccttcaaaaagtgccaagaagggattgtgattttttttttccctgggttgaagaaacttgtatatctttgaagaacatagagaaaaaagccaataagaagaaagaaatggaaatgtttaagtaaggattatctattaggagcaaaaaaatgcataagaataaaggagttaatcccacgtggttttgtttctttggcaaattggaggagaggtcatttactggaagtaatgatagcagtttgcagttggaggcttaagtagagaaaaggtaacatttacatagtcatcatagggaaatttgaaaggaaatcagcaagatttcaataaaaggatagatgggcagtagagagagtttgatt

SEQ ID NO: 94347 - DNA, 1020 bp, Homo sapiens
atgcaataacatatatcctacaagattaaaaaccttttgctcttgaattcaagtacaataaattagaagtcttatctacagaattcagttgattttgttaaagaagtcatcaggatatatcaacattactttcctttaagaatgccttgagttaaatattaatattttatttttgttgactagaaaatgaatattaattcatttaaggtttatatttagttaaaataatttttatttgtagtgtttttatcatttcaaatgttctccttttaacatcatattggcttttcatattttatatgggttatataatacttgggctaatattgtactatagtgaaatagatttttaagtattagccacttttttggttgtttattttggtcacttttctaaaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagaggtttgtaaaattctttcagtatattgtgaaagtttgctttccaaaaaagaaaatagtagctttaggaacttttcagaaacgatactatttcttagagacaggtgatacaggagtgtctttttttgtgtggaacacaggaacctgaaaggatgtataagaaccccaaattgctagtaaacagattgcagttaggttttctcttctccttttcttttaaattagtattattctgattttcttcctgtgtgtttttcaagtcatccccacagctttggcaacaatacaaaagtgtgaaactgaaaatatagttgatgtaagtggaaaaatcattgccgtgaagcataagaatttgcttaaggctaatttcgtagttttattgccacatgttgaggttggaaaagtaagttttaataaaaggagaataacaggtgttctgaataaaatgtcccaaaaaagatctcaaatgaggtgtgattttaa

SEQ ID NO: 94348 - DNA, 1523 bp, Homo sapiens
ttgcactagctacatttcaggtactcagtagctgcatatagctaatgatcaccgtattgggcagctctcatatagaaatttgatctgattattcagcttcaaagtgtgaatattttattcttttttccatcttgacagtctttctcttttttagccttcaaaagcctatgaaatttattctgtatccttagggaagcccaacctgtttataaaacattttgagaatgcttagcttctaagagttaaattaaggtgtgagatttagtagaaatcgtgtgtgttacaagagtaaagggaaaattttcattgatttgtgttgagattgtgctaaaggacgagctcctaaagatagtacaagtaaaaaacaagtggctctggcttagaaaagggaagtatatctatttagtctaaactgaaggcagagaaagatacggcagttgaattaaggaactctttggtgagtcatagtcattacctttgataataattatgctgttttgtgttctgataggttcagaaactgtgtaggtcaacaattttggtagtgttaaattttaaaattgatgttactatacctgaaaagttaattatgttatatatgctatgaatttatgattagaacgtaattcttaattgttcttacaaggcctgtcaagtattatttgctagaaaaaaattcttgagtttaaacccactaagttttattccatccacccaaaactctgacttcctaatcacagctaggaattatacatttctggtaatttagttttaaccattttattatcctaataattctgtgtttacaagatatagaactttctgcattgatggaagtgtatttaaattgtatagtagtagaaaatatagcattacagtttgataaaataaacacgtaaagcataaatcagagccttataagtttcatgatcaaagagctagtttgtaattttgtgactatattgtcctcactagtagttcagtaattggcccaggagatgcatctaagttagacaaggcagtgctgtctattttgtaggcactttgcatttgttagctgtaagaatacagtgatactagcagttggtttgcagcattagagatgtaggtgaaggtggagattaaaatgcatgttaaattgttaatgctgactggaaggaaaagattgttttgcattttaatatttttaatttatataaagctttttaaaagttacacaataaagaattaccccctttattccatttggttacgtgtgtactcatgtatatattttttaagtttgcctctggtaactttgctctgttagaaacaaatcaaatatttattagattatgttataaatgttgaactgggccacaaaagtgggtttcttttattaagcttgataggatgaagatgtgagaatgaattgtaagcttgaagtaaaaattgcttaaattttttttccaagaagaaaggctgtgttgtttggtaatagtcagggactgactgagcattttggctgtattccgaattctgcc

SEQ ID NO: 94349 - DNA, 1075 bp, Homo sapiens
acatgttatccaaattagtgtattttcttcagcccataccccctctcagtcaaaacaaacaaaaccaaaataaaaactaaaatcaagtagctatttttatagaggaaactattaattagatgtgtgaattagcagcttagtttttagagataccatgggatgtttgattatataaatttaaaaatgaaaaaaattgcgtgtaggatggaattgtttcccatcgtacatacatttggtaagtacctaccaagttactgggaccaggagtggaaataaatggtctatgttctagaagctcttatggtttggtgaaggatacacagattatggggaaatcatgtaataattagtatgaagtaaaaatatgtaccaaatgttctggcatataaaatttggagccattaattattcttaaagttgacgtataagtgagagtgggggaccattgatgattggatcagggaagactacacagagatgataagagctgtgcctaggattgtgattagcaagtagttcactagggggatgaggaggttggggaaggaggacagacagagggagtagtattaaggcagaggagttgtatatatgcatatttgggaagaatggtgattaatggctcagcatagctagaaagtaggttgtttcatggagagtagaaggaaatgtctgataagaagatttggactttttcatagacagattggcccagtggtgaaaatctggcccaaagaagtgatttttttccagttgaatattttaagaaaatcttagttgaatgctgttggacagggaatattctctccatttctgttatagattgttaacttttacctgacttgttatatacatttattttaacagcctcactgtaacagacatttaagattctggtcttcatgaacttgcacagtggaaaaccatttaaattttataaggagatgaatcataagatctgtgttttaagtaagaaaacactaataggcctaagaggagccaaacctattaggagccattttggctacctttgtggcatgtccctgtatcaacctgatttggcaggttcttgatt

SEQ ID NO: 94350 - DNA, 1019 bp, Homo sapiens
tatttcctaagcaaaatggtaggataataaactgacttctcttttggggaacctacatgacagaaagggtagccattacagtagatactcagaatttgttcccctgtgtctctttattgtgcttatttttagacggaagattttgaatttgtgtgctaaaaatgtgtgttcacaaaaatagggaaatatattactttagttttccactttaatggtttttatttgaatgattctttttccagaaaaatttagattttttttttgcatcctaaatacttagctgaggtgctaaaaacaaatacgttaatttccacttcaaatgcagttttatgcttaaaaaatatatgtatattttgaaaatgacggtattccaaaatagtgtttgtcaggttgctgtttttcatgaggactagctcctttccaaaccacaaatctgcttctgtattttcagttccacctctcagtttctttagattttttttcggtgtcctaattctgttgtaaatgacctataaaattaaaggaaaagaaaagaaaaaaaaagtatacttttgctttgtttgaataatttgctaaaataagatcaaatttatcttaataaattatttaactgatagggcaacaaaatatacattgttttataagctgtattttgctaattttgaagtcattaggatttctgttaagcactttacttagattaatgtatgctttaatgtactctattataaagtgtcagttgtaactctatacctagtaaatgtaaaagttaggcctagtctaatttctacagtacatttagttacagaatttgtgagcaagaaccctttgtaaatgaaactatttatatattttccatgtttcttgtgcttggaattcaatgagtgtcttggatctgtgggtttatagtttttatcaaatttagaaaagtttcagtcattattcctagaagaaaatatatacatatatatatatatatatatatatatatatatatatatatatatttatttatttat

SEQ ID NO: 94351 - DNA, 1269 bp, Homo sapiens
ccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggtaagtggggtgtcctttattgtatattttgctgagttatttgtggctgcagagatggaggtgggcgttcatgtcgtggtgatccttctgtttgttctaggttaaaacgtttggacctctggccgcaggaaatgggaccaaccttgatgaatatgtggctttggtggatggggtattcttgaaccaggtcatgctccaaatgtaagttcttccttctttcctaggtaacgttttctttgagaaatagcatatggtgaactttgagacacgatgttttaagcccctaatttggttcattggccagaaatattcaggtggtttaagaattggatcttgaaaggaatgctaatgttatgggctcagcccattatcacaacctagatattttacctgttaaaattgtgaaactttagtttttcattctgtcaaccatgtattgtcacttgtcttcagtactgaaatccaagccacattgtgtattctttgataatttggtaaaataagagagaaaatgagaatctggtttcctaagagaggaaaaaagactttactgtgaagttatgtgcatttgatgcagaaatgtttcttattaacctttatatctagaaataaatggctcaaaatttgaaactcgttaagtaatagcagatttcagaagagaaaatttcaaacagttctgattggtgaggactcttgctgtagtaaataatttaaatgcctgtaataactaaagcctgatgagatgatttattgtgtgaattattaggttgcttaatattttagggatcattttaaggtattcttacaggttttgaaatgcaaataacaagtcttgataacaattagataacgacttattgggcaaatctttgtcttttgtgtttataatattgggtttgtactaagtaggaaagtatgcttttgagat

SEQ ID NO: 94352 - DNA, 1012 bp, Homo sapiens
tacaggcgtgagccaccgcgcccgtctactgcgcgttttctaaaccttggctcctacgcatttatcagaagagagagcgcaatctgtctatgacttccagccaatagctacacttcttttctcagccctcgtccactgttcttttttaaccaatcagaaacgtttttcaaacgtttgccctccccgctaagtgcgcaggctcctggaaagttgtcttcacttccgggccgcggtctagggcggctacgtgtgttgccatagcgaccattttgcattaactggttggtagcttctatcctgggggctgagcgactgcgggccagctcttcccctactccctctcggctccttgtggcccaaaggcctaaccggggtccggcggtctggcctagggatcttccccgttgcccctttggggcgggatggctgcggaagaagaagacgaggtggagtgggtagtggagagcatcgcggggttcctgcgaggcccagactggtccatccccatcttggactttgtggaacagaaatgtgaaggtaaaaaccagagcccgaaccgacaatccttttctcctctctcacaccagcggcgggcagggggttggtaaccacaagccatctctcgtctccccgaccccctgtctccacccctgtcgcaaggtctcgttcccctcaccaccttctccacccgcgtcatcaggtttagagctggttgtgtgggaggaattcctttcaccctgccaatgtgttccttcgcagacctgaaaacggggaccgagactccccttctctggggccgaagcgcacgtccgaagaacattagacttgaatcgtaaattcggtctctcaccctgtcccgaacgtttctgccctcggcaggtggactgtttggctgggcttcttcaacagctttgccagacttgagaggagaagcgtcggtttacctgagttccttatgatccctagcatttcgcccggtgtagtcagcttaggaaatgagaaatgatttcac

SEQ ID NO: 94353 - DNA, 1026 bp, Homo sapiens
gtatatgctttatttcctgctgcagaacctgaactgttccttacctattctttgtgtaattaaccttccattcagcttaaagaggcttagccagccctgctcataggacactacactttgcctttctaacagtttcgtctttgggccctctccactagccccatgaaggcagtgaccctgtcaatctagttgactcctgtatccttagtgcttagcacaatgcctggcacaaacagtaggtaaccgagtttgaatgaatgaacatactatcaactagtttccttctataccctctttccaagggaaaacatccaggaatttgtattaaactaatcagtatgagtagctgccttccctactgtcctttacctaaagtgtttaagatatttggatttacaaaagtgttcgaaactaaaaggctcagtgtaaggactaaataatttatttttaagacaatttgaacttccattttgttaaattgttcttaattattacttattaataacttcttctttgagtttctctgcaagcaatctcctctttagtaatgtttgcttctcctctgctgtcatttctggtttctctgtcatttcctgaaaaaaaaagaaaaaattggctacagtatgaaatagggtaatttgtctaaaattcccaacatactgcctcaaatgaacaaaaatcgggggcaccttcttgtgggacggagggagagacagacatagactaggtttcctaaatctcttcttcgtaaagtctcttcttggagaacccctctgggaagtggtggctgatgtgctctatgataaaggtggtactgatgctgctctatgataaaacatttcagaatgcccaggtgaaacagaccaccaaccctgacatactcagagaagggcaagtaaagaaacagcataagaaaaaaatgtataatgacaccgctattttctgcctcaaaaaatccttatcacaacaatttcacttcctagaaaagacttagcagctactgcactaggaggtgattaatatgaa

SEQ ID NO: 94354 - DNA, 1382 bp, Homo sapiens
ttaaagtgttacttatacagaccaaccaagaatagtgctgaattaagtggcatttagtatctagaagccattttgatccaagaagctacttaagtgtcaaagtcagcatgcagcacatgtagcttttctgtaaacaagggtgtgatatgaaagctgcttttttaagaagagtaaaagcacattccatatacgtaagtgaattttaaaaataaattgaggcaaacagttaagttttatttttagagcaacaagttaactgtaaatattttaatgttagtttgctcatctatgatctgagatcatgccgaagtgagaaaaatctccccaaaatacaatttaatgcattgggaaaaaaaaactttaacagtaattccagccacaatctttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattccataattgatgtttgtgtttggtttgttgtaaatataaattaactccattttgagatatgtcaattttacagtatcttttaaaagccaataaaattatccataaatatttattataaactgctagatcataccccaattttaatgaaataattctaaacaaatgcgggtcaatggcactttatcagtgactacttatagaaggtaagccttggggaaatcatagcatcacagtatggagcttttctcaccttttcaattaaaggtgtacatatagtaagaaagaaagaccttccacctcataaggcaggtgactcaggatattttaaactaagatcagtaaagttcccatccactttctttgaatcatcaaattttatcgagacccatctctcagcttttagtaaatttcttcttaaaataagcccacatgtaaaacactttcctagttactttttgtttgtttgtttgagtctcgctctgttgcccaggctggagtgtagttgcacgatttcggcttattgcaacatccgccacctgggttcaagcaattctctgcctcagcctgagtagctgggattacaggtgcccgtcaccatgccaggctaatttttgtattttcagtagagacggggtttcaccatcttggccaggctggtcttaaactcctgacctcacaatccacccgcctcagcctccctatctctgtatcttatg

SEQ ID NO: 94355 - DNA, 1053 bp, Homo sapiens
gcctcagcctcccaagtagctaagattatagacatgcgccaccacacccggctaattttgtatttttagcagagacggggtttctccatgttggtcaggctggtcttgaactccggccttgggtgatctgcctgcctcagcctcccaaagtgttgggattacaggcgtgagccaccatgcccgggcagcaatgttttataagttttttaattactgctgtttttagatgttttgacttagcagtatttattgatatacgttcaaaattttacttttgctttagcaaaagaaagtgaagacaaggaaaaccttcccaaaaggacatctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaaggtaggtgaaacagcattacacacaaactttgcttttcccgtctgtgagattttttcatgtttactgaaaaaaatttggataatcaaaacaatttcaatgaattgtttagaatttttctgttaccaaaatgttgattgtagaattttattttattttattttattttttgagacagagtctcactctgtcgccaggctggagtgcagtggagtgatctcagctcactgcaacctccgcctcccgggttcaagcagttctcctgcctcagtctcccaagtagctgggactacaggcgcgtgccaccacacccagctaatttttgtatttttagtagagacgaggtttcaccatgttggccaggatggtctcgatctcttgacctcatgttccgcccacctcggcctctcaaagagaatttcattttatttaggcttatgataataaatgtaagcatccttcctccctgtcccccattctattttggagcacttaagttgattctaatatttcactgactacttagtgttactgcattttaaattattttcttggatagtttagtagtagaacgtcttc

SEQ ID NO: 94356 - DNA, 1094 bp, Homo sapiens
ccctctaaccagccgtgtgctctggatcaaaccatccagcctctcttagagcctcaattttggtttttctctaaaatgggaataataaaacctatctcatagaattgttgtgaagatcaaatgaaattttatgtaaaagtgctttttaaattgtaaactgctatatatatatatatatatacaaaaaatagaagatgtaaaataaatctatttacttttcgaatgctctttatagtcctataaaaggactccagtaaattgcttctccttttttttcaagttttctgtgcagtcctgactcatgtgtaaagaaaccaggacattacattttggaaggtgattttgaaaaaccttttttgatcagctttagaactacaaaacaaaattttaaagtttttcttctaacaagcattgtattatattttaaatgtaaattttgtgcttatacaggaagatatcaagtctcttactgcccatatagttgaaaacttttataaagcacttgaatcgattgaatatgttcagacattcaaaggattgaagactaaatatgagcaagaaaaagacagacaaaatcagaaactgaacaggtattgtttaagtatactgcttttatagcctacaaaactgtgtccaaaattgtttgtagttcagattttccatgtgaaatttactgaggaattttctttccatcactggatagcatagagttgaataggagggtaaggcgtcccccctaccccatatcatttatatgttgaattactactccatgttgtaacttacgaagaatatttagtttaatttacaacatcctaaaatattttggagtgttctctggctacatcttctatcattacagagattattttgatataaattatagtcagttaaaattacttcagttcatcttggttatacatatttttccttcagttcaatctgatgatgaactttaaatcattactcaatatttgtgatatatttcttacagtgtaccatctatattgcgtagtaacagatttcgcagagatgcaaaagccttggaagaggatgaagaaatgtggtttaatgaagatgaagaagaggaagga

SEQ ID NO: 94357 - DNA, 1095 bp, Homo sapiens
ctttgtctcaaaaaaaaaaaaaaaaaaaaggaggaaatacagtttagattttgttataacatataggatgtaagctttatttattctttatttagatatattcaatatttattttcatgagattactttcttttgtagataattatcaaacagcacagctacttgccttaattttagagttactcacattttgtgtggaacatcacacatatcacataaaaaactatattatgaacaaggacttgctaagaagagtcttggtcttgatgaattcaaagcacacttttctggccttgtgtaagtataaaatgttttaaggagcaacatttttaatagagataaaactgaagttacccatttgaagttatttattagcagtgtatattctatgaatgagatgattgtgagaagtcctattcttttgttcttatttaaagggcaagaggactaggttgtagtgattttcccacccacatattgctcacatttagatttaatgagcctaacttttgttgtgatacattaccatgtgcagtgacagcattttactaacagaaccagtcctgctgtttttttacatctacttcatcaaactgtcatttagtagtcagtcactctttataattatcctgatatttgcatcaatgttgatttttagcagactataaactgtcaccttcataatttcacctgcaagcagagaaagaaacatcctccctccaaatgaaaagtactttgtggttttattctgaccataaaaattatattttaaatatagacatttaatttaatgtatagagaaaatgttaatctccctaatctttatttttatggacttaaaatagccagtgttaactgtctgcattatttctttttttcatacctgtaccaatttatgtaataaacatattcacacatgtatagaggatttttttgtgttttttatatttacaaaacagtatcataccaacacatttctcagcccactaatactactctagattaatcaatattgtatagactaattttattcctggagatagctgagtaagattttatagtatggctcttccacagattcttctgccattctcc

SEQ ID NO: 94358 - DNA, 1090 bp, Homo sapiens
ttttacctcaagtatttatttgtgttgagaacacttaaaatctactgtcttagcagtttgcaagtgtaatacattgttagtaatatgttgttattatatatgttgtacaatagattggttcttcactgcgtttcatattcgtatcacaggcatctttttaaaaaattattttgaataattttcctcagaaaaacattttgtgatgctctctgatctttatcttgccttcatttttacttagtacataatatgaagtagacttaattttcagttccacagaaataagattaaagtgaatatagttagtttttggttctttgacaacgtataaccaagtgtttgatttttttcacagtattttaaagtatctgcttatatatgatctgtactgctaattctttttgttttggtttggttctggaaaaggtatgtactgctaatcttgaagatgtttttatttacataagtaacagtattgtttaaaaaattctatgtttcagaaaaccgaaaaaagtgaatttctaaattttttctacaaccattgtatgcatgttctcacagcaccacttttgaccaatacttcagaagacaaatgtgaaaagggtagggtctctttatttatctgctgtgatttctgtttttaaagaaggatgagataaatattaaactaacaggcaatttacttgagactttataagacagggagattacgactgaaaaacttaaactgcaatataaaattatgattttcttgtttcttaaggttatggaagtgaatgataaaatgtggcaagactattctttcgggggccatttctatagtttgttgctacggaagtttctctgaacgtgtagaccactggcagaaaaaaaagaaaatgtggcaaacagtattacacactaaggaattgatatgtagacacttatcaaaagaaagcattgtcgccaaatttgtgcgatatctagaatgagtagaagcaaatagtataaatattttaacttagcctccaaatgcacattcatatgccaatatgtgctaatatataggggcaaggctttttccttagtatttttaaaattgcatttccat

SEQ ID NO: 94359 - DNA, 1092 bp, Homo sapiens
attttttcttttttttctttttgttaggaaggatttactagttagaggctgagataatttatgtcttagggtcatgtgatcttgcttgtttagtcaacctctaaatttacgcctgagtctgaaacccaaaatgagattctgttagaacctctactgaacaagaactactgctaaagaattttgttttccacttcctataagttgaagcatgctctgcttttgtgggttttttttcctccttcttcttttttttttctcggagtgggattttttttcactctagtgtgtagtattttatagaactttcaaaagcattaggaatagaggtttaaataagctattccattcttcgttttttctctatataattctcactttgctctttcagttggtgtttttgtcttagatctaaaccaggtctaatggaaacatgttttgttttgttttgttttgccaccaggatattcttcttattaatgtggtaattgaacaaatgatctgtgatactgatcctgagctaggaggcgctgttcagttaatgggacttcttcgtactctaattgatccagagaacatgctggctacaactaatgtaagaaattactctgagataaaaatgttttggcctagtcagttttaggtggctttgtaataagattttgagaaacaagtattttaagtatttgtccagttggtatttaagtagcagtggtattcttatagcaattcatttgtggtaaaatacaaaattgtaatccgtcaaaatcttagtaaaatgttaggaattccatttatggcccttggcctctatgtgttaatttcttaaaatttaatacacagcaatgtgattatacttaacactactaaactgtacacttaaaaatgataaaattattattatttttttgagacagagtcttgctctgtcaccaggctggagtgcagtggcgtgatctcagctcactgcaacctccgcctctcgggttcaagcgattctcctgcctcagcctcccaagtagctgggactacagacgcacaccaccacacctggctaatttttgtatttttagtagagatggggtttcatcatgt

SEQ ID NO: 94360 - DNA, 1257 bp, Homo sapiens
atgcgtgcttgactatatatatattatatatatataatatattaaatatatatataaatatatatataattatatatattttttatatatatataattttttttttttttgagatggagtctcgctcttttgtccaggctggaatacagtggcacaatctcggctcactgcaagctccccctcccgggttcacgccattctcctgcctcagcctcccaggtagctgccactacaggcgcccaccaccatgcctggctaatttttttgtatttttagtagagacagggttttaccatgttagccagggtggtctcgatctcatgacctcgtgatccgcccgcctcggccttccaaagtgctgggattacgggcgtgagccaccgcgcctggccacttgactatatttttctgtttgtccttttagacaacgcctgtagaaattagcacttgtctttctttttaataccccagagtcattagtatgaaaagcagttattgtagtgctttgtcatttagttatatccttggggaccgcaagaacgtgtaaaactgtgcaccagttggttgtaggttgttgtattttatgagttattgtattttaaatagctttgtaactttatctactgtcggaattcagcctcctttactgttttccttgttccttgtcttacaattcttgtttttctaatctgttataaactgacaataagatccttaggcttgtttgaattatgtttaaattaagagtaagtagaccctgaaagggggctagagaatctaagttaagtgagttttcacgtaacacctctagaacaaatatttttgttttccagagagttatttgtagttgaggtttttagttaaactagatattgatgtatttataacaagaattgaatggtgtagtcaaattttagaaaattgtaacacagaaatacaccccagaatattaggtttcatgatgaaaatactacttgtcaactattttttataatttgtgtaagtcatataaatgagtataactttattcttttgttaatatttcatagtaattatttttctcatgcaggaagatgagaagtttttgtctgaagtttttgcacaattaacagatgaggctacagatgatgataaacggcgtgaattggtaagttatgaaattcaaactcttaaagagcacttattcttttggcatgcacagcttttaatcttgaatttgctaacttgagacaattttttgtaattagattagtaaga

SEQ ID NO: 94361 - DNA, 1005 bp, Homo sapiens
tttatgttgtccagaaaagcagccacacaagttttgacttaaatatataggttttattaaaacaaaagctgttaaaaccaaatagaaaagaaaaactaaaagagattagtttgattacttggagaaccagagattttggagtaagtatttcaactatatgataggctttaagttattgattatttgcttccttcataaatatattggaacagagtgcttttatagcttaatgaataatagccagagtaatgctggaaatcagggaaaaaatactaggaatacatattctcttaatggactgtaataattgagattgcctctatctgtaatattttatgcagttctacttatcagctcacaagtaccgaatcatataagaagaattcaagtgggaaattgcatttatcaaggagttggaacttttttcttatgaaaatattttgaaaaaattaaattttcaggtagtaaaggatgaagatgtaatctacaacagatgcaggaaaatagaaatttataaaaggtgtgaatggaggtaaatatgtacttactcaccctaacctaaaatattaagactaaaagtatttggaaaaagtaggctgggcatggtggctcatgcctgtagtcctagcactttgggaggctgaggtgggaggattgcttgaggccaggagttcgataccagcctgggcaacaaagtgaaacccccccatctgtacaaaaaattaaaaaaaaaatagccaggtatggtggcacgtgcccgcagtctctgttacatgggagtctgagggaggaagattgcttgagtccaggaggtcgaggctacactgagccacgtttgtaccactgcactccagcctgggcaacagagtgagactctagaaaaaaaaaaaaaggaaaaactaacttgagggctaaataaaagattacatatgcatataaactccctcaaaagatggatgttcaggctgcagtgcataaggtccaaaaggagtcaatgaaatacga

SEQ ID NO: 94362 - DNA, 1070 bp, Homo sapiens
ctctactaaaaatacaaaaattagccaggcacagtggcacgtgcctgtaatcccagctactcaggaagctgaagtgggagaattgcttgaaccgagaggcggaggttgcagtgagctgagattgtgccactgtactccagccagggtgacagagcgagactgtctgaaaaaaaaaaaaaaaaaagtttaaaagggtcctgatacaaataattgagattctatctctgacttagtgcctagctaatcgacttcattttgcgacgtttcccaccagtagtcacctattattgtttactttaattttttgcataggatttacttttctttcaggtcatttattcacctaccaattttttgttattcaccaataatgagtgtgggggaggttagatgtacatatcaggttctttttataatatataggacctgtgtatttttaaactgtagtatacaattcagggtgctatttcacttgttgacagaaaaacatttaataatcttaggagattggacagagtcacagtctgtagttgataaaaagaggaccaggaacagaagctcatatgtagctttcaaatgactgtttttgtcttcagaagggtttccaaattcatactagtaaatcgtaaatacttttttatattcagaaaataaattatatgaactataaatatttgtaaaactttgtcattttatgtattttataataggtttatttgtgaaggctataattacgtaaatcaagtgcagctttttatttttctaaaagatttactcatttctgcttcatgagatgcatttcatgaaatagccagattctgtgaactgtctgttatttacataacatttactacttaattatctcttatgtgccagcaatgatgttgaatttttttttttttttttttattttagattcagagggcacataggcttatttgttacatgggtattgcatgagtaatggtggagattgggcttctagtgtacccatcaccgtgatattgaacacagtgcccagtagataatttttaaaccttcagtcctctcccatcctacccctttttgga

SEQ ID NO: 94363 - DNA, 1299 bp, Homo sapiens
tgcaacctccaccttccaggttcaagcgattctcctgcctcagccacctgagtagctgagattacaggcgtatgccaccacacctggctgatttttgtatttttagtggagttggggtttcaccatgttgcccaggctggttttgaactcctgacctcaagagacctgcctgcctcagccacctaaagtgctgggattacaggcgtgagccaccgtgcctggcctagacttcacttttaattagtagtgactagccaggcatttccaaatgatttgatttccaaaattttgaattattttgtattttaaggtaattagctgtatacttggatatttttaggttcaaggtaaagacccatcagtggaagtcacacaggacctcattgatgaatctgaagaagaacgatttgaagaaatgcctgaaactagtcatctgattgacctgcccacatgtgaactcaataaacttgaagagattgctgacttagttacctcagtgctctcctcacctatccgtagggaaaagctggctctcgccttggaaaatgaaggctatattaaaaaactattgcagctgttccaagcttgcgagaacctagaaaacactgaaggcttacaccatttgtatgaaattattagaggaatcttattcctaaataaggcaactctttttgaggtaatgttttctgatgagtgtatcatggatgtcgtgggatgccttgaatatgaccctgctttggctcagccaaaaagacatagagaattcttgaccaaaactgcaaagttcaaggaagttataccaataacagactctgaactaaggcaaaaaatacatcagacttacagggtacagtacattcaggacatcattttgcccacaccatctgtttttgaagagaattttctttctactcttacgtcttttattttcttcaacaaagttgagatagtcagcatgttgcaggtaagtaaaaagatactcttcacgattccatttttcagatatttagttcccttaatagttcaagcaggtgtttataccctctattttttgaaagatttattttgtttaaatgtactattaagtacatttaaagtaaacaaaagaaattgggactttatgtcttgtggttttagtgcaaccttttatttatttttttgagtcggagtctcgttctgtcgcccaggctggaatgcagtggcgcaatctcagctcactgcaacctacgcttcccgggttcaagcaattcttcttcctcagcctcccgattagctgagactacaggtgtgcactgccat

SEQ ID NO: 94364 - DNA, 2493 bp, Homo sapiens
ggttaaattttttgtttccattagcgggttttttattaaaaacttaatgagtaagtgaatgagatgtttataggccattttgctgtattaaaatatgttgactatggcaggcatggtggctcacacctgcaatctcagcactttggaaggccaaggcaggaggatcccttgagctgaggatttcgggaacagcctgcacaacatagcaagatccctgtctctaccaaaaaaaattcaaaaattatccaggtgtggtggtgcgcagctatagtgccagctacttctggaggtgagacgggaggatcatttgagcttcggaggtcgagactgtagtaagccatgattgtaccactgcactccaggtggagagacaaagcgatttttctgtctcaaaaaaaaaaattgagtaaattcagaggggaatgtttaacattcttcttttaacattatagttttaaaatgagccaactactaaattgtgtgctcaagatacatcttttctttcataaatgaagtaccaaattgtgagcctaaaaggagttagaatgagtcaagctgaatgtcatatgactggatattgaaaagtcattattgattcacatcactttcttccttactgtgcatagtactgaagtcgttaatggaagaagatgtacttacccaataaacttaagcatttaaacatgttggaaagagaagagaatcattatatgatacaacatgaaataacatacctgataggtgtgacagaaattttaagttacttcaaatcagtcccactgatactgactaaatcaaaagcagagtcaaagccaggtgtggtggcgtgtgcttgtggtcccagctccttgggaggctgaggctggaggatcacttaaggccaggagtttgaggctgtagggtgctatgattgtgcctgtgcgtagccattgcaccccagcctgggcaacatatcttaataaaaaacaagagtcatactaggcacagtggctcacacttgtaatctcaacactttgggaggctgaggcaggaggatcactttagtccaggagttcaagaccagcctgggcaacatactgagactctcactgcaaaaaatataaattagctgggcatggtgacacacacctgtagtcccagctgcttgggaatctgaggtgggagaattgcttgagcccaggaggtcagtgcttcagtgagctgttactgtgctaccgcactccagcctgggcgatagaggaagactctctcaaaaaaaaaaaaaaaaccagagtcataagaatgtgtacctatttaacacaattgtgtgttaattgggtttaagaaaatcctcattgcagttttatttggaggcaggatgtaacagatgaaacagataaagaatgataataagatagcttataacagtgttttaccacagtcttcactgaaagcccgtgaaagcatttcacacatgaggcaacaaaggtacagaaagggtaagattcttgactgagattatacagcaggtatgtgccaacacaaaatataaaaagtaaacttgcattttccacagacttagagcagtagaaaattaaggaagaggttaatataagctggaatcattaagaaaaacttcattcttggtggtggtagtggaaggaactgtgataggaaaggaaatacacttgctacaaaaggtattaagcctatttgtagcagtggtttctccccctcctaccaccaatcccaaatatgataatacacaggttcagaaggggacattacaggttcttgagtaggggcctaaagtgatactgtgtttaaagaaatgagtgtggcaatgtcatgaataataaattggggaggagggatagggtggagcagaagatctttgagtagcaagaccttttgcaataattcagatacaaaaaatgaaagtctattccaccacggtaaatggacttgaaggaacagagctccagtatattttccagaaagtgctggaaaatttagtaaatgattaaatattaaagagaaggaatcaaaggtcactgatagtgtttttgagtctggccaggaaggtgatggttctttccagaaagtgggaagttaagcaggtttacattaatcttttggtttgaggcttattaaaaaaaattttttttagtgtgtaatatattagcccagttaaaaattcaaaaggtatttattgaagtctctttcccacgccagattctgtccgtacagtttcccttgctagaggccactgacatcaccagtttcttatatatcttgctggaggtatgcatatgtaagcaaatatgcatacaattgtatgtattttttcccttttattggtataactggtagcatactgtatactgttttgtgctttgctttttttttcttttccatccgggctttgaagttacatacagtaaaataaatggaaagagtttttttgttttttttgttttttttttttttgagacacagtcttgctttgttgcc

SEQ ID NO: 94365 - DNA, 2202 bp, Homo sapiens
ggaatagggtgaaatattttagattaaatgtgaagcctagatttggagagaaaatgtgaattcgaatacattttattaagatgtccaactcggtaaaaagacttgaaaagtttgcgggggcggggggcggggtttaaatgtgtatttttttttttttttttttttttttggagacagagtcttgctctgttgccaggctggagttcaatggcgcgatctgggctactgcaacctctgcctcctctccctctctctcaagcgattctcctgccccaccctcccgtgtacctgggactacaggcatgcgccaccacgcccagctaatttttgtatttttagtagagacggtttcaccatgttggctggaatggtctggatctcttgacctcgtgatctgcccgcctcccaaagtgctaggattacagacgtgagccactgcgcccggctttaatgtgtattctaatttttattcagggttttatcatttgagacttatgatgtattattttttatctttcaggatcactactcttggaatcaaagataaatccaaatactgcatatcagaaacaacaggcaagtagttgtttatctttaatttgaaagacttcatctgtgatcaaggaagtattaatctgacaaaggtgggaaagctttcctgacaagaaaaaaacatgtttggtaaacaaagatcatgtgtatttctcttgcaggttaaaagtttcagactgaaaaaaagtttttgtactggtgataattatcatttttggattgagccactgtcggtttattctaagatgtatttattagtattatttaactgtagttagccaagtctcttctataccttgtacatgaaaccttttattctgagtcacgtttaaaggaaatgacatagaacaaaattcaaagggatactcttaaagcaaggaaagcctgtttgtggtgtgaaattaaatcctttgactcaagtaaaggtagaggttttgaagtagaagcattaaatcctgctctttaattgttgtgtatttttaatatagtaatcaatggatactttataaaaatgtacattaccaagtatgtaacatcttctgttaatattgtcttatttgggaaagaaaatgtgtattgtattttagcacgcctgattaatctgaaaatggtagcagtgattcaatcttttttattctgtgaatgtttttgtttttattatgaaatatattaaaattgaaaagtacagagaataatcggtgtctactgtaacaccaccagatttaacaatgttaatgttacgccatatttgtttcaaatatttttgtaatattgaacattatggatagagttaaagcttgtttgtatccatcccgttgtttacattctccatcccctacataggtaaccactattctgaagttgatgtgtattctttgtgtacatgcttttataccttttctgcatatgtatgtatccataaataatatgtagtctgttgtgtgtttttaaactttacacagtggatgtcatactcttacatgtattctgcagcttgcatttttcacacattcattttgaatattcgttcatgttaacaatgtagatctagttttctttttaaactctgtatagtattcttatgtatgacatacacttgttgttatacatttgaattatttccaggtattcttttttgtgtgtggtatgtaaagtcacgatggcagagatttttgaaggaagataaattattttaggattacatttacagcgtcagtgcccacttcaaggtttatgaaaatttggatgcccagaaacaagtacttcgtagttggaggaataaaattctgtctgttgtgcagcttattattacaaagtcttactgttagaacaattatgtatataacacattcttaatcagttatttgaaatactttaaaattttcaatattcaattcatagcttttttctctgtttagaaaatattgtgtgtcttttttgatggagaagcaaattaaacatttgtcctgaattgaaaacctgaagatgtttcctataccttagacattgtaaggtagacatttaagtaaatttaatttctcagtcagccaggcagctcttaatctctgtctttataccgagtttttaccagatgatcacttttagtttgtttttgtttgcttgcttctttgtggggaaagaaatactaat

SEQ ID NO: 94366 - DNA, 1039 bp, Homo sapiens
atggtcacagagctctaaagatatttgaatgctcagcctagggagatccagtatgtagtcagggcgctggttggggaaaccagcctgaagctttgaaacatggaatgggtgcccctgaggattttggctctgtagatacctctggacactcaagagcttacagaactggctcatacttcctagtaagagcaagcacttccctcattacagaaagacctcttccataattgttctcagtttttctcctggctgccaagccatggtaactggagttaacatctcagcataatctgcctaggaactgctggccctgataagaaaggaaagattacacaccgaaggaattgaaataagttaccatgactatcaggagccagagaagtatacttaggattggattttaagggtgttcaattaagggggctggaatttaagacaacataagcaagacttcatggacttggggtacttttttgggacagatttaacctcagcaagtagtcccgaggttagcttttcaaagcctggaaaaggtgatggctttgaaaaagtggaaatgaattcacaccatggcagcttttaacttgaggagaagatagctatttattttggcatatttatgtggttactgctcacttactagtcccaattgttttgtaaccactttttatttattttttgagatagtctcattctgttttctagactggagtacagtggtgcaatcttggctcattgcaacctctacctcttgggcttaagccatcctcccacctcagcctcctaatttttgcattttttgcagagatggggtttccccatgtcacccaggctggtcttgaactcctggactcaagtcatctgcccattttggcctcccaaagtgctgggattacaggcgtgagccaccacatcgggactgttttttttgttttttgagatggagtcttgctcttgttgccaaggctggagtacaatagcaccatctcagcttactccaacctccacctcccgggttcaagcaattctcctgcctcag

SEQ ID NO: 94367 - DNA, 1046 bp, Homo sapiens
ctgcctcagcctcctgagtagctgggattacaggcgcccgccaccacacccagctaatttttgtatttttagtagagatggggtttcaccatgttggccaggctggtctcgaactcctgacctcaggtgatctacccgccttgacctcccaaagtgttgggattacaggtgtgagccaccatgcctggccagatatacctacatttttataagatttaaaattttttttagagataagagtcctgctatgttgcccaggctggagtacagtagctattcacaggtatgattgttgcacactacagtgtcgaacttctgggctctagtgaccttcccacttcagccttccaagtagctgggactacaggcacgtaccactgagtccagtgtatttttataagattttaaaaaagattacacattctaaattatgacgtccacataccatttacttttctgtggaattataaggtgatattttaaatgatgggaatgaacaacttgacatgtgtatcagtaacctctaaacatctatttcaaacatctattaaccgaaagtcatgatccttcagctcttatactaagaacttccatacattagagcaatacacatattcaaattgacctagttcaatttgataagtaaacaattttttttttttttttgagacggagttttgctcttgttgcctgagctggagtgcaatggcgcaatctcggctcactacaacctccacctcctgggttgaagtgattcttctgcctcagcctcctgagtagctaggattacaggcatgcgccaccacgcccggctaatttttgcacttttagtagagacggggtttcaccgtgttagccaggatggtctcgatctcctgatctcatgatccgcctgccttagccaataatctttctgtttaggtaaatttgaaaaatatacatcattactaccacattcatcctagttagaatctcatttatatttattccactctgtttatgatttggtaactaatttgaaaggcattatattatcaaaagtgtat

SEQ ID NO: 94368 - DNA, 1157 bp, Homo sapiens
agttctcaaaataagacatataaataggtttatgaacatgaaatagttttcaacctcagtcataaaaaacaagtcagatttaaaataaccattttttacactttaaattgagaaaaatcaaaagatttgacaagaattaataagaatatagagtagcatataccttcttacaccactggtaaaagtttaaaatgctatgtctttagaaggcagtttgacagtctaacaaacgtaaatgcacataccttttgactcagcaatcgcacttctgtgtgtgacttgtaaaacatacagggagtactaaaactattcaaaggaataaagtagagctttgtgtggtggtatgtgtcaatatccaagacatgttattaagtgaaaaaggcaaggtgcagaacagtaaatgcatacagtctgccgccacgagtaaagaaaacaaaagattatatttacatttatacttgtgcacagaaattttctaggaggatacactaatgttagctgccatggggaggtaaactgaggagttcaggctggaagaatttaccaaatagatgcttactttccaacaaaaagaaaataagacacctgaagcaaaaaagcaaaccaacggataatttaaaagttataaagtttgctattgttagagaagtttttgctggatatagtacttgtttacattgttttagggaactttattatatgttcaaaaacaaacgaagtagtcagatgacctcttaagacttccaactcagcttcggtgattgtcaatttaggcaacaatatccacttacattaaaagtaaatgtctgctgggcgcggtggctcacgcttgtaatcccagcgctttgggaggctgaggctggcagatcacctgaggtcaggagttcaagaccaacagggccaacatggttgaaaccccatctccactaaaaatacaagcaaattagctaggcgtgttggcgggtgcctataatcccagctataggggaggctgaggtgggaggattgcttgaacccaggaagcagaggctacagtgagccaagatcatgccactgcactccagtctgggcaacagaccgagactccctctcaaaaaaaaaaaaaaattgatagataaatatttgttttaggctcatgtacacattacccacagttg

SEQ ID NO: 94369 - DNA, 1017 bp, Homo sapiens
gggtattgctgttggtgtgatatatctataattcagctttacggtttatgatatctttatgatatcttgtgtaaatgatgcagaaatttagactaaataataggtgcaccattcatactggttaagggatgagcaaagggactgcttaatctgatcaacaggtcagagaatgatctcaagttgaagacgtgaggatgcttatttcagccctgtctctttcaatgttgacttgactgagaacactggcctgccagtaaaaatactgccaataaaaatactgattaaaaggaatgggtgactgacaaaattgagcaggataaaaaaatatggagcttaatagtttaaaaattaaatttgaagcgttaaagccaaaaacctcaaaaaaattaaatttgataagaatgaatgtcaagtcctgtgggatgggccgatacaaggtatgcagttcaattcaaatatgaatttgaattgctagagtagggcttgccctgccctaagtcaggcactgtcctatgccccagggatgcaaattgtacccagtttttgaaaaagcttaaaggtttgaaaacaaaaagatactaatagattgaagaggtaataatacaaatatgtgtaagggtgattgttgaactaggctgagcataattggctgagagagactgctacatttcatctgattttaaaggctgagtaattgttgactgggcatattaggagcagggcctgtatttcacatgaaaggaccagcatgtgcaaagttaagaagttacagtgtagtgtgtttcaggaatctactcgaaagaggtgttaaggtaataaagtagaaccatatgttgaaggttattgtttttttttttttttttttgactttcctttttatctttgtcttctctttatttcctagttgtttctagtcagaggaaggatagctttatacagaaataggattttttttttttaattttttttttttttttaaattgatcattcttgggtgtttctcacagagggggattt

SEQ ID NO: 94370 - DNA, 1541 bp, Homo sapiens
ggcgtgtgccactatgcctggttaattaaaaacttttttttgtagagacaaggtcttactatgttgcccaagctggtctcaaactcttggcctcaagcaatcctcctaccacagcctcctggtgttctgggatacaggcatgagccaccacgcctggcctttggtgtgttttttatgtaattttaacagtttttttgaggtataattgctgttcaataaactatgctgtttaaaatgtatgatttggtaacttttcacaagtatgcaactgagaaaccagcaagataatgaacaggccaggcatggtagctcactcttgtaattccagcactttgggaggcccaggagggaggattgcttgaggccaggagttcgaggttgcaataatctatggtcatgccattgcactccagcctggactaccaagccagaccctgtctcttaaaaaatttaaaaatgaaaaagataatgaacatatcagttacctccaagagtttcctcatgcctttttgtaatgccttcttcctgccccccacctcctcaggagactactgatctgcttttgtcactataaattagtttgcattttctagaattatctggtatttctgttgtatctttcttttaatattgggtatacaaaattgagtaactcagactctagtttatggcatattgtgattgttgacctgttcaaggccctcatttgttttctccatttagcctgtacagttctattctttttctattctttattctttacataggcacccactcttgtatttaacaggtagccttctggttctccttcttttcgtttattaatatttacctacatctgtattcattgttctgtgtaccatattatgctttatactcctttcccacattaattgtttctttaattctatcaatctgataggcaccaagtagtaactttttgctttaattttattttcctgattactagtgaggctcagcattatttatataacagccagtcaacatggtcactgcataaaccatgccctggggaactgcacacctccagggcactatttccacatgaatgttgtcccctagagttgtgcagtgtggtggccttgcctcaggtttgcccttttatgaattttctgtccatatcctttggccagtttttctttttttaatatggtttactgtgttttacctgctattttgtagtaatttctgaagtgttttaaatattaattccttttggtaacaaactttatatatatatgtctccttctttatttattgccttttaactttgcctgtggtagtctgctatgtttagagtaaacctgaaaacttagttctgatataaattcttctgtacctcaaagtcacaaagttactcacctactttttctattagctttctagttttagctgtcgaatgtagaccattagtcgatctttgaatttattcctacacgttgtatgaaaggaagacctccatagtgagccaattatacattatttactaatactttatttttctcaatgacttgtgatgt

SEQ ID NO: 94371 - DNA, 1016 bp, Homo sapiens
ctactcgggaggctgaggcaggacaatggtgtgaacctgggaggcagagctggcagtgagccgagattgcgccactgcactccagcgtggtcaacagagtgagactctgtctcaaaaaaaaaaaaaaagtattaaaaacaaatgcacttgtatactttaaaagatttaatttttattttatgtgacttatagctcaataaaacttatttttaaaatatgtgcatgatttcttttttttttctgtttcattttttatgggaaatccctccttaaacttaaggagaatgtaaacctaaatacagatatcaaggtgtctttattcatttaccgctgcttacattttggaagtatgttgattctgaggaaagaaatcaaggtggatctatcactaagaagtaaaattgatccataatatttatgtcatgtcatggtatttgaaaatgttatattactaagagcttcgatggcagtcattttttttttctttttcctttaaatagtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataagtaagaacatctgtgcaaatgaaaatatgaaattgtcatcagatttaatttcctcgtgggagagaaacttcccatggaagcactgcccatgcattacttcataaatagcacttttctgttttaagagtcattcccataaatatctgcttactcccttaaaaaggataagcccacatcactcttgtaagacctaactttgaatctcaaatgaaagagtgtgtttattggtcaagattcaggtaagcaccacatctctccacgtctaggaaaaagaataaaacgttaagatatttgaatatctaaggaaactgttggaattctcaaaaaga

SEQ ID NO: 94372 - DNA, 1279 bp, Homo sapiens
ttctgttagaggacttcttttttttttttttttttaactgggaaattatcagagtatatactccttcaggatgaaattaatgtaacttacggctgttataagttcataatcatgcaatataaaaatggctcagtgagtaaataattatcaagtgtcctaggcagagcaggccctagcaatacaacaatgaaagatgcagttcttgatctctgcataaaggagacagataattacttatgatcagtgttattataaagacatagtcaaagtgctaagaatatgatagagaagagcagatttgattttgtgtggtcaggttgtcaaggagggctcctcagagtagtcatttgtgtaagctgaaccttagtaggatctagtgttaagcatttgcgttagagagaatactgactggctagaccaggggacaaacatgagcataatcccagaggtgtggaagaagtggtatatttcagcaattcagagtgatccagtgaggacagaaggtagggtggggtaggatgttctgtgggtcttaaataccgtgtagaaacatggattttattctgtggtcacaatcaaagatggggttgaagccatgactggaataatgtcttgaaaactgggtatttccattaaacagttgccaatattctaatacattttaggggcagtacgaataggaataattgatggagaatatgttgttaacccaacaagaaaagaaatgtcttctagtactttaaatttagtggttgctggagcacctaaaagtcagattggtaagttgttttaaataccacatttgttctggattttacttacaagttctggcttcttaaactgaatttaaactctgtgtgtatgttttgtcggtagccataaaaatttttgtcatgttttatctctgtcctatttttgtgctcttgcttcatatcaaatgattcctaaaattacaggattttattcaattttatttagaatatacaaaaatatttaccaagatcatttcagtaattatttttagactaaattttaattattaaaattatgactaatttttagtctaaaaataatttcaataattatgtttagactaataagttattagtctaaataacttattttaaaaatagaagttctaagtctggtagtaaccattttattagtttaaacattataatttagctatttcattctaagtctgcttggtatcctcttgagaagtgacccatttctactaggtggaaaactggtaataaaatagaagaaatgcattgac

SEQ ID NO: 94373 - DNA, 1138 bp, Homo sapiens
gcccatgcctctactttgttgaatctattcctagtacattttttcatgttcagaatagtaattcctaaacattatgttcatcagctactgaaatatgtccataatctttcaaatctttaacatccctacatattgtgggatcatatgtaatttatagctcttctacccagaaattgcttttttttgagacagagtcttgctctgtcacccaggctggagtgcagtggcacgatctcggctcactgcaacctctacctcccgggttcaagtgattgggattacaggtgcccaccaccatgcctggctgatttttgtatttttagtcaagatggggtttctccattttggtcaggctggtcttgaactcctgacctcgtgatccacccgcctcagcctcccaagtgctgggattgcaggcgtgaaccactgtgctcggccagaaattgctattttatgtatatttatatacagtcttcagacacaaagtagcaaggaagcattttcttttggtctgctattggtcttaagtctctttgctctgcttatatatgtaactgttgcctgtggaaccagaatgaaaaattgctccccaatctttattgttaatgtgcttcttctgtgtttgttttttgttgttagggcatggtatgtaataatggaagcactgacatttatctgtgtccctcttagtaaatcagtccaaggggatttttcttgaaaacatattgaatggctatctatattagttcaaacgttttgaactgtaaagcaactctgtcagtacggtttaatgtgtttttttttcttttggcagatcgttcaattagaccgctctttccagctggctacttctatgatacacaggtagattctgctttaggttttttagttgccagatcaatcaaaaattacttaatgaatctctgtaatatttcctagagtaaacattataaagaacataagaattttttatgatactgttatattttacattacgtttttgaaaaaagatagtactttttttttttttttttttgagacagagtctcactttgtcgcccaggctggagtgcaatggcacgatctcagctcactgcaacctcaatctcccaggttcaagtgattctcctgcctcagc

SEQ ID NO: 94374 - DNA, 1062 bp, Homo sapiens
tcttagttcacagatccaaataataataatgtgttgttctatgacttctagtattaaaagtaaatataaatttactctgcatattaaacatttacattattctaggacttctcctttaaattacgatagtacacacacaaaaaccttatttatctaattgcctttcgttggcacataaagacaaagatcgtttgcaacataatcgcgttctgataggtttgaccctctctagtcttcgtagaaggtggccaaggtttccgttaccccggcgtccctcgggcaccgcggaaacgaaactccatcaggctccgccccacggtctgcggagtgagccaatcagggcacagcctgcgttgaccgcgtgccgggtgtcatggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggtaaggagtgacgtgcgttcactgtattgtcataaggtgtcttgtccagccagcttgagcgtattcatctcccagggtagaaacccggtatcccagctctatttaatctctccttaccctaaacctaaattccaaatttccctttccgggtttggaatgtgtctcctcggaccctccttcccgcgctatgtcgttctctctgttggtgtgtgccgggcttctttgctccatccgactctgtccgtccacctgacttccgatctctttactttccgggaccactgggctcttaagtgggaaacattccacctaggaataacgagttgacgtgggtgagacgaggccccccgggatgctggcccggaccctggaagctggggctctgatgcccctcgagctgggacacagacctcagcagaggctccgggtggctagtgcaccacgggtcccccacgtcccactcctcgggctccttcagcctcctcttcaccaggagcctaccttgtagaagttgaacaccaggtccag

SEQ ID NO: 94375 - DNA, 1027 bp, Homo sapiens
gtgagggggtgaatccaggggatcttcgccttggagggtcgggaatgcggctgctctgggccagcagctcttgggcgggcagagggcgaggaaagggcgccactgccagggagagcggctggcggggcgcccgggagaagcagcgggcgccaccctcagagcagtcttgtgtcaccgggtacataggagttcaagctctgccttcacgtcttctcccaattcctgtgctttccctctcccggagtttggaaggcatcccctggagttgccttactccccttcccacttaaccccaggttgactgggggaaagaggaggagcaaagagactcagtatggaaggagcagcattttgacagagtaccccaagtgttggtcagtgatggtttctttctgagccagcccccctgccaccctcttctaggaaaagaagggaaacgtaccccaagcccactaactttcttttctccttggagagcgccgggtctgcgaggagtgtgcctgcccagctgcagtacactagtggccgggaaccgccctgctggcgagcaccacaaacttcctctccttccagctagcgctggtgcctcctggtattccttcctctcattgttctgctttgtttgtaggaagccagacacaaacgaaatcactgcagggacttcagggagcaaattcccgaaggcacaagctgttcttttcccctttccactcctatccccacatatcagacagtagatgctgttccggaattgcctcagtgctccagctctgggattctggggcaagaaagagtgggaagagtggaatgctcaaggctcacctatgtgctgggcccagttcaggtggagatggccgtctcccgaggccgaaagtcattgtcatatagtccctagagtgggtgcaggtaggaagattcctccagtcagaaaaatgccaaggcttactctctcctgtggttgaattcattactaacagagtgtttattaagtgccagtctctttggggaatagaggcaggctagtgta

SEQ ID NO: 94376 - DNA, 1001 bp, Homo sapiens
atgacataatgcaagtaaagtattgtgcagggatagaactgatacttaagttagtttaatttttatggccatactaattattatcccctaaatgtttgggtaaaaattagatgacataatgcaagtaaagtattgtgcagggatagaactgatacttaagttagtttaatttttatggacagctacaaatcttcagcttcctcctactccctcacctcctcccctaacctcacaggtaattcaccagttacaggctctccctttccaggaagtctgagcctgctgacacctcagatgtgtacttcccttgaatggttgtgtctctcttttcaggatatcaaccagaaactccaggaagacaaccaggaactgagggacctctgctgtttcctggatgatgaccggcagaaaggcaagagggtgtctcgggagtggcagagactgggtcgctacactgccggggtgatgcacaaggaagtggccttatacctgcagaagctgaaagacctggaggtgaagcaggaggaagtggtgaaggagaacatggagctcaaggagctctgtgtgctactagatgaggagaagggtgcaggctgcgcaggcagccgctgctccatcgacagccaggccagcctgtgccaactcacagcctccaccgcaccctacgtgcgggatgtgggtgacggcagcagcacctccagcactggcagcactgacagcccggaccaccacaagcaccacgcgagcagtggcagcccggagcacctgcagaagccccggagcgagggcagcccggagcactccaagcacaggagcgccagccccgagcatccacagaaacccagagcctgtggaaccccagatcgccccaaagcactcaaaggacctagcccggagcaccacaaacccttgtgcaagggcagccccgaacagcaaaggcacccgcatccagggagcagccccgaaacgctgcccaagcacgtgctgagtgggagcccgga

SEQ ID NO: 94377 - DNA, 1009 bp, Homo sapiens
tgataaaaaatagaaccattctaagagtctttcatcttaaacctgagcattttcttagtggtgtgtgctgtttcctaccagagcttgtttgtggaatggttgccaaaaggattttgaatccagttaataggttatatacaagaagatatgaatatttctatgaaaaaccaataacattaaaaaagaagtatgatgttcctaaacaggcttgatgctggtctgcccaaatggctataaatatgcctgactttaccttaaggattttttttccattgtgttggaggcctgaatctgtgacatttctttgcatctaaaacgcatcagctgattccctttctactcactcaaaatccaccaacactgtcatcaaactcccttatacatattccaaataatatgctgtcttacactgcaagagacatctttcctggttgtttgaaagtacctttttaaaatgtacagatgtgtttggacactcttttggtttctaaagcataacgtccactacatttgctgaggcagtgctaaacctgagcttttaaaccttttcgaagaggtttaattttctgcatcttggatctgaaaccactttgcacttgagagagaaaaaatcatttcttaaagaataaaaaacaaaaaaactccacaatccttttatgttacctatggttgagttggatctaaaacgattgattttatatactgtggggttttgttttcattgaaaatatctgagggtttttgctttatttggaaggtgctctggagtctgcagccagctccaagcagtagtggaggaggctgccagttttagcagtgacaagaaggggtaaatttcaatattgtatttggggatttacctgttggattccattttatcctaatccttttctcatagtgctgaaaattgcctccagaaacttgacttcaaatgcatgcaatgttcttttaagcacaagtggaaataaaaaggttgggaaagatgagaggctactgctttctctgtcgt

SEQ ID NO: 94378 - DNA, 1048 bp, Homo sapiens
ttgtcctacctgtaaagatatgcattccctcccaaaacacacacatatgcacactgagaggacatcagtgaaaaagatgactgttttcgttgactgtgccttgagcatttataaatcttcttgtgcttataattacaaactcagtggatgaaatattgaactcattcaagagtttcttttgggaatgcaaagataaattttagctattttttctctcttaaaaacatcttaagtctctataataatttcttaattagtaggtgtttagaaaacaacaaaagcaaaagcaaaagaaatatttaaacaaatctccaaactaaacaaaattctcaaaaatgcatttaactctttagaagttactgttcaatgatttctttctagtttgtgtagagttccgttttcaaataggaagtagattcaacacttaccacatctaggcattcaggcatttgtccattcattcaaattgcttgcttatttcatatttgtaaattaagtaattgaataaccattgtcatttataaatgttcataaagtgacagcctcaactattgagaatgggggtttcacttacttgattccattgacatccaaggttgaatggaattttcttaggcaaaaatgtttccttccacaacaaaatgaaagagttgtgcttccagatactagctggcaggcctttgcttttaaacaggtaactatttagctcaggtcatggatgtcttggatgatttaggctcttctagcaatagctgtatttgttattggccttcaagacaaagaagattctgatgatcacagatccttacaagtagctcacccactggacataatgaatgcagaagaaaaaatagtaaaaatagtttgatattaattctagaagcacatattgctggtgactggcaaatgagaaggaataaatagacgaagaaatggtactcttcattatcttctttcttcttcgtcttcaaaaaaaaaaaaaaaaaaggaattgtttaattatcctggtgggtctgattccctttgccttgttagagcaagtttcagt

SEQ ID NO: 94379 - DNA, 1038 bp, Homo sapiens
ccagggcctttgtgctgcatcatcccatggtgggaggcaagagggcaagagggcacaagacagcaagcaagcaagagggggccaaacttgcttttataacaggcccactatcttgataactaacccactcccatgataacaatattaatccattcatgaaggcagaaccctcatgacctaatcatctcttattaggcctcatctcccaacactgctgcattgaggattacgtttctaatatgtaaactttggggaacacattcaaaccacagcattaagggttcctgaacaaagaggttttacaatgatcagtgcttgagggctttatatacccaggtttgtaccgtgatttaatcccttttcacttattttatttttcttgtaaaggttatgctgaattactggagagtttttgcaatgaaggagtcatcagttaagaaaatctatcttctgactaatatcttctgagtcaatgatgaaggtgtactgtttttttggggaaaataggacctagttgcctgggaggcagaaatattctaaatattctgctaagtgaaaatcaataaactaattctgtttaaacaataaaggtagacaaataatcttgcaaccttgtggaccctttggcttgtctagtgcagtaaaattaatttagcttttacatttcacttactttgatgtttttccactttagtattttgacctcattttagcttgttatgttctatctaaatctcagattgttttcaaactgtgctcctttgagccctggaaggtctgtggagcctccctggggctgttaggagtgcatagggaagagtaggcaggctctgccaccccatttatccctagcacagctccagcttcaactggagcatactctacatttgactggtttgtttgttcccatttctgcttaagctcttaattgaacaaagctgactttacaaagctgacttgaaaacctctagtgttacccagtgacaccaaaagaagcaaacattttggacacatcaggcatatttctagtccagtaaa

SEQ ID NO: 94380 - DNA, 1039 bp, Homo sapiens
aggcacatatctgcctccatgtaatctatgtactacatgaggagttgcagctgtggtccaagggccaaataccgtcacagtcatgttttatttgtcccaaatggtgttttgacaattggaaaattcatatacaaatctaagtgtctgttttctcttggtaaactggaaggtcacctaacactgactgcacattgccacatgactgcagtcagtggaaacagtacagtggctgcctctttagtggaggtgttctggttttctattgccatgtgacaaaccacctcaacacttagtgttgtgaaacatcagcctttcattatgttcatagattaggtggctcaggaatttggacaaggcatagtagggatggtttgtttctactccacaatgtctggggcttctgctgaggagacttacattctgaaggctgggaccatctggaggtaactttactcacgtatcatatgcctgggctgggatggcttggagttccttgagcatcccccgaatttcggtgcagattccagaatttccatgtgttcttttcatgtgtcttctgcaacatggtgcctcaggatagtcagggctcctacagtgtggctcggtgatccaagggcaagtgtcctagcagaacaaggcaaaagccacctggcattttgtgacctagtcttagaagtcatactgtgctactgtcttgtactgtattggttgaagtagtcataagccgatcaagatgcaagcagagtggtcacagaaacctcttcttgatgagctaagtgacaaggagttgcaactatgttttaaaaccactgacataggggacaagcatgttttcatttgctgtagtcttcaccactccctattacattgcatccaggctgctttaccaacttatgttatctgaccattgtcaagagcatttgagttagagatcactgttcttccttggttcttccaaatttagataaactctaaattctagttagggtttgtttttgtcagtgttcataggagggtaaatctgaatgttccctttggg

SEQ ID NO: 94381 - DNA, 1550 bp, Homo sapiens
tgacagcatataagtaggggactggatctagccagggacatcagcagaggcttccctgaagaagtgatgattaagttgaaagaagaatagtatcacttgggcaagagaggatggagagaagagcattttgtctgatggggtagtttgatgaggcaggagtgaaagcaggctaggttatatgtgaagaacacatgaaccccttgattccagggacttagcatcacaaaggtttgcttcttcctctcactacatgaatgatgtagcttggtgaggaggttctgttctttataggtattctgggacaccgctgatgaaggcttccctctctgagcattgctgttggtgtggcagaggagaaaacatggacttatcacaccttgctcttctctgttcccacctggaagtgacccatattacttctgcccatggtccattggccagactgaccacatggccccacttcacggcaaggaactgggtggtatagttttctgtaagaggttataatagcatttactgaagtgatgcttatggctatgtggaagaaataaagcatatcagtgactatgcaaataatgtcccagagtgatttgttggctgctaaaatgtgggtggtgaagaaggagagggagtcaaaaagggggaggtagcctttagctcctaggtaagtggtagaattaaggaaccattcacaaggttgaggaagggatagacagggtgataagtaaaagatggtaagaactgtaccttggggaacacaaagatatagctggcaccaggagaaaaaagagtcatcagaggagacagaagaggagcaaaggatagtgattgggagttttcacagccaggataaggggcctttcagaaggaaggagggcccagctgtgtcaaatgccctacacgttaaagaagatggagaataagaccaggtcattgggctgggaatggaggaggtcattgatgatcttctaggaaggagaaagaaatgatggaatcatgtgagactcttaaagtcatgggttggggtttttgttgttgttgttgttgttttgttttatgagggatagaggagaataaatcctgaacatggtgataggtacagaatgaaagagagaatgaacacaggaaaaataagatttagaagagacaagagtggaagaaatacagggttaacattggtaacaaggagtcacatttccttcttagaggtaagagcaatagatgggaggagagtttggaaaaacaaatatttgagataatgaatggcttgataggagagatgaacagatgtacatatcctatgtagaattcaagatccttagaagttaactgctcataatcctgaaatatacaataaattgcatggcaggactgcaaattcaagttagctcaaaaaaggctcagaattcagatatgctttgattacaggtcaaaatgcagaggaccctatgaaagggctattgttggaaaattaaaaacaatagtaaatgttgcattttctggaattgtgcattggctattatattatttctatgggaatatagaatgaa

SEQ ID NO: 94382 - DNA, 1160 bp, Homo sapiens
gtgtgcgagatgctatggtgtgaacattctgaaagcaaaaacttaagtacgtttcagtccctgacataaggtatcttcgagtaccactgtgttggggagatggtggcaaggcattagttaattataatgcagtccagaatgtgatggctgtcacaatggggcccaacgtactgtaggagttcaaagaatgaaggcaatattttcaattaaaggattaggaaaactttcatgaacaagatagtatttgaagtgagacctaaattaagaggtgaagccatgttatggtgggatagtgaaagaggaaaataaacagctaggggcaagcatacgacgaggggccaaaaacaatggaggaaaacatgagaggtgggagaagttagggttgtggagtcaagcagtcaagcaagtctagtggggaggaagttacatgaaaaacatctgggaggaaggtaggtttgggcatattgtggaggtcttaggtgattgtgtaaggaattttgacactcttttgagtggaggagtgggataataaaacatttaaaagaaactcaatcaggtgttttttcaggtatctacaaggcgaattagagaacagatactgaaggcagggagatgagttaggaagctattgtgatgttatacatgagaaatgatgaggatctgaacaaggagaggccctctctgaacctgacatggaggagaagatataaaagatgttgtagatgccaaatctttgaatattagcaactgatggagggggagagaaaggtaatgaagatggtggtaagatgttgacatcattttcaccaacagaaataaaaaatcatcagtaagggctgttctttaatcagctattataatgggtttggatttatactttcttaaatcatagccatgttaggatttatcagagatgttctcctttgaggtgttgacttggtaactgtacatgatattgaaggagtgaattggcttccgagtagggagtgtgagaatgcaggggatggagaacagggtcccacagcaaacctgcaggtaagaggtgggggaggccatggaagcatggctgtgggagaagatgaagaagaatgaagctggtgctgtggtacagaagccaatggaacaaagagtttggaaaaggagggtactggaaagaacat

SEQ ID NO: 94383 - DNA, 1048 bp, Homo sapiens
ctgatcctcctggcattttcagaaggcacatgctttaacttcagctagtgtttctctttgagtctgggaccattcaaaactctgcctgcctggctggagctgtgtcaccttcctagatcttcccagagcctattctccaaggactagaaatttcaccattagccaaagttctgcccttaatggacttaaaaccaggaagcttctttgtctttcttgccaaattgggcctcttcagtactgatgatgacacatgtcagacttgatttctccttgcctttctggacacagaatgctaaacttctcattactcatcttaagggccaggttgatagctggatcatcttcaccaaactcaagtggggccttttccttatgaatctatgttgcggggacttcattggctatcctgctaaagtgttgtcatatttgaatagggggatttaatcaaggtactcatggtagtgagtttagcacccaaactagcatttaagacaataaaagagaagtaggatctgaagggaaccagatggtcaaagagcagggaagactgatgggaaccagaaaaataccaatgtgaaaatcagtgtgcatcttggaggctgcacagatagtgtgggaccacaataatatgggaaaatggaccaaaaaatagacaaactcatgctgtccctgaaacaccattggtctcctgctggagtagtgattttgttgagcttggttttcccagggatctcagctagaactggagtgagggtgggagtaaaaagaatctgacagggaaccacaagaatctttcctttgatcagtgttcttttcaagaagatgtttgccactgtccataatataagtcatgcttgaaataaaactttagtggagcaaatttattcaagtctgggcttacacaaacatgataaatttgtccaatctttttttagctgctctaatgtcatggtagcttttttgcctgcaggagtagcaatgtgatctggctccatagttcagcctgttgagcagggcagggctgtattagtagtcacattacattcat

SEQ ID NO: 94384 - DNA, 1043 bp, Homo sapiens
tttacttttgtggcctttgaaatgctgtgattttattagctagccaaatttcaagagtctggaggggagaggcctgggaggaggctgagacacatagtgggcaagaacagctggagagaggctaaggacaggatcaaaggtacaagtttcttcttcaaccctgtcattctcattaccatttgggacacacagggtagcaaatctagtcaccttgtagcaaatgcagggtttaggcatacaacagtgtggaaggcctgaataaagctttccccacctgtagttctcatgcattatttatttctgatacctccgctgtttctcctcttacagctgcactcagtctggaagagtaaaggctacacaggaaatcctcagctcctggcctagtgcacttagagaatattgcctgccaatttggtaactacgataactgcagcaatattcttgggtagcttgttttcaggacatctttaatgagagaagaggatttgaggaggctattagccttggctgtactaagtttagagtgctgtcagtgatctactgcatggatgccccctgctgatttcttccttgattagtcttttctaatgttcttgcctggatgcatctgtgctgcaataagagaattaaaattcataatctctgcttgggatcctgaggctgcactctgttctggagcccagacgtcttttgtttcctagctttgccactgaaaacagatttcctggcacgttggctgatagttggatgagcagcattgaacatgagaaagaaaatgctgggaatggaggatggtcagttacagtctgtctgactcagaaaagggcattccagctgctggaattacattagaaagggctgtcatcagtgaatacccatactgaatcaagaaaatcaagaaaccgggtaaagtaagggataggtcattttaagcaaaaagacgattaaataaaatcctaaagtaatattacccatgattccctgccactgtcctcaggaaatcagctggtgcttaccttcccctccattcatttcttttt

SEQ ID NO: 94385 - DNA, 1038 bp, Homo sapiens
tctatagagtaaaatttcagagttgtatttcttgttcaaggagaaaataatcaatttatgatatgagacctttctgtgatggttcaaattagatttcttgacatcagacctagctcttaaatctaataagcagctacacagatcgtagcagttttgcagatgtgttttatggacttcagcttgcagcacattaaacgacactgccagcttaattataataaaagcttcacagaccctagttggcattacagactaggtttctaaaatattttatggtatagtgatagtttatttaatgtcacaatgtaagatattgctcagaaaataatggtgatcctaagtgagatgtgacaagattgtgtatagtgtttggtgaacagtaaaagtgattttacaaataaagtttggggcagttggatgaactaggacagataagtaaactggggaagaggaatctccttggtaatggttcatctttggacagtcacatttagaaaacagttttaggaaggtttttgaacaaattaaagaagctactgtgtatcccaatgtaaaaggttgtcattgactttgactattgtgctgaggacctaaaaggatgcgtgctgaacatttgaatgcttctgagaatgctctggggttttggcagcggggtttgaggctggctgcatcacagcatggttggctgaatgtcagcttcatgtacagactttttatggctgcatcttaagtgattataatataatgtgcactttgcccgagagagaaaaatattatttttccttgtccttcagttctttgccctttatatatttgcacaaggccctggaggagtcacactattcacaccatcaccttttacctgtttgtttcatatgagatgtgaggaactaaagacctaaataaattactttctccaggtctcgtccaacttgtgacaggagtagagccattttctgtctccatttttaaccactgtttaacctacacttagagtttacagtgagacagggacatacctcgggtaaaatgtcatga

SEQ ID NO: 94386 - DNA, 1085 bp, Homo sapiens
tatttggtagttattcagcacctattatgtactaagtaaattgatctctaattttgcaaatctgactatttataagtcttaaaactgatttgatatatttgtagttttatatatcaaggatagacttgttagtctgtaatcctgacatacaaaagcaggataactaagtttgtagagagcactttatgcttttaaaaatgcttctatatgcattgtcttatttaattctcacattggttaggtcttaacatgctcattttatggaaggatagatgatgcattagatgaacttgttgccatttgcatcctgaaagtcttttattatgtttatagatgaggaattatattgtcctgaacattcatggctgttactctttgtacaatccagttggcgactagtcatgttcttttttgttgtaactctgtcttctatttttatcttaacagtctttatgtaagactttaagtaatatttatatttttatacatttcagttttattttcccaactagcctgcaaatctcatgtgtgctatatctcttcataattataaagcagtattaactattttttatagtccttatagtacctggcacattgtaggccttcagtaaaggtaattgaatctgaagtgggaataaggagaactgataccttgatttgcatcctaccttcatttgtttcattctctgggcagtatttttgattttaggccagtcaagcttggggcttccctctctttttccaggctcttgctttaagccatgtcattgcacagcagaccatggtgcaacaaagaggatttggagccctgtatactcagttttgccaaacgtttactgctctaataaatcatctattggctaagctaactttggggaattgcctatggactttacttctatttgccagccccatctggttgccatggatacttgctgtggcagaaggttgtcctacaggcactggaacatgatgttgcctgtggcaacaaatagctcagtgggcagcagaaggaacaggggtgggacaggagtaccaggtactcacagggagggcagggactttggttggactcagcagaa

SEQ ID NO: 94387 - DNA, 3118 bp, Homo sapiens
ttagtttaattcgatcccatttgtcaattttggcttttgttgccattgcttttggtgttttagacatgaagtccttgcctatgcctatgtcctgaatggtaatgcctaggttttcttctagggtttttatggttttaggtctaaggtttaagtctttaatccatcttgaattaatttttgtataaggtgtaaggaagggatccagttcctacaaggagatttaggcacttttcatttaaaagttttctacttttcattttttgttttctttcctgtagcctgaggaaagtgaacatgcttataaatataacgcattagtaatttaagttggtgccttctgtatcctttacatataaagtagacaaatataaatgtaatatatgcaatatctatattgcctaaatataaacataatatagatccgaaatgtcatatacataaagatctatattctttgacaatataagacagtttaagtgaatacatttttaagtgatttgagtctttctttttcttttttcgagacaggcactcgctctacaggctggagtgtagtggtgtgatcgcggctcactgcaatctccgcctccctggttcgagtgattctcctgcctcagcctcctgagtagctgggattacaggcacgcgccaccacgcccagctaatttttgcatttttaatagagacggggtcccaccatgttggccagggtggtctcaaactcctggcctcaagtgatcctcctcccttggcctcccaaagtgctgggattacaggtgtgagccactgcccctggcaagactttcttaaattacatttgaaaagctgtcattgtatgaaaaataagcaaaacataactgagccatgtttaggaagctgagacatagcagtgactttggactctgatagtaattcggagaggcactgtgaattgctagaaataacaccaaataggggtttcaagaactagttctttgcctggctctgtctttaatcagtttttagaccaggaggacacccttaacctctctaagccttatatagcttgtctataaaagaaaattgtcacaggtgatatggaaagagctactcagctctgcaaatttatgactctttatccagagagtttgtgtttatgtataattaatatacaaaacaggtgtgttctttttattttgatactcagattccttaaaaccacaactttacactatattgggtctttaatttacaaatgcctacttacatcgtggggggttactctacctcactggattctaaagctaataaagtttcattagatagctattaaatctatttaaataacatacagtcatggacatgtatgtttaagactcagaccatatcagatatacagatagtgtgctcacacgctagtctaatcagtgttggttttatgtgtatttggagagataacatgcagtccccttaatgtttctttctattctttatataaaatcatgtataatgaacataaaagttctagttttccctaacaatatacatatttaaaaataaaatgagtgtgataaaggcttgtggatttctctctggttagatccaaagagctaactccttcatttctaagtgtggttcctttcagctctgaacattctgagaccaggtgtaaataaaagcttgggctcatgccttatacatttgcaaagctaacaagtgtcaggatgaagggctatttattcaagaacagatagagagaagcagtgaagattgaattggttgtatctagttggtggagaggaacccacaggaagtgctgatggaatgctggtacagccaccatggcaggtcatcgcccagtgaatgcagagctctttgcactgccatgttctctatgatacccgatgaagatcactaagctgtcctttaaatccagtgcaacattttgaagagagccaaaaactaggaacagtcttattatttgggggagttgcaatgttatttattaggcattatttaagaagaaaatgccttgtgaagggtggtatatacagcccagccacaactgtgagcatagcgttactgagtagactgtgtttcctcaggccacaccagcccaggtaaagatcacctgaagttaggatattctcacctgagttcatgaactaatgtgaaaattttaaaaatatcacacttgaacatattttaaagggaccacatgttatctcatattgcatgtaataaaagaagccatgacatttctcatactgcctacaataaaaggaggcatgacatttcacagagggaatttaaataattatgacgaaagagaatgctaacatagaaaatgctaaaaagttaacttttatctaagtgtaatttatacccaacaataggtattctttattttaaaatgtagcatacttttcagaaattcagttctgagactggccaaaataaattgttatgacaaagagacgacaaagacatgaggtatcacacattagttttttcagtgaagctacatagaggagaataatgaaagagaagctgcatataaatcaaagtcatctgtgcttgtgatacacataaagaataatacaaagaggaagaaaacgttttttcaaaggatacctgatttaccggattcattctgcagactaaagcatctgaaatagccactaagaagtggatgaggcctttctttagattttctggttgacatcatgaaagaattgtaggaggcacacagtgagatggtaatgagtgtagcttttactgtttagaagaagctcttgtacatgatcttttaggttgagtgcctctgagcctgtctaacctggtagcatgttaacacatgacactaattaaagcatgttggagaagcaggatgaagaaagagcatattaaataaattataggtgttagcttaattgtttcactacttaggggccttcaatggcttggtaagtcttactagaagacgatttagggtttattttagaattaaaaattatacaaagtattctaacatcaataatcaatggagtcttttgaaaaacagcccagccacaattgtaaacatagcgttactgagtagattgtgtttcctcaggccacaccagcccaaattgggatc

SEQ ID NO: 94388 - DNA, 1033 bp, Homo sapiens
aattctccctaccagctagaagggtagcaagacgttgtagagtgcttatcagagagtaccatttacttcaattgatcaatataaatatatctttttttttcatcttaatgagtttctcataaagacacatcttggggcataccaaccttcatattcattcagtgtatccattggtgttaatattaacaatttcaactaaaaacaacaaacataatttttctaagtgtttcgagctgtgagatgtcaatttctacaatttagtttctagacatgctgtatatttaataaactttatgtaaactttaaaatattgcactgcatttatgaaaaaagctttctttgcctactgcagctatctaacattttatgaaactgacgcatgtccttcattattgaggctaaaagctcttgttcagattgcttgaggtttgaaaaagaggtgtgctagctttgcttagtttatttcttatttttggtatacatatacatatatataacattagaatgtgtgtactggaaatgctatgataggtattttgtgttaatccaaatgcaatgatagtttcttgtatgaatgtgcaagaggcctgtgaccgaatgctacgtttttatggtagtttaagattataaaagtagaaatgcaacaattcccagtttttggataggttctaaatttctgagatttgattcatggcagatattctctgttgttgttgttttagatgggctcattacataacgagttaattgtcactagtaggagactgtgaaggaattttgttatactttcaaaaatgttactgtgatgaaaaatcatctattttcagaaaatatttatgaattaatttactatagaattatctctctaattatcataattgggttacaatttaagctccccttttaaatgttatattttaaaatgttattactctataaaagaaaattgcttgctatatttacaccttctttcctaggaaagctttcatccttaaattgttgtattcctaccctctgaagacatttaaaataa

SEQ ID NO: 94389 - DNA, 1683 bp, Homo sapiens
tacatgaaatttattttctttcttcattggaaattgttaatttcgtgtttcttaaggtgtgtcctgcactgttaatatgtgctatagaaccccgaaatgaattttggatgaaatttggttagtttgcttctgtttttttaaaatatctatacctcttagatctcagtattgtaatgtatgtgaatttctaatttgaatataatgtgtgggcttttccaaactgaattaactttagaatcctaatttctgggaacctgggaaagttccctattgaagacattttgggaagtgtattttaagagttttgtttgtttgtttttctttttacccatttatctcaccccttctgccaacagaagtgatgccaccaaaaagaaatgaaaaatacaaacttcctattccatttccagaaggcaaggttctggatgatatggaaggcaatcagtgggtactgggcaagaagattggctctggaggatttggattgatatatttaggtaaagtaaaaccttaaattaacaattattcttatatctgtgactgtaaccgtgattacttagtggtattttaagaatggaaatatggaattcatatgtgtactttattaaaattcatgattgtactcgattaagtaataatagagtacagtgtctaggttcaagacatcactgacccactccttgttgtccatgtttttctgagtaaatcttagaagtctttttagagcataattatacaatctgccagacaaaatgctaactttctttttttttgagagcttgttttcttagaaacatgcttttttcagatgagaaaccacaactgtatagataaaaacactttctgtttgtgaatcttaatcaatatttaggcaatacaagagtctagtcatttcttaattgggctctactggagaattcatagataaaacttaaggcatctattctgtgaaatgaattaacttctctctcgtgcatctagagtggtccctagggatgtgccattcttgggataattgaaaaaataaacactcaaaattattttctgtgatctgtggtacaggtaaggaaccatgggctggataggcctttacattgcatttaagcatttaaaaattacactgaactttaatggatcattgagttggaatgaggaggggatatccattaaaagattgattaataaaataaggaaaatagtagtgatttttaaaaatataccctcaaggataaattctcctaaatgtactcacttgagacttgagatcacatctatttctataggagattaaggagttgataaaatacctccgttgagggaatcttgggttctcatcacatatttccagaaaaacatgcttcatggatcctgaaatataaaagatcctcttctgataaaattaagattgtagttttgaatgaatgaatgaatgaagtttggtcaataaatatctgcttattaaatacttaagtgtctattctagttggaaagacaagatcagcacaaaaaattgtatgagtcaagtaaaggacccatttaaagggtttgaacttgcttgaaattgcttgaaaaaatactatggttattaagtgctagattgaatgacatagtcaacactgttcaatagaaatgtaatacaagttacatatgtagtttaaaattttctaggagccacattaaaat

SEQ ID NO: 94390 - DNA, 2777 bp, Homo sapiens
accctgcctggctaatttttgtatttttagtagaaacggggttttgccatattggccaggatggtctcgaactcctgacctcaggtgatctgcccacctcggcctcccgaagtgttgggattacagacgtgagccactgtgcccagcctacttatttttttttattaccaaaataatactgtttgttttacaatatattttcagggttcaatatgtaagggaacattctctagtatctgaactttagaacctggaccctacctaggaagattagcaagtacacaccactgaggaaggactttaaagaaatatttagctattttcagaaaaaaggctccagtacttcagaatttataataaagatgtgtgttccaaatgttgtaactgttccattaaaagtgatgctaatgaatcatagaatcagtttaatttcactaaacttagtttttactattttcaaagctatacaaacaaatcaatatgaaattacatcatgtttttgcattttatcatggttctcatcacttcctctatataaatgaagagaagaagcagtaaaattcaaattttcctgaatacttttgtgtccagtgacattcatttcgattctttccagataccctctttcagcagacacttgatcagcgtttactgcctaaggctgagaagaaactagctgctctgtctagctcattgtacatgtacaactgtcctctagctttgagatcagtagccagggcctttcggtaatcagcagcttacagttaaggggaaggggcagagaagtttggtatttactcttgacttggagaaataatgtgcctctagcattaataagaaatagctaaaagagtgaaaagaaaagtctgaatacaagaacaaagtcaaagttctttctttgaatatgaaaagagaaggggaggaaaaaggaagaaaggaaactggtttaggggatgggaaaaattgctgtcattttagtatcaaatgaatgaaaaagttttttaaatatcaggaaggagagaaaactgagggttagaattttactataatgctgggtataacacagaaccaagtaaattacgggagaattgcataaataatagcagaggttttggcattaggcatatctgacctgaatcctgacctgatgaagccacttattcatctagttacttaatcctttgggttgtttctattctgcataattgtgataataataattgtgaggagaattaaatgagatttttttaaggaacttggtaagcatttaataaatgtaatttagttatttatttccatagactttcccattcttaatactggtgccatagtggggccaggcacagtggctcatgccagtaatcctagcactttggaaggcccaggcgggtggattgcctgagctccatccagcctgggcaacttggtgaaaccccatctctactaaaacacaaaaaattagctggttgtggtaatgtgtgtgtgtagtcccagtactcaggaggctgtggcatgagaattgcttgaacctgggaggaggaggttgcagtgagccaagattgcaccactgcattctagcttaggtgacggagtgagactgtctcaaaaaaaaaaaaaaaaaaatgctgccatagtggattaagatgatgacaaagaactccattggaagggtggattttctatttattctactatgaattttggtggatttaactactaatgtggtaaaactgagaacatagagaatgtcagcataagactttatgacattttactaactgataaaagctccccctaaaatttgctatagtagtgaaaagttctcatataagctgtatttaatctgcctcagatattaaagctattggtttcagaaattattcaaaattgagaataacagaattacaggataaactttagccacattcttttgaaggctgattatgtaagtaaaagatatgatttatctgtagcagttttagttttttgaaggtggcatagtgatgaccatttagcatctttggagtgtcaagcacagaatagatgttcaacagttatttgcctgagaaattgagactgagattggagtacttaacccacacaagctagtttgctttgttctcttccataattatagatgtcactcttcgatctactgcagattagtatccttagtcaccaggaaagttgagacaaggcacctatcatgacatcatctaaaagaatgtgcatgtgctttattgacaggacatcagtagcaatatcttttataaagatactatctcaaagcttttataaagaataacacattattataactaaagttaactgtggtgaagcctgaaaatcagatcatttatccatggacagatgtttaaatttcatcaaagtgactgccagacatttttggatcatgttgtcggattagcctaattttgtacttcagaaacatagaaggaatcttttgttggcggataggtttttagaaattaccaaagtttaaatcatttattttactgataaggaaacatttatatttaaaacaagtaaatataaaccacatacatagaatgtttttacttcttcataaaataattttttattttctttataaatagtgagctataatagattgattttaaggtatgcagaataaagtttagaagagcccagtgataatactagcaacaaagtagtgtgttggaatacatattgcttcattacatattacattattaagtgttattttggtagtgtttatagagagctttgagata

SEQ ID NO: 94391 - DNA, 1028 bp, Homo sapiens
ggcttttgcttggctttttcatttttttaaatatccatttttaagcatattttatattatggttcttctttattttcaacattttactgtcaaattcttttgccttaagggaagatttataaaatactctattcttcagtgcatttatatattatgtctcttccactggacctgttactatcttgtaactgtttacagtggtcaaggttttttttttttaatttgaaacatattgctgtggggaaatttcttcttcctgaaatgagctcacctctattgccacacaataaaagaattctcagcttttgagagctctggcttccttatgaaatatggatagacttctgcttctgaagtgttttaggtttttttctttagataaggaagaagaggaataaatagtatgaggtgtgtttcttcttttaagacacaggaatatctatatcagataaatgagaagaaaattaagaaactttaaagctctaaatgagagagctcattagaaattagctacttggatgatgaaaatttcttcatcatctacacttaaaggcatttatggtttttatactacttagatacttgattttgcaattagtatttctttagaatgtttgtccctgatagctccatcacatggactgttattcctgaacactctgttgtattctccatgaaaaaatattttaggagaaaagatagaaaactcagcaattatttcaagataattgttgaggacttcccttgtttcttttaaaagcatagccttttgttagccaggtagatttatcttttctttaacatcttcgatcaagtaatacttgagggaaatattctgtagaaagacatccattgaaggccagaaacatctacagatgcaatgtgatcccaagcaatgaagcatgtggcccttcattggcattatatgataacaggaggatcttctggcagaagaagtgacttttgctgcgttctgcatgctgcccctccaaacccatctttgattggcacctatgccctattgaaac

SEQ ID NO: 94392 - DNA, 1064 bp, Homo sapiens
aaggagatgaagggaaaactccaaataaaagaccttcagaaaatttcatccagaaacagaaagatttttaacaaaccaaaggaaaaagtttagtcctttctcctcaatgcagaaaatcttctgagttttctatcaataaaaacttagttaaccaaaatgttagaaccaacttaatgcataagtgacaaaactttctatttttacatttatttcattgcatgtctatcatgtatataaactttgcttcttgaataatggattttgcataaaattgagaactctaaacatcatatttccttctgattgtctcacacccactacagaactcccctcccccaccccctaaaagagggcacgcttccttctgatcactttaatcatatcttctaaatgctctaaaatttacaggaatgcctgtaagaccagctgtggccaagagaagcttttcctaatcgccttatagccgttgcttttgctttttcactgtgtaaactttatctatggaacagattccatgagaccgttgtgaatacttcaacgtattcaaaacatataactgccacaaattaaactactaaaactaaagctggtgcattgtaactgccaagtaaaactggcacgtccctctgtcagactgcaggagagtgtgccatacagtcctcggaaaacacaattcatccagaagcactcttgtcacttgctctgatattaaaccagagaaagtgacattaattaaagaagtgacatgagccaacaaaggcaatgaattctcagctttggctcatgtgcagaccttaatccaacctgttctgcttaggtagtgtggctatttctgaagagtaactagtgtggctactcaccccacttcctctcatcttcccattctgcatcacgtgtttgaggaactaacattttatatccagggttggactggttaattggtacactggtagtcattgcagggcttcccaaaatagtagtgtggtggcatgtgatgcttttattgtacttggtaatagtgtgagatgtacaactagaggtagaggagagttggtctaacgaaa

SEQ ID NO: 94393 - DNA, 1041 bp, Homo sapiens
ggctttagagatgaagctaaggagttttctattaccatacagaggaagaatacctttccctttgctcatggacatggcattttgttctgagattctcaaggcttgatttataattattgcttaggtgaggaattgctgagtgggcttcaagattatttcaccatagatctctgattttatgctatgtttttcctctttgtgcagtgcggtttggctactgggctatcaggaattaggcataagcatttttgaatcttgattttcttcctttggaacttcaactaaaatacttgatttttgaggatcattttacttttttctaggatgagcaaccagaagatgtgatattttagaataattaaccagtaattgtgaaatacatcgctttgtcaatgttaatatgaaaaaacccatgttattctatattcaaaatgttgaaattgatcatgagttctaaatagcagtaaaccttattttatctatttattttcacagttggatgtactggaatatatacatgaaaatgaatatgttcatggtgatataaaagcagcaaatctacttttgggttacaaaaatccagaccaggtaaatacatacttttgcttttaataaaggtctttaatgtatgaaactgaaacattcagaaaacaaacttctaacccagaagagtttacaaatgagggcgtaacatgatgaatgttgtaatttatcttacctgcttatctaatttaatctttgtaccaaactaatgagtaattaggatgagaaactgagagtcagaggggttaaataatatgttaatgggcacacagttaagaagtggctgagcaggaatttgaatttctgagcaaatatagataagcaaagaaccatcaaaatccagtgggagtagagatggatttatgtagaggttaaaacactgtcatattagttcatcatttcctactgtataaccaattaagttttaagcagagaggccgggcgcggtggctcatgcctgtaatcccagcactttgagaggccgaggtgagtggatca

SEQ ID NO: 94394 - DNA, 1027 bp, Homo sapiens
agaatgtttgctcttatctccccttcctgcttgaaatagttttatgtttcagggaggggttacaggaaaaagcagagcctcctcaactgtgtgaatacagataaaaagacatattgtggtttatgatgtctagatgcccacctggagggaagggaatttaggagcaaaataaaaagattaaaaatctaagtcaactcagaaataagatatgccaatgatgaagaaaggatttaagttggaaagttagttgttatggcccccagttgtacatattttatcctaaggcaccatttggtttaataaaatgtagatctgaggctgttcttaacctatcagtttcttaagacttaattataaaggttatgttttcagaggacaaaggcattattcatttgtctgtgcttgtcttccaggtttatcttgcagattatggactttcctacagatattgtcccaatgggaaccacaaacagtatcaggaaaatcctagaaaaggccataatgggacaatagagtttaccagcttggatgcccacaagggagtaggtgggtttcttttttctttttcttatttttatttcagaagaatgattagagacaagggtaatgaggctgcatgaaatgacctttgcatagtcagtttgaagcataagagcactggtgaggtttttatcaaaagtaatgaattcctgttatgccaatgaatatttcttctaacagtggaaagaaatttagactgtgacaagtggtgaaggagcaaaagtgtgtcaagtaagcaaaacttgctgctcattttagccagaaagccacagtttgtataggtaaaacttggaggtcagcagtgaatgtttatactgaagtgaatattacagatttggtaaagttgcatgtgggccaggtgcagtggctcacacctataatcccagcactttgggaggctgaggcaggaggatcgcttgagtctaggagttcaagaccagtttgggcaacatggtgaaaccccatctctacaaaaaaatacaaaagg

SEQ ID NO: 94395 - DNA, 1611 bp, Homo sapiens
tggttgctttgttcacaatcaatatggtcaatgcaactgtactttcttagttgctctgtcagcaacacaaaaagtcaattctaatgttatgctagtgaaaaaatggtgattattgaaaaactttggctttcaaaattatattctttgtaaactttgtttataaaagtattttcaaatatgctaaaccaaacaatttttaaacagttttgaaaggaccacatttttactaaaagacaattagatatttgcacttcttaatggttgttgaactgttaccctaaactgatgccttctaacaagttttagttggtgaagacaactgtatattattgccttttctattaaaaggaccattgaccatgtaatgtagagggtcttgatcattttgcagggcattaaaacccatactagcttaaggtaggccaatgcaaaagtaaaacaagtataacttcttcctttcagaaagattcataggcttgattttctgaaacggaaattatcttttatattcctgatcaaagtaaaagaaatgactacattttttttcaagtatagtttggttagaaaagtaataatcagtaagaaattttgtagtgttgtgtgatttttcagtattcatattgttaataaattagtgagaatttaaagataatatgggacgtatcttacattaagaaatgagaattaaatgctcaagaaatgtaagaattaaatattttattctgttacacctaatagaatttttagaaacagtaagtacttttttgataatggtataactggaaattcatcatacaggttcttaagcattggcccagttatattaataatgataccaacttatgtttgagtcatttatttcaactggtagctctaaactgctctgatctagttttgagtagtggaattgctaagaaatcactgtgattgtggaaagagaagtagagtttttttgtgttggtatggtcagtgtttggactgtggtaaatctgaaagacctattcaattaatttcattgtttagggtgtcgttttcattgtgttgtcttcttgaaagatttgaacacatttttattttttagtctacttatattttttattctaaaatcttaatacatgttgaatatgttggtaagatttcaccaccctcggtctttggggagaagactgaactgagaatgatcacagaatgatcacagaaagatggtgttacatccctgggggaggtatattcagggaagaacctacattaaatatttttgggatttgctgaaaagttatatgatagaatgaacattcatttttatcaaaggttttaccagattcttataaaatagtagatttccttaatgcattttaaataggatttacactaaaattctaggcatattgatatatatatatgtagatacagatataaatatagatatacacattacatatatatgcacatatgtacacatatatacacacatatatagatatatacacccacatatatatttgctgacattttaatgtgaagttttagtctgggatataaaatggaatgtatgacatcctcaaatgtctgaatactgttcactcctatgttttacatttaattttccaa

SEQ ID NO: 94396 - DNA, 1120 bp, Homo sapiens
ctaaatctcattacagttccaagcaataataagtaaacacttcattttaggacatctgcatgaaaatatactgtccataattacattaattaccaaatgccactgaagaaccctatgtattacaataaattgtgcaaatacatgactcagaaacaaaacagtgcataatgtattttctattcaaatgaatgaaaatatattaaaaagaaatacattgcacagtatcatctgattttagagctgaaaatgtaaaatattagtggcagggatagaattggatctcattcctagtccagagctctatttactgcttcacttaatatgttttaaaatgaatttgaaaattgtataattaaagaagcaactttcaaattaaaaaaaaatttttatagttagacattaatagtctcagactataatcaattctttgtgtaaactatacatgcatacatagattttaatattgtcatctagaacatttgtttttaattaatttaacaggtattaaaattactcctctgtgtacagtagatggaaagaagacaatcattggcaaagtctaagattttaacttcactaaacattcaaacttttcaatttgcttttctgagagggaatttcaggtagaggtatgtagtcagaaacatttttagtcactcttcagtgtggggaaaggaaagggtgactattgggtgttctttttatcactgcatgcatttatgcaggacttatcagaaacagtggcaaaacattcacctaacggtagttattaataccgatgtgcaaaaaagaaaataaaagattgaaaaatgtgataatgtattttaattaggtaagaccaaactataatagtgaagtaaagttaactctcaaagggctatttcaaatgaagaccagtttatgaaagattggcttcagaaatctaaatgacttgtcattacttacagcttcatatcaattaatccctcaattggggggtagggggaaatggctaggaaggttcaatctattttaattctgattatttttcctcaaagggcctcttgtgtgtagcttatatcatccaaacactgtgccagaatatcattttttgaaaattagaggatatgagattttttaa

SEQ ID NO: 94397 - DNA, 1052 bp, Homo sapiens
gataaaacagtacgcaagaaccatgggagaccctttgtttcacactaatggtatcaggtacatttattaccaagatgacttcagcagaaagtggctcagaagatggtgacataaattttcccagtagtttgggaaggttgagtggtgaaaataaagaattcctgcatgattaagaaacatttccaactttcaggttactgaaaggcagtggttttgagctgggatcctggaggagggtagaatagagtggtgttgtgacaatttaggcttagccacaaaacaccagcatattttaaagggaaggagtgaacacacttggcgataaaagctaaaaattgagagactacaaattaaggctctgcttgcccagccaatgtaattcattctctattttggcactggctacttcactatttcccctttgtgctgttcctatcttctgccccctgtttaactcatgaaaaaaaggtgatggcactttcagctgctataaacatgaagctgctgaacaaatacttcatataaggaccttcgctgtagctttcaatcttccaacagtgttgtgggttctgcccttctgtttctgagtctacttcaaggttattgacagtcaggcatcccccagatatcatcatggtgtgaaaaagaaaccttagagacagcaagcttgttgtagaagaacttaacctctgatactggtacacagtattcgatgacatgaactgttattcatcttgctcaaaggttaaactacctgcacaaaaatgtaagcaacatcacaagctccttttatatattcacattaattaggctcacttcaatgatagaaaactaagattttaattaataagaatttaaactacaaagatatactggatacactcccagcaaaggttaataatgaattcatgtgcagctttaaaatgtgacaattttctctaaaaatgctgttttcagtaagcaagttatctgtagagataatttctaaggagtacagtgacactaattttattttttattttattttttattatactttaagttctagggta

SEQ ID NO: 94398 - DNA, 1063 bp, Homo sapiens
aggatttgtgccagaatgtttgtagcaactatattcatggtggccagaaatgagtagtagcccaaatgtccattaataggagaatggccttgtgaattatgatgtagttacacaatggacatgtgaactatgatatagttatacaatggagtgctgttcagcaatggaaaaaacaaattactaatacatgcatgaacatggataaatctcaaaaaaaaaaaaaaaacactgagtgaaagaagccaggcccaaatgaatgcatactatatgactgcatgtttatgaaattctagaagaggcaaatctaatctagtgatgagaatcaaaatggcagaacattccctgggggaagaggactgactagggaaaagaaccaagactttccaaagtgataaaatctatatatacgtatctcattgccaccacagccaaaaaggaatcaatttctttgcatcagtattttcgcagtgcttccctatccctgtacaccaggtgattttggtggacttaagtaagggttgaaaaagaatctctcaactagagatttttagaatctctaagttttgtcaccaagcacgatttgtctttaattttaccaataggaactaaaatatgcctaagtgaagtagttccttacataaatttaaaatgaaacaacaaataatgccactattttatactcgaaagaatgtaaaagattgctattagtactaaaaaaagcatttctgtctctggataaacttgcaggcttgttggctggctgaagaatgcataagtactatgcttctaatttttgcctcggctgtcaagaagttcagagccaaattcagtgctcagtttagtgattaatatcccagctgcctgatatatcaatttttcttgattaggtagggtatacaaggtggggtattaaattatcctgtttcatactgtaaactacctcaaatcatttgggggaaatgatggtgtataaatcatataaaatgttggtcattttgacaaaattaaatattttttcactgcagataataaatgcattgtatgcttctccttgttgtcaaaa

SEQ ID NO: 94399 - DNA, 1041 bp, Homo sapiens
tcaattcctttctttaaatactatcagggacattataacaatgtatgatatgggaatattactgatgcccaaacatcttgccagccaaaaatggaatctctttttttagcctagctgtgtatatttgagtggaaaaggaaacaccctacaatagctttgctaggtgttaaatagtaatgtaattatatttcctataatacagcaatatagtcacctttataaaaactatatttataaaacattcttcctgatcttaccttgtgttttaaacacatagatgatttcgtattctaaagtagttagaagaattgtaatgttcccaacataaaaggtaaatgttgaggtgatgaatatcttaattatcctgatgtcatcattaaacactgtatacatgtatcaaaatatcacacataccctcccaaatatgtacaacgaataagttagtgagacacatacgctttttataaatatttttcttttgaaggattttactatggattgtggaatttgttatgcttatcaacttgacggtaccattcctgatcaagtgtgtgataattctcagtgtggacaacctttccatcaaatatgcttatatgaggtaaaaaataaaaatattgtcaagacttttttccgctaacacaacataggaagtattcctgtttgaaatacacagaatctaaaatctgttgagtcaatagtgatcctctcttttgccattaactccttttaccagtttattccagatgcttatgtgcttcatttcttcatcacagttactaatgagtggagaaatgttctgaagtatccaagggagaaaatctatccagaatatattcatggactagcttattgacacataacaaattaaattgatggtacattggaatctttctataaattccttgttaccacaatgtaagcttcataggtttacccgaggtggaggtggttgaaagtggcagtaatacagtgaaaatgaaattagtactatgtagtatctattacttttcaggctgcatttaagaatagaatatatcc

SEQ ID NO: 94400 - DNA, 1037 bp, Homo sapiens
attgtatttatccaaaaattatttttctcatatccttttattgtttttttttttaaagtcccaatctccccacaatggaagttgagaaaacatagcaaaatagagaagagagagcctgtaatttgcttttggtattttgatgtatgctataagtaaaatactatgttgatttttttttctattaaagaattggaattatgcataaattttatagctttctttttttattttaaaaaaatttcatgagacccatgtccctttttttaaaatacacattttctatttggctctggaagttcaatcttgatgttttaagtgagatcatgagaaaatattatagctaggttgtgttactctttccaggtgttatttctaaattatactttaatatttatcacaattccaaggttgaaaaatacactgtttatgagtttctttgtgttttagatgtagataattctagaagtttccccaggcatttatctgtggaaaagtttgcaatgccatgaaaagattgtttagtactttattttgttatttaacaaaatcagtttgtgactctctactagactggaaagtctttgaaggcaatttcttttaaattttatatccacatgctcagtgccttattcatataagcatggaataaatattatattaataatattaattcaaatttaagtttcaggtttaattgggtcatacaagttttgttttgtagtaactctaagaaaatgtagaattcgtagtaatgagtgttataaattcttaatttgtggaatatactgaaattctaagcaaaatacagataaattaaaacagccttttatcacaactcagatttgacaaatgttaatattttgtcacttttggttcagatacatctatatttctctttgtcttaaaaataaaatgttttaagaatagctaagacctgacccccttttctgtccctccttcccatctttcctttctttgcttctctccctttaagtagtaactgtttacccaaaattggtatataggccatccgtgca

SEQ ID NO: 94401 - DNA, 1043 bp, Homo sapiens
gagttttgtcatttttacatgtgaaacagccagagaaattaaatgacttgttcaggatcatacaacttagttagcagagctggaaccaaagaaagctgaggtctctgtctacatttactttgagataatcacgatttttaaatatggcatacaaattgtttttccagtgattacagcaatgatactctgaagcacatcatctgatatttttaattgtctgaaatagaacttcctcttttaatttcagcatgatatttttttctttttttttttttccagaagtagaccactggaatatttttatatgatttcttatctatttgcctttgtgttaattagttctacatagccagattccattagtcagagtgtatattgatagtaaatctttttagccaacttattattgtagctaaatgttaatttttttgaaagtgttgatttcaaatgtttgttaaatactgtagtgatttttttcttcccttttacttacccagcagagtactgaaaaataagaggctgaaaaaagtgaaagcctaaaacttcttttaataatttgtcaaatgaaagatttcctaaaactaattttctttcagtacatttagctttttaatgaaaagaaatgggtatttttaattacatgtgactttgaagaatcagaattggattatagagaaatcattaagtatgattctctaataaggaaattgattttaagaaattttatcttttgcctttgttaacttaaaaacttggtttgtcctcatgactgccagtttttatatgactagttgaagaaataattttgtatttagcaatctttcaaaggtttttcttgctaaaaactgttttattttttcttaataagccagaagatatttcattctttttatcttcttgctaaaattaatatctttaatatagaaaataattttttaaattgacagctatatgtattcatgtttgtgtatttcttaattcctttaactgatactgcctatttaaatagtgactgatgctatttgaaattaaatttaggacta

SEQ ID NO: 94402 - DNA, 1054 bp, Homo sapiens
aagctgggaaggaatttggcaaaaaaagaaaaaaaaaactgttttggaaaaacaaaagcatgtaactgaatcttatgttggtatgatttattagaatctttatttctcaatttagcttagctttcatatatacaccatagctgtctttgagatgtgataatttttttttttaggaaaaaaaagttagttctagattgtgaatttggacaaataagtagaataaacaagttcagcatattaatcatttacctagtaatcactggggaaacatgagaatttgaagaaaaccaggaagtcttttttttttttttttttttttaggaaaaaggtataggtatatataaaaccaccagcaactaattgtcaaacttttactttcaaaagtaatttacaacaacaaaaactccacatataggaatattaactgaaaaatattttaggaaacaaaaattttagggaaaaaaaaagaaattgggcctgcgattgtcagtcaactacactaatagttgaaacgttaactgtatgttaagagtatattatgcaaaatcttaatccaaactaagttttaagtggaatgctgaattttttttattaataacatacctcaaagtaggcttttttcataaatacacaaacctttatttctgttacttgattttttaaatatacagtaaataaatgcatttgttctatttattctggaatacatactttcccaattctaccacttcccctcacgatctccaagaaactcacaaagaaaacaaatacctattttgactagatgtcctttattaaaagtaaatatgtaaataataaataagtagaagtaaaccagataaattttttggtttttataggtatatttttatgcaatgcttacagtgcattcagtactgaattacctttgctttacaaaagtagcagcccagggcttcctcagctttggtcaatcaagatcagtactacttgaaaaacaaattacatatatgcatcagagggtgggcactctttctctgctgcaatttgtatgtatttacttggggatcagcct

SEQ ID NO: 94403 - DNA, 1070 bp, Homo sapiens
ttggactaaaatatgacataaaactgtctaggcttttggaaacgtggtgaataaattctttgaggctttccaaaatcaatgttttaaagcatgatatatgtatttttagatgtaactagcacttctttacattgagagcattcacagagttcatttcacaaagtattttctgatcacaataacagtttaacgaggcacatacctttgccttcaacttgagagtgattaaatgctctctaccagaagcatcttctgcttttaacttgatggtactgaagcaggtatccgcatacacaagtctggtgagcagaggagaataaaaaatgatcacaccggggagagctggagaggggaactggagatggttgaatttgaaatgaaaatatttgctatattcctattaatccattataaaaatcagagcaatttctgcatgccaaccctttctgctgctatagatttactgccgttcatataccagcctagcacttaatgcagtcatatatctctggattatttacaatgtgtgtcaaggctcatgctgtggtcagtgagcactatgtttcagttttccatcactggaacctttggcacacacagcatgttcctgtcagcctctacttatgtacacattaaacttcctgtcaaactctttgatccatttctgtagtttcatacagtatgagactttaatgctccctttgtttttctcctcaatgaacttctcctatattatcaataatgttaccgtacaaaaatctagctggtatttgttcatatactcaaattgatcctctaaggaaaatgctgtataagcacaggtacagcctggtctcctaacaataaattttctttctgcacgatatatagcttctgacacttaacctatgcatgtattcaagatgactaatattctaaacatatagcacaagcacaactgctttggctttaagttaccctaaatgcatgaattttctacaatggaaaccaatatcctttgaaatatataattctgtaaaaatacggtcccttgagtagcataagctactgccaaaaaggttcaaatttag

SEQ ID NO: 94404 - DNA, 1087 bp, Homo sapiens
agagaatagcattgtaaaaatgtcaaaaatatccatatgcccagttcactagtaaatatactgctaaatttgaacctttttggcagtagcttatgctactcaagggaccgtatttttacagaattatatatttcaaaggatattggtttccattgtagaaaattcatgcatttagggtaacttaaagccaaagcagttgtgcttgtgctatatgtttagaatattagtcatcttgaatacatgcataggttaagtgtcagaagctatatatcgtgcagaaagaaaatttattgttaggagaccaggctgtacctgtgcttatacagcattttccttagaggatcaatttgagtatatgaacaaataccagctagatttttgtacggtaacattattgataatataggagaagttcattgaggagaaaaacaaagggagcattaaagtctcatactgtatgaaactacagaaatggatcaaagagtttgacaggaagtttaatgtgtacataagtagaggctgacaggaacatgctgtgtgtgccaaaggttccagtgatggaaaactgaaacatagtgctcactgaccacagcatgagccttgacacacattgtaaataatccagagatatatgactgcattaagtgctaggctggtatatgaacggcagtaaatctatagcagcagaaagggttggcatgcagaaattgctctgatttttataatggattaataggaatatagcaaatattttcatttcaaattcaaccatctccagttcccctctccagctctccccggtgtgatcattttttattctcctctgctcaccagacttgtgtatgcggatacctgcttcagtaccatcaagttaaaagcagaagatgcttctggtagagagcatttaatcactctcaagttgaaggcaaaggtatgtgcctcgttaaactgttattgtgatcagaaaatactttgtgaaatgaactctgtgaatgctctcaatgtaaagaagtgctagttacatctaaaaatacatatatcatgctttaaaacattgattttggaaagcctcaaagaatttattcac

SEQ ID NO: 94405 - DNA, 1087 bp, Homo sapiens
ggatgatttttcttcatacataaatccatgtcattgaataactgcaaattatctagtagtaaaaaaaaaatcatgtttttctaggttggtaatatgcttaacagtatttaattaaaacagtttgctttcagctattgtttgaaacttacacatgaatcagtaaatgtgaaccagtctgacaacatcctctacattgtcatatatacatggaacatggtacactgacacatacataggaatataaagctttcatattccttattaaaaagtttattatgtgtttggcaagctaaaacttacatgaaaaggagcaatgtgagtttggaggaatttgaagcattttgggctacaaataatttaggagagttcttagaggagatgaatgttgggataagctttgaaggaatatacagagcctttaaagggaaggaatggtgaaggcaaggttgtagcaatagaaatgtgcaatttattttttgactttggagtagatcagtggctcacataaggggattaacatattagggctaaacagaggggtcttgactacgaggctaatgattctctatatgcaggtgatagggactcattgaatatttttgagcaagggattgatatgattaaaaatgtatttaggaagattagacacagaaggcagaatggattggtgtacagagacgaagtaaagacacgcattaggaagattgtttctagtaatccagatatgaagtagttaatgcttaaacttgagagtggcaataaaagtggaaacttggatgctttattcaaacatgaaggtcttcagtctgtcttttgaagcagtctgcctgttgatgttaatactacttaaatgcatctagatggctaaagaaaataaaagctaaataacttaaactcttggtcaatataagtgcagtattttatgagctatgtaaaacacatttcttctactttgttttacttgttgacattcagctattaacagggacaacaacaaaaacatccctgaagctttattattaacaaacattttaaatgtttaaaaaatttaacttataaagaaatatagcaaatgataaatacaaag

SEQ ID NO: 94406 - DNA, 1053 bp, Homo sapiens
atccattactgtctggtagagtgacaaaacctatcaactttatttttatggcttaactcttaaattaggtctggtacacacatacactgataaaattgggtttcaggacctgctgatctaaagctgagacctgaactgtgctgtccacatactagaattgctactgtttaaggccccgcctgaggagctggctaaattcttaatttaaattatcttttgaaatgacacacacaatgatttgcatgacagattgatttaaatgtatttacagaatcttaatgatttctagactctgtcaataagtctgtattttccttacactctaaataataatcttgtagatttgtcagtataatcataaaatctgatacagaaaaatccttgttagataatgctggccttgctgtgtttttaaattacatatttggtatttctaatcaactctataggattagacattatacaaattctaagttggaaaagaaaaagaaatatttaaaataagatgaaagcttccctttctttccttagaaagaaatatggaaataatattgagaattagtagttgaccttaagtttgattgctattgttataatttctgttcttatttcaatttctataaaaacacagtcaaaacagcaacttccccaaaggttaacgtgaagatggtatgacaggtctgggttattttgggtgtaacactggctcacaaaggtaagtgatacaaaatgatgtcttggtgggtttctgttaacttctgcccatgttgttttacagaatggcctattaaaaaaataagaattaaacagtcctttgtgtttaacaagattttctgtttggtattaagagtatcctagagttgaaagtaccaaatacttttgctttgagtagcttatcatgcataccattttgcctaggacagccctaatttatgctttttgttttggcccctgtcagtctcaaatatgtcccagtttggaagaaatacatatcactttatgatatggtttggttctgtatcccctgtgtccccacccaaatctcatcttgag

SEQ ID NO: 94407 - DNA, 1048 bp, Homo sapiens
tttctttagaggtactttttaaaaaatgtatatatcaaacatcatattcatgggaatagagccatagtgaagccttgaggatgaatttaataaaaattttttttttatctccgataggcataatagtccaggagaatattaaaatctcaagttattttcatggcataaaaattgacattttgcatgaccttcagtgcagtcctttaactttttcttgtctctttttcatgagcaggggaatgagtcagccagatttccgtaaaaaaacaggcacttttattaggcactaagaagataatgaaattatgttttgcaatcaggtattaacagttcattgtcttgcgttccacagctaattcaggttttcttcttttaaacaggaagttgccttaaagaatagacaagagctgtatgcactacctcctcctccccagttctactcaagccttattgaagagataggaactcttggttgggataagtatgtctgttttaaaatatgttttaaatgcctttgttttatatattttaacttaatgtatttctagttttagcagtttatacctgattttagtcaaagtgtttaattgtaactagagtatttgatccttattgttgctgtgaattaaagagagggatatcatcataaaaaattgccttacaaagtaaaatgctaaatataatttggaaaaaatgacatttttatgtacacagtaagatgttaccgtaatagatactttcactgaacatacaactgtattctaaattttccatgtttgaagagtaatgctgagacacatgaaagagactggaaaaattgcagtatttctggaataattgttatttttggttaatatacaatttggcatgtctaaatttacatatatataacattataagtgcttttgtaatttgagtggtaaattttagcaactagggtttgtaagaatcatccagctttctttgaaaaaaatgattttttttttaaaactgatgcataaagaaacttaagttcagtaaacgtgtatgcaagttgttaaaacttaat

SEQ ID NO: 94408 - DNA, 1019 bp, Homo sapiens
ttcattttattccgtaactgtaatcagccatttctccaaagaatcatgatttctttgtgggaaatagtatttggatgcctcaatctggaaacttgagtgtgcattgctgttacttgtaggttttttcagtggacaaaactgagaaaaaatactttttggaaagaatataattatgagtttgtattgatatttacaattcaaattggcattatagaatttttacttgtttgcttgtatcacttttactctgaaaatgctgttttctaatgttaacatcattgtagtatggttttttgttatgttctacttgttatatttcacttatgcttttcctgtctatgtgttgttagtttatataaaaattacaatactaatattgctaacaatggaaagttttgatatttctttgtgatccttgttgagaccattttattcctagcagcagctactacatattgataacttagttgctaggttgttttctggagtccttttttaatgctaataagaaccttctaaggtaggactttgattaaatgtgtgagattagaataatagtttaaaattaatttctaaagtttgaattttgatttatgagttcataaatcctaattaataagggttatcaaacttgattacaaattacatcaaaggccttaatgtaataaccttaaaaaggtaaagtgaacaagtgaagcatatttggtttacatctccttgacattggagaaaagtttgcaacatttattttatctttttattataattttaataaacaatacaaatacaaggagagactaagggaaccagagtaaaagtatagatatcatgtcccattaaactcttcttatcaaaaataacttcattaaattgtaagtcacagctctcttggccatgtaattttggagaaacacttattagtttaaaactaaaataaaattttgagatctctgatttacaatatctatttagtatatttattcaatttctgaataaaaatgaaatcctgtattttagct

SEQ ID NO: 94409 - DNA, 1013 bp, Homo sapiens
ttaacatctaagaagagattaggtagtcctacttaaagatataatatgatgtataaataattttgtgtatagctacagatatctgaaaaacttattaggcttcattttatgtatactgttacatatgtactgtttaatcagtgttgcataaaatacttgattattcagtttatcctgtagacattttattattttcttaaaacccaagttcattttattacccaagttttcaacataaacaaaagaagagggaagattatagtgaatactgctgggcctgaccaaattttaacattttgccaatcttatttcctcttctacttttttagaagaaagacaccatagtattttaaaggaaattctggatattgtatgtatccctctgtaaatatgtcagtgtgtatctctttaacagctaagtgctttttatctgtttttaaatatattattataacctcaataaagttaataatttcttatagctgctttgtttgtattagtatgcaaacaaggtcctcacattatatttagttgataagtctcttaagccttatataagacttataaggtacttatgtataacatcatctctctcctctttacctcaccctttttattcatgccatgtatttgttgaataaaacaaattaggtgtcctataaaatcttctacattctggatttggcttgtaagatattcatggtttatcttttaacatattctactttctttgtaatctggcagttagatctagaggcttcagcagatttggattcatttgttcttatgagattacttggtgctctgtatttattatattacatgaggatccacgtggtatctgatggttccttggttcctgttttagtaaatttaagattgatcaataggtttagatccattcaatataaagtttcccatcagactgtcacctaatgattttagcctctaataacaatcattgcctgtatctaatgtttcattaggatttacaaatggtaattttaaaaatt

SEQ ID NO: 94410 - DNA, 1050 bp, Homo sapiens
tagatgctgacatgtagccttataaccaccatttttagaagctatatgatgtcaatttactatgcaccttaataggttgtaaaaattttctcgtggaaggtcctttttggtttttaattttgttgctgatttctaatttttcttgtattgtaattagacagtattgtttataaaaaagtctccatggaacttactggtactttttcctgtgacctaatatgtaatcagttttaggtgttgtctctattatcagattttctctttccttttgagtgagctttggtagtttgtgtctttcaaggaatttgttagtttcatctaggtttctgattttattggcttaaagttatttacaataatcccttattatccttttaatgtctttaggatctgtaatgatgctctctatgttggttatcttttgctgctatttacttcaaaccttagtggcttaaaacaaaaacaattattgtctcactgtttctgtggatttgaaatttgcgaacaacttggatggtagttcttgatcaaaatctctcatgatcttgcaatcaagatatttgccaagactttgatggtctaaaacagggtgtccaatcttttggcttccctgggtcacattggaagaagaagaattgtcttgggcacacataaaatacactaatgatagctgataagctaaaaaaaaatcacaaaaaatcccataatgttttaagaaagtttattaatttgtgttgggctgcattcagagctgtcctgggctgccagttggtcaagctagaggtggaggatttgcttccaagattgctcattcacatagctattggccatgaggcctcagtttgttactgctcttaacaggaggccttagttcctcaccacatggatctttatagtgttgcttgactgttatcacacatggcagctagcttctcctgagtgtatgatacaacagagagatcaataaagatgcacattctctttaatctcttagtctctgaagtcacacacatttacttctgctttattgtgttagatgcaagtttctta

SEQ ID NO: 94411 - DNA, 1058 bp, Homo sapiens
gagaaaaacaaattcttaggtccttcaagttaacctctattttcctttcaataaaactttaaaaaaatgtttagtgcattcagtagtttgctttttctctttcttttgcttcctctttccagaaccttagttaatatctgtgtcctatttgggagaaaatcacagccaggactagctgtggaacagagcaggactggagttggtgacatttaagcagccttgactgggggccagggcagcagaaccaggcccagttgcttctcttgcatacgtctttttgaggctctgacatcacactgctgctgggttgctaatgcaccattgtaaatcgtacagtgaattgctgtattacctgagaaagaaaatgctggcattaaaaacaatcttttttgcattatcatagcaatcatatcttctatacaaaaaaggattcaagcgaattcttgattcataatttttattataccctgtggaaggcccatctggaataagatatgcacgtactatttctcttcttccccttgaaggtggcaaacactaggtggttggttctcatttgttagattacaccaaattatgtctattttttgcttaatcaccaaagcaactttctatccagctcactacatgtttagtaaagcaaaacttatttcacaattactatttggcaggtatagcccatcaccttaccatcccactactcagttctttttgacccattgacattttaaaaagtaaggtttatcttcagagagcagaatagaaatgagagtgggtagcgagtcttagctaactcaagaactcaggacttagtggagttagaagctttcagtgaagattgcacatgtgtattttcagttttgtggacatgagaaacacaaagctggtggtttcataaagagcttctacccagacacttaactcaccagttagcttgagatcgcattactcagtaaccccaagcacattctcataaatggattttatgttgactccttgtccatatcagttcagagatcataatcatggaagaaagtgaattgccttccacaatgact

SEQ ID NO: 94412 - DNA, 1031 bp, Homo sapiens
cctgatcttagagtaagaaattgtttttatgtttactttttggttcccaaggttaatcaatattcattatggccttactgtttttctttaaactgaggaggttaaataagtccttctatagagaaaagaaaatttaatactatatatatgaatttgggatgcaaaatatgggatggaagaattttgcaatatacacacatatatcgttagaaacaccatctccaaatgtaaaaatacttattatatatatacatattaagaaatttgaatctacatctttctcattggtagctagcatcctttcttactcttgtgtgtgcatttgaatgacagacaaatttaatgtatgatatttaaacctccaatgctggtttctggaaattgctgtgtagaaatagtcaatgcctaagtctagaccttgtctactagttaagtgtaaattgtaggctccagtgaggcagatatctgtgatcagtttaagctagaaatcaatctctagactgcattattacatccatgaagcatttcttctttcctggttttcctgaagtttcaaggtagttgcagtcctggtagtctgggtatcatcagtaagtactctgtagtctcaccatttggtaatcagtatgtcaataatgctgggaaaactgcttaagctcgcaagatttatactcccaaccatgtaatagataagagttgcataggtcgttccacatggaacttcattccaaactcaatctgttcttgtgtcagctaggccccaaagtaacaatttctggtaggggtttttggatctattacttggcaaacatttattgaaactcaagcaaaaacaaaatgtaatgaaacccattagtctacagaaaaatataaggagaattgggatatttttctgcctctgaaatcaagatgaagaagggtgttgaggaagcctgatagtatcaataacaaaggaatggtcccccaaatcatgagaggccactgaatttgtcaaagaggaggtcattgataaccttaccatgggcattgac

SEQ ID NO: 94413 - DNA, 1112 bp, Homo sapiens
aatcatatatatatatatatatatatatacacactgattccttgtccatgctctgcaggcagatcagtatattctcccccagatttaaaactaagagtattggaagtaattaataatctttgaatacactgtaaatctttgtcatttattgatgaatattcaatcatatatttcaaaaaactggaatgtacaagtagtacaaagttttgctcttataattgcagtacagagcaatgatttagtctgttattaaaataaaaggcacaactttaacatccttagttttaatagtgtgatctgaagtttattttgatggcatttctcttgaagttccatcttctagaattgtctagctgagcttacaacttactactcagttaaaaagagtaattaaatctgttaatgcacaattgtggaagtatggatggctttttgaaatgcgatatatttaacctttaccttatttattaaatcatgaaaacagctcacaggattagaatacatcttaaagttttctagccccaccaccctcatgatacttatctctaaattttttgccaaactattcttcataggtgtacctcagttgtaatgaaccacctcaggattggcctcctaccagatgtaccaaacaatgccgttccctgcccccaatcccagagtgctgcttacatacttgattaagagaaagttttggcatcttctgaacctagaaagaggtctcttattgattgttaattgaaggtgtgtccgttaattttaagctttaaacacctcatgtgcccttagcaattagacttttgtttctaacttcctcaaaatctacattaaaagacattcaataattggaatgtgaaatgatgtaagaggtagtggtgtgctgaaataggctcctacctgcttgtatggctcactagttgagtgacattgagttaagtgacatccctttggtagcttgaaatcagccatggtgggatcatttacaccacagaaaatggcgagtgatttaaatccccctcactccagccaactgttaaacatttaccagtatactactgcataaggaggtgtacataattgaatattaaaggagataacaggtaaaatgcatg

SEQ ID NO: 94414 - DNA, 1028 bp, Homo sapiens
tagaccataacagctgttacagtctattatgttaactctcatagaattatattatggatttttaaaaacaccataaagaacctaaggaatgaaatgatagcaatgaaataaaatataaacttccacttattatagctctctcaaaagaggagaattttgagttcaggtgaaactcatgactgatactttatcagtaatttctgacttaaaatttattcacaaaaatataggttaaggaatcaaaggatgaggaataactgggcagtatgtattaggccaagtttttaagcatttccaaggataaaacttactcttggtggcataaataaagacttgtatgtaacttttatgttttttagacctcataaaattgcagtggagcataaaaatgaaaactgtatttgtgtcttttatgtattatttaagtatagtagaattaaaatactgtagaatattctctggtttatacctaatgataacatgttggggcatattcgtgtaggctatatataatgataacatatgcatttgtgtgttttttgtgggaattacagttgctttcttgaccttttaagggtcctcatgggttaaggattcataccatacattttatggctcagcttctgaatttattctaaagttaaatacaagatcaatgcaactaaatgaaacttctatccgtaatgactactaaatagcaaggctcaatcaagcaagttagaatctgtcatttagtgatattggaccacatattcttagttacaaaacatagtataggagaaacctttgatcctatttgttaggtattattttgtaaaatatttgacagcttaaagtaagtgagtgcttgagtttcagagaactgttgtagaaaagttaatcttcacatctcttaaaatttattttcatttcacatttgagctgtagacccctgacaagtctcagcaatactgtggacaaagttacttaaaccaggggctttcaaatttctttaaatgcaactcctgataagaaatatttaatgttag

SEQ ID NO: 94415 - DNA, 1056 bp, Homo sapiens
agtattcctcagtgatctctgtaatgttcatgactctgaataggctctgtgggtagaatatcttcataccacagctagtttatatttgtcaattagtcataatgtcaaatacatgtcatgacaaatcttttgagtttcaaaaaacatccgctctgctgttgtttcacccatttcttctcctgcatttcttcccttagagttcagctctccatatatccagcctctcaagctcctaactccctccctgtccttcattcttcttcattcttcctctcttcattcttcctgactagtcaatgccacatcttttatggtctatttcctaaatatatcttgaacttgccccttgtttcctttccgactgccatttcctacgttcagaccctcatgatttcctccctggattcctctaagcctctggagtgatcctcctgcctccagcctactgctatcacttttgtcttccccacagctattggggcagttctaaaaatgagatcatgatcatggcgccctctgctgaggattccctttccctttgttttctctgaccagctttgctcatccttcacaacgtggaaacagcgcctcctcccataggccttccctgcctccctgcgtccccatagcacgctgagtgggcctagtagtaccttgagcatagctctattagggcactgtcaaactattttactgcgtgtttgtatctcttcctcattaaattttaacttcttaaaggtaatgaccttatctctttggcaggaaatattaagtacccaataaatatttgtggaatgattagatggcagaaccactgtctgaaaacattaacctccaattcaggctggtatttttcaattagatttgtcataagttgaacttgatcttttcaatggttactagagaaaatagaaatagggaatggagaaataggagacacaacttagaaagatgaaaatttcccttctaattacagagttgatcaggaattttgtggttctagaatccaaactgtaaaactactgcttccatcgcaaagattcattgctactgtaa

SEQ ID NO: 94416 - DNA, 1035 bp, Homo sapiens
cagagaagagaagacagttgatccaggagtccaaattcttgggtggtgacatggaacacacccatttggtgaaaggcttggattttgctctgcttcaaaaggtacgagctgagattgccagcaaagagaaagaggaagaggaactgatggaaaagccccagaaagaaaccaagaaagatgaggatcctgaaaataaaattgaatttaaaacacgtctgggccgcaatgtttaccgagtgctttttaagaacaagcatataagcggaatgagttgttcctgccgggccgcatggcctatgtggtaggcctggatgatgagtaagctgacacagatatccccaccactcttatccgcagcaaggttgactgccccaccatggaggcccagaccatactgaccacaaatgatattgtcattagcaagcttacccagttgctttcatacctgaggcagggaacccgtaacaagaagcttaagaagaaggataaagggaagctggaagagaagaaacctgctgaggctgacaggagtattttcgaagacattggggattatacaccctccacaatcaagacaccttgggacaaggagcgggagagatatcgggaacgggagcgtgatcaggagacagagaccgtgaccgagagcgagagcgagaacgagatcaggagcgagaacgagatcgggaacgagaacgagatcgggaacgagagtgagagcaggaccgagagagagaagaggaaaagaagagacacagctactttgagaagccaaaagtacatgatgagtccgtggacgttgacaaaggacctgggtcggccaaggagttgatcaagtccatcaatgaaaagtttgctgggtctgctggctgggaaggcacagaatcgctgaaaattgcagaagacaaaaagcagctgagagatttctttggcatgtccaacagttatgcagagtgctatccagccacgatggatgacatggctgtggatagtgatgaggaggtggattatagcaaaatggaccagggtaacaag

SEQ ID NO: 94417 - DNA, 1050 bp, Homo sapiens
agaaatagaattagataacagggtttcaaggtgatttcttctctaaaaaggaaaaataagatgtgctccagttcatgtatcttcaatgctttcaattatcttaatgtgtattaatatatattatatgtgataagtataggtttataagagaaaacctcatcaattagctattcttgagtacctttgcatttggttactaaggaataacctgttcatgatcaacagtggtaaaacagagcacagtaaaacactgctctatctgaactaaagtagatcttcaaaacctctttgatgtgcgtgcttctttaggtcttaaggacacattaaagtgtatgttgaactttctaatattcactttatttaacgagaaatgttttccttcctgttttgccactgtctttcccttccatatccactcccccctccttttattttattttattttttgttctgagaaatgattatgtgtgttcttttcctatttaaaatttaaagagttacatttgggagaggaacaatgtagggaaaggaaacccctggagtgtgtctgatgtgatcgttctcctctgtgccaccatttttcctcctgctgtgggagcgctaaatgataatgcctgataccttaccgaataaagcctgacacggtttccagctgtgagcatgtgatcagtttttatgtttgatttttgcacacaagtatactactgcaagcatgtccacaaactacttcacaaatgctttaaggggggaattgctcttgagtgaataaaacattaaacaaacactaagtaattgcatgaaaaaataaaaaaccttcatttattttagaaagccatgtttctgttcaaacccagacttttaaaataaatttaatttatattcaatggtcagatataaccacataaccaatcctctatgaatttacttgcaagcgaattttaatctgagatgagttgtccaaacagaaaagagactgttacttcctgtactttgctgcaatgattaaatatgattgtaattatacaatatgttgattcatttgtgagaaac

SEQ ID NO: 94418 - DNA, 1032 bp, Homo sapiens
cctatactaatttaggaagaaagtgaagaaatgtgacttttatttaaaaaaatggtctttttggcaaagcattaggtcttttcattcactaagccttaagtgtgtaagggtgcaagtgagtgtgtttgagggacgaaaacatagtcacactcatacacactgtgaagcaggtttgactgttctaggtgaggaagaatattcagttcagaaaaatttaaactcatattagattgcatatatatatatatatatatatatatatgtatgtatgtgttttttttaatttatctcaaggaagaactccaagtaattgttgtcttggggagttcttaatttatgcactagaccatcatgctgattttaggtaggtatttattctgctattcaatcaaaaagcatagtttccataacaactgccacatcagatgaaacgtacagcttggcatttgaaatacaggacttcttaggagatatgcttcctgacatattgtgttgaacttgtgttcctttcattctcttttaagctagcaagatctgtgtttctataaaggaccatcgcagttttgcataattattacaatccatctgcacatttccaggatttatattaaagtaattaaagccattttgtattagtgggtgctgtgtggaagcggcttggatgcaggattctaaaagttcccacttgcctgcttgctgtgctgtaatttggagaacagaatgttccgtaaatgaggtttgggaatactacattttttttctttcttttctttgcaaagttactttttttcctccagtggaaaatggaataaaaggttcacctagggactggaattaatgtagtccttctgcctagggttaaaaaagagcaaaatcacagctagcaacattgtgcaaaccctaatatatttagctttttctatgaagaaataataagcctgtgtttctaaggcaactttcttccaaggagcagcaagcaatttaatttatattctcattttccccagctgtatttgttcaagataaatgagg

SEQ ID NO: 94419 - DNA, 1040 bp, Homo sapiens
ctccctcttggccttggacgccatctggatagaagaagtttggtttaaacttcttagcactctaagatggtttcttaaactgctccatagaagtccctcaaggttgtaaaatctatcactcgaagccccttaccagaaaatctgtacccttttagactgcagcagatgactgataacataaatagcatacttacttttttttctcagaaatacctggtaggcccaatggatctttttacacattctgaaagccattaactttttctaattagaactagacaggattcttcaactgccccaccctcatgtcctttctaagggcccaccgtctgccagagctggttggaatacaggtggactcctgaacctggggcagcccggggactaagacaagccctggctaaatgaatcagagtttttccccatcaagaaaattagaagcaagaacagagggaatttgcagtctgtgatggacccttgagatgaaaggtcaaggtcttatagaattagagctgggtctgctttcctgatgtcacctgcacactgaagtcatgaaaggctggatagtgaagacctgagaaagcagccaagtggaggggatggatcaaatgtgcagagagaaggaaagatgacaccgtacaggccctaagagttggaggtgatggcctcagtgactgcatgcaggtttccaagtccaggcccaactctactgtgtttcctgtccttggatgcatggatgtccgtgacatcatcattgttgtgtccatctaactctcctttcactagcttgagaggttttctattcctagcaatagaaaatgctctgaacttgtccctgtcaggctttacgtgaccatggcatttattttattttattttatttttttgagatggagtctcactctgttgcccaggctagagtgcagtggtgtgatctcagctcactgcaacctccagcctcctgggttcaaatgattctcccgcctcagcctccttaatagctgggattacaggcgcctgccatcatgccccgctagttt

SEQ ID NO: 94420 - DNA, 1056 bp, Homo sapiens
tattttaggtttaaaatgaagagtctccagctcaggtttattggccattgtgacagtacaaacaggtctcttccccatcacatgcaacagtaaactgcattgctgggaggtggcaaactcatgcaaaaaggaaagcacttgacaagggctgagtgaataatgctgcgagcttaaaaagaccctgttaaatgcctttgtatgttatttgtatacaatttctgattcttaaaaactgaaaattatatttttgattctttttcttctcgcatttttatagtgatcaaataagtttcctttaacattataatattaaaaataattcaagagaatgtattttttcatattatatattaaaatgaagttaggtcatcaagggaacactaacgagggacgctattgtggtacagtgcattgctatatatgtttagaaacattaggggtcaattgaaatcctgatatgatttaatcagcatttaacatgtgatttattctgaaaatccagtagagaaactatgaaattcctctacatagtagccattcatagactgaaatgccttttagtagaaagaatggaaaacgtgttcccaaatgggaaacataatcccaaaagcgatccacaacccatattcaacatctcaacaatatgagatgttgatatgaaatgtaaaatgaaatgatctgatatggcatataagttgatttgtttagcattgtctctttcaaaagtctcttcttttttgtattatactttaagttcaaatgtctcttctttagaaattattgaatcagactaagtgatgtagctcatttgtgcaataggtcagggactgggttgcaggaagcacacacatgtagtctacaattcactacccaaaatccctgagacggagacgtgtttagaaattttcttttagaaaggtactatggtgcatataccgcagattatgcaatatctccagctgggtctggggcagcaccctataatcaaacacattcatgtttctgcatcgcagtgtatgaatattcacattgagtgggataaataaagattctaaa

SEQ ID NO: 94421 - DNA, 1030 bp, Homo sapiens
ataaccagtggggtgggtttagaaacctcatgactgattctctgcttcttgttttcttttaccttatttttcttttcttattgagctcttagaaaagagacataattacatttcatatatgagcactttcttttccagtatatatccttggaaaggaagggccagatatgtgtattttaaaaagaacctcaaattaatctacatcacttggaataatcacgcctgctgctatcatgtctttgggtccacttctcaataaaacacttatttttatattttcagatctattgatatttgcttagaatgcaatttcctcttgtatgaactgtggaataggatctatttcccttgtctgctcaatagttctatgctgtctcattttgccttctgcaccttaaatatttcttatgttgtaggtcaaattataggtgaactgtcatatccccttatgtctatgaaagcaatattcttcggagaaaaatataaagtatacatttgtagcttgtctgtatcttgagagtcttctttccattctatattttggaagctcaataaagctggagtttctaacctttgggtcacaacatatacccctgattaagtttctctggcttcaaaagtagctacaagaatgagaattgttataaaggggggaaagctcttcaataattaggattcatctacaactagagcattttattaattacacattgtaatcacatggatagtcacaaaaccaatcgtgcaagtctgtatttagagatttgtagacagaagacttaacgtaaacatagaaatgttaaacctactcaactgtaacctgcaaagaagataacaagaaggattctgttctctgtatgatttgtgaacaatgctaagtaaatattcatcattaatatataataactgttgcttttggcagttcacttttcatttaatttgataatgtgtccagtaaatgaagtggtacaggctacagtgttttaccaacacaattgcatattttcaatcattgttaaatgaaggcagc

SEQ ID NO: 94422 - DNA, 1067 bp, Homo sapiens
aagtggtgctggactcagaatcagcttgatattattaaattatttttgcttcagatctattcttttacaagatttatttttgacatttgaaattagatttgaaaatgtatttatgattggtatttaggcctaatacttatgtttatttatttcagggttcatcgctaagatttatattctaactttccaaaatttaaatttgcaaattaaattttaatttgagtattagtagtcttttctttccaatctattttcctttcacctcagattgttctttctttatgacatcttgaggatgcccaagagttttctaaagttgttttcctgattcctataaaaccaagaaatatcgaaaacttctaaatggtactctttgcttatagccatatgtaaccacaggtctcttgtttatttacattcactcaaataacaactttttccaattcattgttgttaatttgtcctccttgcaccttttcccacatactattgggtaagttgatgtgttcaccttcctttctaatttccagggaccagggatcatttacatactgtggtcttgcattactgcgatgaaatcttccaccactcccaccacccactacaagagatggaattaattgaaactacagccttcaagagacatttggagcaatactcttccagttctttcttccacattttatttgtgggtacagcgtctcccaggatgtagtgtgctgtaattattcttccacccttttattttctgggagtttctctatctgaatagcacagaaatattagtggataggaagggaatataatattctatccatctgaaaattaacacccatgttgaacagaatcccttttcagtttcctgtttactacagggtccaaatctctgagctgagctgtgcagcagataataggagaagaaaaaaagatacctgctcctctttcaaggacgtggacttttctgttttgtgaagtgatacttggataggctactggatattttctcattcttgactcatcaaccttataattggtctaagtttttcccaaatttgtagctctggatt

SEQ ID NO: 94423 - DNA, 1058 bp, Homo sapiens
atattctttccactagaattatctgctttcttgctcaaaaagagtcaactaactatctgaaaactaatgataatttgcaagttacaagaaagccattttctacctttgttatacttgtaataaatcctaggtccaatgaatatgtttttaaatatgtttcaaataggtattactaaagtaaaccataagagagacaaagtagaattatttccctcaagtttttgggaaagtaatattctgttcagagaatcaaatggcattatccaaatgaaagtattatttatccctcaaaggaatttctacctattactcacaatttagttaggtagattttcttctcatgtttgagtttcttttccaaaatcatttatcttttattcagttgaaaaatacatatatattcttaagcggtattattgagaagttttccactaatgggggagtaaagaataaaacaaaaaaattaatacatgctagaattgctcaaacaacttcaagtacccatcttataaacccataatacatttataggtttttgaaattgagaaagaaatctccatttgctctagtcaaataatttttagaggtgctagaaatcatatatacatatatgtatgtatatatgtaccagatttaataacttggcatgcattacaagaaataacatttttctcacattcttactttaaggtaaagatttttaaaaaaatactttagtgaattgagatagtcactctagaaattaatgctaaaatgtttagtgatgcacttgtactaatttaaaaacataacttgttaaccattatatagtatttgtttccaaacatttaaaaaactctaataaagattctaacacaattgtaatcagctacaatcaatatgcaggagctggttttcattttccactttgcactgagaggcagttcttaaagtgctgaagacctagctgtacttgaaaatggctgagatttagttgtgcttagatctcttatattcctcctcaactttcaagacatgctttcatttgataaggatgctttggaatctgaattttaaca

SEQ ID NO: 94424 - DNA, 1094 bp, Homo sapiens
gttgacttcacttggagcctgctctcataagcagaaatagggacactggaaagatttgttttggaaaaaaaatatgatgatataggttgtacatggtttaatttaggtggaatcattattgaaagtattcttggttctaagcatcaaaataaggctgtcaggaaggagagagtcacggccatattggacaaagggatagtaaaattaacagggatctaaggctgccaggaacgggccaaatatggaattaaaatgaatccagtcatggcagtagaaatgtgttaaatgcctggcaggggagatgcttggagtctcaggcaatcattgtggaggagtcggaggccatagacacaggaaatatggtctagtctctcagggggaaggaattagtaagaactggctcagagacaagggacccaggtacctcctgaaaaactgatgcactattcagaagccattcatacaagttgtccagacatataggtgacatgatttaggggagggcttaggtctgccaatccacaatttccatgggctcagagtagacatattggaggtagaactaatgttgacctcatggtctagaatggatgtgtcaatgtagcaatatacattagccaccttggaaacacatgacactgtctataaggtgagggtgttcctatcatattcacaattgaaagggaatagacaaggctcagactattatttaatatactgattttcaaaggatggttaatcaaaattttcttgcaggcaggtagaaatgtagttctgtccctcaaaaaagtgaatgagattctgtgttccatagaattttgagggaaaggaggaatgaaattttagatatatgataagtatagtgagcaaattgttataattagtctcactcaatttttagcagagaaagaaaaagagatgggttcatgacagggcaggcttactggttttaaataatctagtggcccgtcttgtttttagatggaagagaaggagccagcaaaactactgcagaggagggtggagggcctgtcagatggtatgaagtcctataggagacagagacaaaaggatgagcttgggtgaagagatga

SEQ ID NO: 94425 - DNA, 1076 bp, Homo sapiens
tttttttactccttaaagcctggtaacttttggttttatttgaggactgagaaagctactcacatttgaaattggaggaaggaaataatttcctttgaaacaccacaaaatcactgcatgttactaatactataaggcttctttcccattcagtttatctggagaaaaactgatttgcatatgtttgcatctatttgcatgttcaattcaagctactcccaactctaagtatataagatgaaacaaattaactccttgttttaacctgctgtgattcttgtctaatgctgtgtggtgggtttggaaattgtaagtgccttggaaattggtgtagaattcaagatgtgtggaggtgggcattcaggatatcatgttggccttaggggctcaggggctgagagctgggaagccacaagaggcctgggagagtgtcaaaatgggcaaatgtgtccccgagcgtgagcttacagagcaccccctaattgagcaagggaaatcacagaggagggttttgagaaactgccatctgcaatcagggacttagagctactagaggcgaagcttatccttggtcctctgcccttgacattactgccctcctttcaaggatcctctagcatgtccttaattttttacaaatctatattgtaaaaggatggcttatcttcatattacatgttcactagacagattatggaaaagaaaatcttccctgaattttcttcccctaatatgtgtgtgtatatatatttatgtatgtgtgtgtgtgtatatatatatatattttttttaatatatatgtatatatgtatatatgtgtgtgtgtatatgtatttatttatatatatatatatatatagtagcatatccatcaaaccataggaagtaaaatgttagaggaaattttaggttctttggaaaaccagtaaatatattttctccctgggagtaggtggtctttgaagccactacataaagacagttacttctttactttcttattgggccagactttaagcctgcttttatcagggcagtagccacttgccacatgtgcccattgtacaagtaaaatg

SEQ ID NO: 94426 - DNA, 1010 bp, Homo sapiens
tgtgtgtgtgtgtgtgtgtgtgtgtgtgtgtgtgtgtgtgtgtgtatgtgtctacaggcatgtgttctaaccctccagtcccaggtagaaattggtggggtcagttctgggatggtgatagaatctggcagcataaagtggtgtgggtgggtgtcgcttcagctagaaccaaaatgctcagatatccttgcaggtacaggtgtgctgggatggactgcaggactataatgtggagatggcacctgccaacaaattccagtgaccaaacaaagggaatgactgctctttggagactgtaattgtggtctcacagcagatctcacattgttctatgctccgtggtaaagggacaatttatgtgttgtttcaagaaattattattcacatttcttcaaaagaactctgctttgtagtattcctggggacattcctatttgactgcaacagtgactgccttaaagtggtgagaaaaagtgatcttcacacatagaagttaggaaagcaaaggtgattggggactgtggtataaatgtgttattaaaattcatctcttatatggtgagctatatctaatttcagaaatagattttatcaaccagaatcagcaatatctttcagtctgcagttctctgttacacagacacattctctattaaatatatttttctcttaaaactgggaatattatctgatgcctgtgtatgagtgacatactccaagtcccatctgctgatctacctttcaaatattccgatgtcctccttgtttcccattttttactgttcaggtcctccacagaacattactgtcccagcagaccttttatccaaggactgttgatcacaacccaagagctgtcatcctatttgcattctgtggaagcatcattattcacaacacttgatgtccataaaaacacattaaaactatttccttgagcaaaaataatcagctctctgctgtacatatcatttgtgtactcaaattgtaaaatgtaaattgatatataa

SEQ ID NO: 94427 - DNA, 1074 bp, Homo sapiens
tctcctaatctcaaaatgggcactattcacagttagcctgggagaggctggtggaagaaagcacactttgcagacaaggccactaagatgaatccaacaaaaataacaactcaaacaacaacaaaataaccagcaccccagcctgccagcctgctaccatgccacccagccttttaaaaatcaagatatgaaatgcagagctctaaggaatctgttttgttccctgtgatcacagtggtctagattccaatcggagaggtacctttccatgcctctcagccaaacttacaagacaaaaggctataaaaatgattgcacttgccttagtgctgttaggactctggtatttatgagacattatgtaagcacaagaacccttactaatttgccacgtttcatgcacacctggaataatcttccccgtgtataccggctttttttttttttccttttccttaatttccaaagaaagcctaccccaacaggaaactgttcattttgtgtcataagccccctgttctataaagctgcttgggcgtaattaagtggctacgtttacttcttcatgtggggaacaatggtctggctccttggagaggtcaagcaggatttattttattgtgtacagagtcggaggagtggaggaggttgtcaagacagtagctggtcattcctttgccatttatgtggccctctctatgtaagagtaaggctgtatatattttttcaacctctgatttgcttcccttttttcctgggatcattgctacaaaactattaggtaatactctgttgtaaggaaaatcagtcctgaggaaaatgtgctatgcatgtatgccttcccccaccctcaaattacttgattgcagcgggctcactttttgattaatgcaattttgcataaggtaatattacacgagtgtattacttttcagtaattattcaatggagttaatatggcagacttcttgaagaaaaattagaaccgtggcgtctcatttctctaaatccccagcactgttcagtagggtaacaataataattatgtataaataaataaatttcttttatcaa

SEQ ID NO: 94428 - DNA, 1050 bp, Homo sapiens
ttttatgtgcagttttgttatgctgcagtttgggagagtgacacagtgatttgttataacaaggatctttgcagtttaatcatcgtgtgaaattatgtgtgctattttgcttttgctttcccttgcacctttgagtttgcgccactccacaacggaggacaggaaaggctcgtggactccttttcctaaagcaattttctctcctttaggtctgatttcacgtgagcatcattttaaattccagcaagatgtggttctatttaactagcccttgcttacagaggtcccatgcctactattatatttccttaccatgatacatactttgcagtgcatttttctcactaatcatggtttagcaaacaaggaaggagggccccgttttatgaaactttctgatgagtgatgttcagtttatttcagtctttagtatactagaatgtacaattgctctgaagataaataaaagattcagccgggtgccactggagagcagagcagcatgtctttggcattgcttgagacttatctgatttggatttgtatacctcatggggaatggcaaaatattggaacagacggcttgatatttccgaagaatatagtgggctttattagcaccagtttcgctccctgactgacggctttttcaaattttttatcttattaatccgtgctactgtatgtaaatgttattcctctctgcataagggaggcaaccagcgatttgtaataaatgcttatgagtgcctgaggctgcacttaaactttaaaacatctattattaagttgcaaaaaaacactgtaatggccaatagtgacctcataggaattttaaactgtggtctgctcttctgcattaaaaacaaaaaaattgcctcaagttagaattatgagcaatgctattttaacagctgcattttgattattaaagtgtgttttacaactgaattacaatgcttttatggactctaggtataagatttaaaaaggtcattaaacatagtcgggttttgtcacagtaggtgtcattgtatacaatggacacta

SEQ ID NO: 94429 - DNA, 1160 bp, Homo sapiens
tccccaaagtcttagcttgagttaacactctaagctcttgatattcattccttcatttagaaactattatccaagccttgaaaagagccacttagccattcattctaggaaagtaaagatttattctggtgagctttcaaaaaccttaactttcatttcattagtcattcatgtattgtcatagcagagcgaaagtgatggcagtacacttccattctctaggcaagtgtgattcttatatgtaaagatgcacagggtatctgatgctcaaataagaggtctaagtcatggtcaaaattaacctaggaacctatcttcaagtgtttttctaacaacaattgttgttctcctgccaaagcaaagttccccttgaccatgtgtttccaattgctttctccgtgtgtagtcaattttgtgctgctttcctattttttactaccttatcccctcagctttttcacaccctgtttcttaactgattttcatgtcagccttgagccctcattgtagcagagcaccttggtttcccagtcctttgcctacctgctttttgataccaacactgcccggctagctgcttggctgctctgtggctgatgcccactgccaccacgttgccttttctcttattgtctaagtttcctaccacttcctcagcctccttagtcatcagtgtcttacctctgcccctcctgcaaataactcctcacctagtcagtgagttgccactgattaggggggagagtcactgatttgggatgttaatgatctttgttatagaaactaatggagaaatttttaggttgatgatggccaagtctttattccagtctagaactttctgctagtttccaaactcaaatatccagataattttgtcaaaaatgtctccctagttttcccacactatgtatgtacagtattgagctagttatctcccatctcccataaaccagttgtatcttctgtattcactctttccaatgatatcatcctggctagaagcctgaggataattcttgacatctttttttctctccttccctccccacatccagtaacttgggaaatgttgtcacaaaatccaaatcatgctgtcctctctgttctcctttctctaatgctggttaaggccttatcattcattttttcagctcaat

SEQ ID NO: 94430 - DNA, 1048 bp, Homo sapiens
gggtcaacaacaaaaaaaaagattcacattactcaaaacacataataccgtggtaaatgattattctgacattttagttatagatatttgattttaatttcctcagcacctgtgctcactttctagggagaaggcatgccagtaatcctctcagaatttggggggttatatatccttatggaaggcctccgctttaaaatattagaaaagttcctctattaactttctcctgtatgcccactagaatgtgtcaaattgtctctattaagtgggacataaaggcatctaatccaagctttgtgacatactaggtgagtggccttgaacaagttgcttatattcatccatttattcaattaatcagtagatatttattgatttcctatcacattttaaacaccatatttatcacaatggtcaaagtgaacatgagaaaacatagcacttaccgtttaggaaagtgcttgaaataggaaagaagagtttagaatagtgtctggcatccaggaggtcctctaataaatgtgtctaatgaataaaagaaaacccggaaaatatgcaagtaaaaaaaagaaagaaatgcacatacatacatacagacagacacacacatgtctttaatatgttagtgtatattcagactgtttttcatgaatatggaagcatctatgagttgagtttatgctatacatacatactgttttgcaatttgatttttcttctcttaataaaatacatactgaacattatttaacactaatattagttaatactttctcataagctaaccattttagtttttctgaaaaatttcctgcagaaatgataaacatccctttcttgttctaccttctaccttaagtttaagtttcatggtctttcacacttttcacacattgatttatgcacattttatttaatcatatagggattttatttttgttttacatagatagtttatatatgtatgtgtgtgtgtatatatatatatttatgtatctatgtatgtatgaatatgaaatgtgctttttaaacatatatcatggat

SEQ ID NO: 94431 - DNA, 1022 bp, Homo sapiens
aataattaaacatcatttgatccaatggaagtctagaaaagattcaaatgaaaaagaaaagcaaaaaaaaaagcatgctgaagaacaaaataacattgcaaaaataaaatatgtctaaatatatatgtaaggatcatctgtagaagctgggattgcatagtgcctggagtaaggcttctggatcccagccaggagatggggaacctggggccataagaggtgaaatgatgagttatccaagtcatgcagctaattaagtggcagaactgggattagaactcaggtttcctgcctcctaagaatgttaaaatcaacctttggaagcaaacctccagtgccttcttaaagcatatcatcagaagaccagttgtggtaaaattaaatcctggagtgaattattgaggggacctggcttgcctggatgactgctcgaatatagccctgagaaggcagaggaatatgtaagtggacaaccgaagagtaagtatgggtatgcatttctctgaggaaacaatgtgtcgcatatcagtacacaggagagaaggatgtgaagacaactagagagccacacttttcagagctggatatatatttacagattttttcctatttttggttattttgtgatataatttgtcttgttttataatagttaatgatttttcacttttgtaagataaatgtatgatattgtggatttaaatgtgaagtgttctttcacatttaagttttagtcattttcttttgcctctgtgtcagtgtatcgaatgttaaaagaattttagaagattttatatatatgacagagatacagaataagaattatttaacatggattaatctcacttattgagaggcagaggctatcaaattaaatttttaaaaaacaaatccagctgtcttctgctataagtggtacttttaaagctaaacagtgtagaaagataaaaataaagatatgcaaggaaatatatgaagcatgactagccaaaagaaatattacatatataacttgtaaaaaa

SEQ ID NO: 94432 - DNA, 1143 bp, Homo sapiens
tatgagaatgtgtgcatgcatgtgagtttacgagtgagagtgtgaacatatgtgagcggctgttcatgcaagtgagtgtgtatatgtatgtgtcagtagtgagtgtatatgtgtgagctgagtgtgcatgtgtatgtctgggttttttagtgcagaaatacagcatatgatgaaccaactagactaagggtctcttggctccacctggaagctaccatacaacccttgctccttaccttagggcaaaggtgaggctgaagttgcctggaggtatgcgatgaacaaggaccagagaaaagcaaggcagcgagccctccggggagtcagttctgtgactgaagacactctcaacatttgcagactttgctgcaggtcccaggaaagcctatcacaagagggtaaggctatggcaagatgggcaagctcccttgaacggaagggtgaggctcacagcacagctgtctgctggcgcatccatttcctcagttattacacctgccccaagctcctggctcttgcaggaaaataccgcactgcatcagaggaaagatgcccaggcataagtctgctgtatttctacatttgtgggccaagagactgatgcatccaaactgcttcaagcctcctgaagacctcattccaccattaccaaagtatctcccccatccctcccaggccccagcattctagccaccaaatgacaacagacttcagaattaaattttcctttttttcccaataaatctatagtcttcactacccccttatattttctaatctcctaaactcatttaattatgtccagagtaattaaacttgctatcagggggcatctggaaggaaagttaatacattttaattttacttatacaatgaatattcgatcccacatacagtgtaggggaaggcactggtacacacacaatcttgcataatggactcatggggatcatgggttgcaggaggttggcggggtaggagccagcaggattcacccagacatgctaggagacagggagcaccgtatggacgaagcctcggggtgaaaagggattagtgaggagtattaaaactgggcagggtggggcctcaggaatctcagacaccctttgaccaaagttcccaggagtcataccagacaaa

SEQ ID NO: 94433 - DNA, 1057 bp, Homo sapiens
gcacaccaacatggcacatgtatacatatgtaacaaacctgcacattgtgcacatgaaccctaaaacttaaagtataataaaaaaaataaaaaaataaactttctaaattaattgagacctgtctcagatactttttgggttacaagggtaaaggaaggctgccccccaaaactattcttacccagcttttgtcactgacaaactcctaccagtataatagggataagaatcataataacaactactaccaatttttgagcaacttctttgtgccaggaactttgcaaatattctttcagatcctcaccacaaccctggggaaaaaaatccagagagtttaaaccacttagtcaatggtaggcagttagcacatgtcagagctgaggttagaacaaaactcctctctcttgtatttgcttatttcttatcttctagggctgtgtgcctaaacaaactattttcaataaagttagaatttattggttttgtatgctttttatcccacttaacacattaacatgaatatttttccatgtcattaaactttttttgaaaacactatttttaaaggctgcataatattccattgttgagtggatttgcccttcccttatttttccagcctttaagctgtttccaggtgatttactgtcataaattatgctgtgataagcatccttgtacatgcatctgtgatcgcatctccaattattttcttaggctagagcactagaggagggactgccaggtcaagttagaaaacgcctttaagtctcccgatgccagttgccaaattgctttcccgaaaggttgtaccaattcatattcccaaggagataaacacttaactttgaaaggaaagggtgttttaaagtgtgagataagccggcaccttgtttaaaggaacaactccttgagttccgcacaaaggccctcagaacccctgtgaaccatgggctgaggaaacattgttcggccttcctgactggctggttaaattcccaacatcccagatgtcattttactcatggttgtaggaggagattcagtggggta

SEQ ID NO: 94434 - DNA, 1071 bp, Homo sapiens
atacaatgatgattaactatgaattcttaagacttgcatttaaatgtgacattcttaaaaaaagaagagaaagaattttaagagtagcagtatatatgtctgtgctccctaaaagttgtacttcatttcttttccatacactgtgtgctatttgtgttaacatggaagaggattcattgtttttatttttatttttttaattttttcttttttattaagctagcatctgccccagttggtgttcaaatagcacttgactctgcctgtgatatctgtatcttttctctaatcagagatacagaggttgagtataaaataaacctgctcagataggacaattaagtgcactgtacaattttcccagtttacaggtctatacttaagggaaaagttgcaagaatgctgaaaaaaaattgaacacaatctcattgaggagcattttttaaaaactaaaaaaaaaaaaactttgccagccatttacttgactattgagcttacttacttggacgcaacattgcaagcgctgtgaatggaaacagaatacacttaacatagaaatgaatgattgctttcgcttctacagtgcaaggatttttttgtacaaaacttttttaaatataaatgttaagaaaaattttttttaaaaaacacttcattatgtttaggggggaactgcattttagggttccattgtcttggtggtgttacaagacttgttatccatttaaaaatggtagtggaaattctatgccttggatacacaccgctcttcaggttgtaaaaaaaaaaaacatacattggggaaaggtttaagattatatagtacttaaatataggaaaatgcacactcatgttgattcctatgctaaaatacatttatggtcttttttctgtatttctagaatggtatttgaattaaatgttcatctagtgttaggcactatagtatttatattgaagcttgtatttttaactgttgcttgttctcttaaaaggtatcaatgtaccttttttggtagtggaaaaaaaaaagacaggctgccacagtatatttttttaatttggcaggat

SEQ ID NO: 94435 - DNA, 1027 bp, Homo sapiens
gaaacctcagcccatgtgcattttttctcgagtggttaacctttcctctctttctccttctttttttgcccccctccaaattcccccttctcttaagaaaaaacacgtgagccatgttggaagtacagccttgacctcagcctcaccaggtgcggctgctgaccggtgcaaaaaaataggaaatattatttaaaaggcagggaggggagagtttctgttccacaatcactgctgtttcagtgaaaagcaacccggtttatctgtaaaacctacttccctttctggtgaatgtggctgtttttgacagcagaggaccccagttgttgaggactaaagagagagaagatgagaaagaagatgctggaaacagaggttggagaaagagaggcaaggaagtagaaaggaggaaaaggggaagagaggaggcagggggagagagggttggaattcgagctattttcagctgaatgtgagtgcagatttcatcaggcttctgggctacagggaaactgactgtgtgcggaccttgcgtgtaacttcctgtgaagcagccgtggtgactgcattttctgacactgtcagagtctggacaaccctgccagctcctagaagggcaacccaacaactgtcacagacgaagcatcaaaagcatgagctgtcgatagtgacctgcatttgcagaaaatctgagggctttctaattaacagaggagctctaaattagagtaaagctgttcgacaagacccctcatacgcggtaagtgtcacaatgcagataatcattacatctaacaagcttctgatttttaacagaagctatgagaccaactcatttataatggttcagtttcaaagggggaaaaaaaagcaaccaagaaagaaaaagaaggaaagaaaaaaagggagaaaaggaagaaagaaagaacaaccagaagaacaaaaataggaaagaaaaataaaaagaaatcctccttctagtgctttgggcgagtgcttagacccagtccccaaattcttcctttgttgt

SEQ ID NO: 94436 - DNA, 1033 bp, Homo sapiens
tcacaagtcattctctggaaaggagccatggtccacccacagaacaaggaccctgaaatccccagtaccagtctccctaggatgtcttgcctttcagcagctgttcagtcaaatccatttcagaatggagaacagcttgtcacagttctctactcttgacctgctgatagaacaaggggcttggagattttgggtagatatggaaatagatccctaaacatactaaaaagattttttttgtacgtgtggtgggggagaggagaaccagagcagaaggttggagaaagaaagttggggaaggaaactaaaatgtgcaatctcattcctcagccttcttgttgaaaatgagaatcagatgcagcaatgtattatttccaagagctatctggtgatgggatccatctggtgaagggctacttctgggggacctggaattgctgtgtgacctttgggaaacacttgccttctctgggttgagctcagcccgtagttcacaaggggcattgctggtatttatagactgtgtttgacagtcccgagtgaaaggcaacttcacttctcaccccagaatagcaagcgttgtttctcatatctaggttgctgggacagcttcccaggaacctaatattcagcagcttcgtgacgttggatggagggtttttctttttaaatgagttgattggcttttgccactttacacattgttttccaggtctaggtttatttttcccttataggtagaatataaaagagtatggggtctgccctggctcacaccgttctgtttttgcagttagcttaaaggcatggaggacattcctgggactagcatctgctagccaagaacgaagatgacagcaacatggccgtagaggcatgggccctgctggggctaataacccactgcaggctatccttggcattcttgctggagtggccttgctccaccctacctggtcactgtgccgttcagtctgggctatggcctctcaccccacctcatcccattgcatttcataagccagtaactcca

SEQ ID NO: 94437 - DNA, 1045 bp, Homo sapiens
attaaatgcttatagatccctctctgtgctattacttttgacctgggttttaaaaacacagtaacacttacaatttattctcattatgtagaaacatttaaattatcctggaagagtttgtctcacgggctgttcaaagagtgtttcttcctttccttctaggaacatgaggagtgaatctgactatttcatcaaagcctgtaaaagatacctgagtcatgattttaactgaacaatgtctccaagaattcagactgtgagagggggaagaagaccgtctctttggtgcagtgggaattgccattgtgtcctccctggttcctctcctctgtccttggcaatccagttacaatttgacagcatttaaagatgacagtacttgagataataggacaatgccataacaggattacagcaaatgtgaaagaaaggacacacgtaggtactgtcatttaggtaatgtcatctatgatcagtttttgtttcattttttgctgacacagaactcagtgctacttatacaattcactggaaaccctgttatggctgtaaatagtttgcttcccccaatgaaagaaaatacttactgtactgcaggggaattcggtaaaactttctagttttgcttaacatgaaaataataacaaaaaatttcaaatcagtatcaatagccaaagatccaaaaacagcctaaagccactgctacccaaaacgattttgtttgtttgtttgtttgtttgtttgttttttgtttctgaggtggagtttcgctcttgttgcccgggctggagtgcaatggcgcaatctcggctcaccgcaatctccgcctcccgggttcaagcgattctcctgcctcagcctcccaagtagctgggattataggcatgcgccaccacacgcggctaatttctgtatttttggtagagacggggtttctccatgttggtcaggctggtctcaaactcccgaccttaggtgatccacccacctcagcctcccaaagtgctgggattataggcataagctaccacacccagccataccc

SEQ ID NO: 94438 - DNA, 1034 bp, Homo sapiens
cagatggggagtgggcaggaatgacgttcagaatcaagggcccatcagggtctgtattggtcccttgtccctctcctccagtccatccatgttgggatactcagggcatggatggtgtttcatgatagcatttatcattttgatgatatgtgacaaaataaggcaggcatcaaaattcatatccctgtgatctctctttaatagtgtcctcctgctttgggggttattaagctagcctgaacttgagtaaacatttttggatggggtgagaggggggctgataaaagtggttagtaaatagacagttggaaaggagaacggcccgggggctcaggagatgagccagggaacaaggaaagcagagatgctagtgacccagagtgtcctagaggggaaagaacctctgttagaatttcaaatgtcagactttcttttcagcttccttcaggtgcttcctcttctactcagaattttcttttgagataggtgctggtcaaacaagcttttgtttgtggctggtcacttggcacacagtgtggctgtttgtcatcctggatgatgaggcagctattttaatggcacgcagggccgccgtgtgtttactgccaagaaataagggcttctaggagacttggtggctttaggaacaaacttccagcggcagaaattagttaggaagcagagtagcactgggttccaaatgcctctattgtatgaatttggatatgttgtgggcaaaatgacataaaagaaatggaatgagaaatagtgtaagtgactgacaaggaccccattggcatgtgggctagtgttgactggctctcacagtgtgaatttagttaggtgtttccactttattttccccaaactctaaagcaacagtttaattggggtctaaggtaccctttagaaacattttgaccacctattatttaggacacacagcattttttttctttgaagataaatttgttttgggtatggctgggtgtggtagcttatgcctataatcccagcactttgggaggctgagg

SEQ ID NO: 94439 - DNA, 1600 bp, Homo sapiens
aggcatgtgataggaatcagtttgatcttttaagcattttcagggacagatatgtacctgatattccacctctctatataatttcaagacttgattggcattgtccctaagcaccagtagaaagcttgaagaagcttctcagtaaatacatcagctgtatttccaggtgagcagtacctgctgaaatgctgagagaacgttctgactaggagggcttgggggagacagagacagagttggctgtttcagcagactcattctgctatttgctttttgccttggagattattttttctgggtgtcccgatgctgagctcccacttcaagaagaacattggtataaatttacaaaccagaagtagtcagaggttgacttttttgttctgttattccttctttgggagagcaggctggccaggaggaaggttcaagtgtgtcatatcctagcattcagataggtggcctcctctgccttttcagtgggtggctgggctgggtgaaatcttgcagtgactaagaaaggaagggtggacccaggcagacccagaaggtactgcatcttcatcattgatcctgcatgcgtgccggtaggcagcagttctggaattgctggggaaaccacagtgcagcatgagccctggggcctgctctcttgtgcccggctgagcatctctgttctgtttggggagtcctgccaggcaagtgtgagtcaaagaggagaccagggccctatgtcatgggggcagtgtcggctgagtggtactcttcagagttctcagaatgtgccgctcgaagccatgtaggcttccagcaggcttctagcagatggggttttggctgggttgggccttaatactcagtgtctttcattccctctctgccccctcgttcctttcctgcatttcttgctttcttttttttctagaatcaacgaagcagccaataaccaattttcaggaggtttagatgaatgtgaattgctgtttaatataaaaattttattaaaataataaagctctgacaaaagatccagaatattgtcccttgcagtgggctttagggttgcatcttggctcctaaatcttctaggcgggttaaattagtcctcacaaaatgtcacatttccctggcagctataggtttccaggagggtgaacaagggccatctgggtgtttgctgagggcttctcagtcctgggtaggaactgctgggtgtggaaaccaccaaggctttgtaagcctgaaagagccactggtattgggagcttggtctgcactcagacctgagcgccacacattattttcccagatttgggcaatctaatggataggagggagggttatgccccatctgtgaataggtggaggagagggtccagagaaaattgttgcagtgctcagaggaagcaatagcctactgtcttccagggacatgtctggctcctggaatgcctgtccaggctgcggtgggtggcatgggtaagggtttttaataaaaagtcacaatgcctggagaagtgaggctccttgcagccacctgccttttctgtcttgggtctcctggttggaccccattctggctttccacctggtcagagcc

SEQ ID NO: 94440 - DNA, 1049 bp, Homo sapiens
cccaggctctcagcccctctttctagaggctccacctaagccttaggaaagactttcgtttggttttaactggctcctgtcaagggttcccccaaaccagctcaacccctccatttacattataatgcaaaagctcttccctgtgggtctcagggcctgtggggaaaatggaatctggctcaaacccaagatccaaagctaaagtgcccccaggttgggctgcctgacagttttatagatatggcattgagtggcctcctggcagtttggaattgtgaaggttcactcattcatttttcaacaaatattttgaacacctgccacatgctgggaacggttcttggtgttgggcatagaaagccttaaaaactccctgctcttgtggcaccccctttctagctggggagagacagaagatgcaccaataaatatgtgaattatatagtatggcaagagaagatcaaactgcctgcacgaaaataaggtggggaagaggggtaaggggtgcatggtgaccaggcttttaaataggataattagggaaggcccaatgagaagcaaaggctccaaagaggtgaggaagttggccatgagaattttgagaagatggttccaggaagagtgtgtagagagcagagaccttgtgtgtaatacgcctggctactggaggaggagcaaggggccctgaggtcagagtggaaagagtgcaggaggaggaggagaggagaccagctggctccttgaaggacgtagagcagggatttttggctctgactccaagggagatggaagccactggaggagtgatgtcatatgacttgcgcttccagagagtctcttgggccgcattttgagactcaagcatgggaaagtgaggcagaagcagtcagaaggcaaattttaggcaagtgatggtggcgtggaccagggtggtggggacgtgagaaggggctggattctggacatacttcgaagggaaaaccggcaggatttgctgactggtgggatgggttgtatgaaaggaagggaggagtcaagatggaccccaa

SEQ ID NO: 94441 - DNA, 1032 bp, Homo sapiens
tgctcacgctgcttgattgaacagagaaagaccgggctttgaatggatccccagctccctgtccagggaaggtgtgaggctgggcaagtttatttcccccttcctccctggggagaaagtgaaaaagtgaaagtgctggggttgggatagctggtggtgtctttgtggctttcaccccatggtcaagcagtgaactctgcttgcagattctgtctcgctcacctggaagccagtgttggggaaggagcacgtgggggaggatccttaggtctgggcaacactttggagttagggggtcccctggaggtgtgggaagctggtagtggcattctggaaacaagctagagcctgtctcaccagagggagaacggctgagttcggaagggactggggcctgctttcctttgggtggctttgactggctcttggatgagtttaaaaggtgattctctctctctctctgtctctcttttctttttttttttttcttttttctgttttagtgtatgtgtatgcaagacctttgatatttgagtagggaaatcctctcttatcaatggaattcacagcctcttatggtgccttaccctttcattgtgttgtaaagacagtcagaccaactagatttatttgcacaactctgatttttttcctaagaaactcccccacccaatttaatttttttttttttttgagatggagtctcgctctgtcgcccaggctggagtgcagtgctacgatctcggctcattgcagcctccgcctcccaggttcaagtgattctcctgcctcagcctcccaagtagctgggattataggtgcatgccatcacacctggctgatttttttttttttttttttttttaagtagagatggggtttcaccatgttggctaggctggtcttgaactcctgacctcaggtgacccacacgcctcggcctcccaaaatgctgagattacaggtgtgagccaccgcacctggctatttaattctattttcagatggcttgttctccaagtcttgggactg

SEQ ID NO: 94442 - DNA, 1018 bp, Homo sapiens
aactttcactcccagttgtcctgatgccacatttctcccatcccaggtgcccctctctgtccttgtccatattgagcttagctctccactcctgacacgagttccctgacttcctctccacttccccggatgacggtgagttacgatcttgtctcctaaggtgccccctccctcttggctcctctcccagtgacgacttcatggaggctgagaaatatagtgagtggcctttcttgcctcacttactgctcggtaagttagctcagggggagagctgttcataactttgcactgacatctggagaacaaaggttttggaagagcggagcccagattccctgtgagccagcagagccaagtcttttttgagtttccagcaaaacctgtgttttaataataggagtgggtcattgtgtttaatagtacaacaaaacctaagtgcacataataagcacatcttttctgtgtgctggggtgaggagaggtgacagtgagtgtgtaggatgatatgaaaagcattacagacatgggaaagcatcttagagcacccaaagctggcatgagtcatcacaggcttatggccacaaggctagattttcaatccctgcttccctttttcataacccagttcaatgaagacataattgaagtggtgagaagaggggccaccgcccttcagactccagggtatttgtattccaggacccctccgtgggtgttggcccagcggtgcccagagaatattcccttattggatctttctcgaattgacttgttcacttcctgttcagcgcagcctggtggtgactcggtaatccccacagtaagacctcacagtgggttgagtggcctgggagctcaagtcaggggcagaaatggggaagctggaaagttgggtgatcaagagtcatttggaagcccccatgtctgtgtcagtccactcacatctctgtccgccacccaccaccactttctccctgcctgaaagcactgggctgtgtttcagagaggtagctgg

SEQ ID NO: 94443 - DNA, 1014 bp, Homo sapiens
cagtaattgatgagtccttaaaatccacgcccggcccccaggaatgccttggggcaccccatcccacgttctgattctggatggacttttaagtgaactctgatgatgagtaggctcttaaaactctttctcaacgttctctgctgggtttgtgtgtcacctcccatgccctctctggtgtgtggtgattctcagatctagagcaatgcttcctgccttgtccccccatgcctttgcgtgtgggaagctaaaattcacatgtgcgatgccctcccatgtgccatttttacctggtcccttctgctcactctttattcatatttaaatgcaggtgagttggaatgtcatcttacaggcataatcctgaatctgctctatcgcagacattttaaaactaaattaaatgttagtactaagtagtagccaaattctctgagtctgcttcatgacaggctgtaacacactggtatggaacggtaggtctaatcctgtgactcctttatctatgatgttttatgtattatgagagctcagcagatgttgacagagggaatgagacaagatgattttaggtctaggtttgatagataaaaaactgggccaaattttatattttctttgaaaagatagctaaatctcagcaattattttattttatttattaagctttttgtagagacagggttttgctatgttgcccaggctggtcttgaactcctagcttcaagcaatcttccctctgtggccttccaaatttctgagattataggcataagcaaatgcctctggccttcaagtaattaatttaaagtcttttaaaaattttctctcctcccctaaaattgggttttagagtaaggttcttgttcctctagtcgacaagagtttctgaggaatcatagaagaaagcacagctctttgagcatagatagtttccttcgtggaaagccaaagtgaatacttattgagcatcttctatgtagacatagacttgtgaagtcatatcattaaccc

SEQ ID NO: 94444 - DNA, 1050 bp, Homo sapiens
gaaagaaggggacaaagaacacgtcaagggttaagcagccttccctttaagggaggactggggcacaagatggaagatgaaagggagcagagtggcaattgcagagctggaaaggggaattttgttcttctagatagcaaaagccaggactgtcgctgtgtgacttgaaagctaggtcactggtgggcttcgtgcagcccgtcacaggggagccatggtgggcctcgtctctgccgtatctgctgcctggaagctgagactggcctaaccacatcacaccattcccagacccaggcccaggcccaggcccgggtccctctggttttacaaaatgtccgctctctctcgcttcacacagaggctattattagcaagtgtcactcagttatctgagagtggcgcttttagctgccatctaagtgcctgatacttgggtttacagcagattaaattaaattttaggctggtttggcttcactggcagtagacaatggaaggcagctgttgtagaaatgtaacctggcaccctcaaggatttgtgtgagtgtgtgtgtgtgtgtgtgtgtgagtgtgtgtgtgtgtgtgtgtgtgtgtgtgtgtgctgaccactaggctacacttccttttcctttcctctccatttcatccctttccaaaaagtgtttagacaaatagtttcccagacttggttttatcatgctgggttgacaaaggttgtgtacagagctggaataattttttcttctttctactgttggcacatcaatatctttttttctgcaaagaaggggctaagcttgcacgaaaacaccggtgggaacccactggagaagggcatgggtggtttttggttcggttggtggctgatctgatgggtggtataggcagaatgtctggctgccccttcagattcctgtagattccgtaggcgaccaacatggggtgggggtgggggactgtctgctctttttgatgcaaatatcttcactctccttggtgcttctgtggttgtgcctatgaatttaggaccttatgcctcatagtgttgag

SEQ ID NO: 94445 - DNA, 1058 bp, Homo sapiens
gcccagaagctgtctttctgaagaaacattaacgccaccaccaccaaaaaaagaaaaacaaaaaaacaaaaaacaaagcaaaacaaaacaaaacctttttaaaaaactggaaatgacagaatagttttaaaaggaaaaaaaaaaaaacccaaaaaccaaaaagcaacaaccaccttctgacgctcaaaacttcaaactattaatagaccaccagtgagatagactgtctttgtgccttgaaatgcaaaatgagggaaataattagcagaggaacaaaattctcaaaatttgaagaacttctgtgattactgggggtacagtgaaaagaaaatgcaaatttcttcctgatcttaattagattcgattgtgcggtgggtgtgttggatttggggggaggggcagaggcagggagtgctggggtgaggcgtgaggctgagtgttgtggagacaggttagcaggggcccggcggtgtggcaggaacaaaggcagcttccaacgctggtgcaggattccgagccttaacccagatgctcatggtgccctagtcttgagttcttcatttaggtgggcttatttcccactgggtctgggggatttcatttgtcctttgaggggcagggtggacactgacagaacagctgcggccggcagagagggtggttaggaagagggaagcagcctgtgggtaacttcccgaccacatggaaaggctgaataagacgttatggaccctgccttgggtactggggtcagcgtctcctggtggtgtctgcacagggccccccaatgccagggcactgccaaaacacgctcttgagtttaatggtagtggttggtctgagtcctgccaaagtgtatggagcaagtttcattggctggactttccccttgcatgaaataataaaagccctggccaaggcttatgaatctatttttgtttcattaatattatttattatgtattttattaatattttttggagggaccttgctctcatttgaccatttgtagttataattaatgcattccgtactggttgtaaaaagtgtgcttgca

SEQ ID NO: 94446 - DNA, 1066 bp, Homo sapiens
gctgaacataaatagtgtggtcacatctcaaagtgagatgtcagtaactagaatcacgacttctcataattcacagtaatgaattaagagtttcctatggtgaagttaacattctaccattgcacataaattccgacgctctggccctcaggtgcccctgaagcgaagttctggaagacggctgtgtgtgtacccccagcccatttctctaaagcacgtctgcacaattccaagtctgcttttctttttatgatgaggaaggaaacaataacagtaatcattcagtagatatttgaattgtgtcacaaaaagaaaggagaagcaatgccttgtattaaggaaagagatatattgatgaatctctagaagaatgtgtttggcaaccacataaaaggtagtcatttaagcgtgctgggtaggaaaggctttattaaagtgatgtaagttggatttgagttcactgtgagcctgtactattttataggcaggaagcaagaataaaacagtgacagatcttcttcctaagataaataaagcttagaattcgggactttcagataggagaataaggcagagttctttaaatcttgagtaaaatggtatgcattttcactgtactcaggcctctccaagctgagttttttttttttttttttttttttagacagagttttgctcttgttgcccaggctggagtgcagtggcatgattttggctcactgcaacctctgcctcctaggttcaagcgattctcctgcctcagcctcccaagtagctgggattacaggcgtgtgccactacgcccagctagttttttgtattttcagtagaggcagggtttcaccatgttggccaggctggtcttgaactcctgacctcaggtgatccacctggcttggcctcccaaagtgctgggattacaggcttgagcgaccgcacctggcccaaactgagtattttttagaggattctttttacctggtgaatagatgggtatgtgctcccccacttcatccacgtacacatatgagctgtacacatagatgttaatcaggttgcttttttc

SEQ ID NO: 94447 - DNA, 1938 bp, Homo sapiens
aactataattaaatcaaagatgtaggataacggaggcgttgaaatagtttttgctaggcaagggtgtgacctttttaaaaaatgtatgatatatgctgccattcgagaggcaaggaaaacatatctccaaatttccttccaagcggtctaccggcattgacagtaccgcggacaaaggagagtaccaaataaatactccttcgaaccaacggtatactgagagccctgagcttgtgggcggggccccggagcctcccgggacctaaaggcagagggggcgtggctgagggtggtccagacctccaggggcggggctgagacctgcgagaggcaggctgggaagcggcgccatattggcgtcggccgcgctgtattgtcataaatagagccggttttgtggtgttttcactactcggttggatgcctcagccatagtaagtgggaaagtgagcgagcaagcgagctactagcgaccggaggaaagtgaacagggggagaagggaacagcaagaacaggactccagagcgataaacactcgctggagagggagacgcaggaagcgatgaaagagatgtctgcgtaagtggtggggggcggcggttggggtgaggcgggtaggggtgagctgaggtggtccgactgtgtccttgtttccgttccctgtcccttgcgccctgcacgcagctcgccgggatggtctccttcccggctcccggccggtccgcaagggcacctcccctaaacccggcggctcacctggccacccctgcacggactcggggactccgggagtccccagctgtcccgcctccgaggacgccctcagaaaaggatgaggagggaaagaggtgcctgtgtccgtagggagaaattgtcggtcactcgcctgcccccagcactgtctgagcccgtctgctcctgtctgcattggcgcaaataccatccccctgcctccccctcctcccttcccgaccggctgtctccaggtcttcaggagtgaaagacctatcgcagcccaagggtttctctttcatatgaggctacagtcttttcaccgccgtccccaccctctccctcaccccctgcttccccacctacccacaacatctaccggtctgtacctcttgttcacactttgataagtcagaaacagttcccgtacttggcaagattttgttgtagcttcttccattttggtctattaggaaataatttaaacatgcagaaaaatgtagagaataacataagcatcatttgtggagccaccacccatttctcccaaaacgtaactgtacacacatacacgtacatgcacacacgcacacacacggtgtgtatatacgtatctgtgtatttattttaaaaagaaatcaagcattccagatacatctgaaggactctcctacctccttctctggtcccaatcatctcttgctccagatgtctccacagtcttgaatttgatgtttatcgttgctgcctgttttttattttacttcttttttttccgccctcgaatcatgggagctgcatgttttttaatgctattactacatacacatgtgttcataataactggcatagttctagttgtttttaaactttatataactcgtatcacacttggaattctgtaacttctttagcacaacatagtatctctgagctttgttcatgttagtattttagttgtaattaattaatattaattattgtattgtattctattgtaggaaaacaccctaatttaattcttttcctgttagtgactattttatttctaagtttttaatgttacaatgtgacagtgaacgttcttttaggtgtctctttgtacgcttgtaactagaatttctctaggttgtttgcctgtaagtgaaattgatggtttgaagggaatgtgggattctgttgtttactttcccctcccctctaga

SEQ ID NO: 94448 - DNA, 1020 bp, Homo sapiens
tttggcgatgggctcttactctgtcacccgggctggaatgcagtggcgcgatctcagctcactgcaacctccgcctcccaggctccagcagtcctcccaacctccccacctcagcctccctagtagctgggaccacaggcatgcaccaccacacctggctaatttttgtatttttgatagagacggggttttgccatgttggccaggctgatctcgaactcctgagttcaagcaatccaactgccttggcctcccaaagtgctaggattataggcatgagccaccacacccggtctagaattctttcttttacagcttttattatttttttctgtagctatgatgaatatgtagaattggttcttttaaacagtgggctcagaataaagttgagtctcctaaagactacagtcgttgagtttaacatggtatttatgctatttacttttgttgccaaaaggctgtctgcctcatttctgaactcaccagggttatcaatagttgaagttattggatgagtcaaattctgagcagatggaaatgctagtgacaggtagtcaaaaaaaataaagttagttaacatcttccattgagcagatgaggtcatttttctttgtgaattgtaattgtctcttttgtgtgggggaatgggggaaggatctctcagtctgtctcccaagctggagtgcagtggcatgcataatcatggctcactacagcctcaaactcctaggctcaagcaatcctctcaccccagccccccaagtagcagaggctacaggtacacatcctgatgcctagctacttttttttttttttttttttttggtagagatggggtcttgccatgttgcccaggctgtcctcaaactcttgtactcaagtgatcctcctgctttggcttcccatagtgttgagattacaggcatgagtcacaaccacacccagcctataattctctttttttttttttttgattttaaaaaaaaaagtgacgaggtctcactgtgttgccaggct

SEQ ID NO: 94449 - DNA, 1064 bp, Homo sapiens
tgaatctgtacacaattgggatatttaaactttaaatagtgtagaatcccacatcaaatcattttggttagatactatggctgtggcaaactgatttagcatatcactttctcataaatcatgcgagaatcagacttctcaaaatagaaatgtgaactaaaagatttttttaaggtcctgtcttctctgtccatttcattcatgttaatcatcaataaatttacagattcctgggcatggtggtgcatgcctgtagtcccagctactcaggaggctgaagcaggaagatcttgagcctaagagttcaaggccagcctgggcaacataacaagactctgtctctttaaaaaatctgattaatttactaacttctttctagctataaaattatttgtgatactcttaaccttaatattcattacacagaagcattaacaaggataatatcctattatatagatacttacattcaagttgaagttaatcagcagatattctttagaacttgtactgggcattgtgagaaaatacagagaagcagtagacacagttcttaactctgagaaatgtaaatatgattgaagattaaatatgaaatatgattttacatgccaaagaagtcagtaaatatagcaaaaaagaatttaagaattgtaatggcagaaagcacagaggaaaaaaaagcttgttagggagtaaggataaccagggaaggcttcatggaagaggtggaacttgaagtgaacttctaaaagtggatgataccgatagccagaagctggacatggtggctcatgcctgtgatcccagcactttgggaggctgagacaggaggatcgctttaaaacaggaacttgagaccagcctgggcaaaaaagcaagaccccatctttacaaaaattatttaaaaattacccaggcacagtggtacctgtctgtagtctcagatactctgtaagccaaggcagggggaatattttgtgctcagtagtttgaggctgtggtgagctaagatcacactgctgtgctcacttcagcctgggcaacacagtgaaaccccgtct

SEQ ID NO: 94450 - DNA, 1052 bp, Homo sapiens
tattgaagtggatcaggatacttgagtgactatctgatgggcttttggaactagctctcaagaggtgaaaattagcttttttttctttttctttctttttttttttttttgaggcaaggtctcactgttgttgaggctgaacctcctgggctcaagcagttgtcccattgcagcctcctcagtagctgagactacaggcacacgccacatgcctagctaatgttttcttttttgtagagatggtgtctcattgtgttgctcaggctggtcttgaactggacacaagtggacctcttgcctcagtctcccaaagtgctgggattacaggcatgaccacgcccagccaaaaagtagcattttaattacattataatccaagaaatgttaattaagcttgttagaatagctctcataaggagatcatgtcaggaatgactccgttcttacagaaaggttgtagagctagaatcaagaaattaaacatacctgtcacaaaaactaaaggggatatgggattggccaagagtgttatgttttagagaggtgaaagcacattagtctggtaactgagagttccttgttgactaccgaaagagtgatgaagcgaaagacaggcagttggaggggacaagtatggtcaagtgattaaaaagaaaagcttttcttcagatagggatgtatgtatgtgtagtgggggtgaatttgttttgtctttcctctgggaatacccttattacttcagatcacaaccagaggatctgtgaagcacttttacaaatctaatcttgacaaggttggcaaatctaatcatgtatcatttgctcaataaaggtcagtagacattatggtgatttttttttttattttttgagacagagtttcactcttgttccccagactggagtgcaatggcacaatctcggccgctgcaacctccacctcccaggttcaagtgattctcctgcctcagcctaccaagcagctgggattacaggtggccaccaccacgcccagctaacttttgtattcctagtagagaagaagttttgcca

SEQ ID NO: 94451 - DNA, 1127 bp, Homo sapiens
ttagtaaagacagggtttcaccatgttggccaggctggtctcgaactcctgacctcaggtgatctgtgcacctcagtcttccaaagtgctgggattacaggcatgagccactgcacctggcctgaaatttttttttttgagacggagtcttgctctgttgcccaggctggagtgcagtggcacaatctcagctcactgcaacctccacctcccagtttcacgtgattctcctgcttcagcctcccaagtagctgggattacaggcactcaccaccacacccagctaattttttgtatttttagtagagacgggattttgccgtgttggccaaactggtcttgaactcctgacctcaggcgattcacccactcttgcctcccaaagtgctgggagtacagatgtgagccaccatgcccagcccgaagttttttaatgaacatgtaaagcttcgtagttaatatgctgtttggtttacttgagtgtagctttcaaatttaaagtggacataagataaattgtgtttgttgtttattttagggttggattagtagaatctaaaatccgtgtacttgttggaaacttggaacggaatgaatttattactcttgcccatgtgaatccccagtcattcccagggaataaggaacatcataaagagtaagttaattgttttataatactttatttcttaaataatgttatttggtatatgcatcatttcagagtaattgtgagatttttgtttaacaggcattgatgggagtatgacacattatatatttgagtttgagtgtctaggcattaaaaataagtacataactactttggtagcccacaaaccccagcaaaacaccatcacaatatttggagcatctttaagaatatatttagtaagtcattttcatagctgcttaatccttctcagaacaacaggggataacttaccagttctggatgtcacttttaagaatctggccagaccactgaaatctgtatttgtgagatagagacatagagaccaagttttaattatgaaatagcatctgtaaagttgtaaaaaataataataattaatggaaattcttaaattttactttatagcaacaattacgtatcaatgtggttc

SEQ ID NO: 94452 - DNA, 1051 bp, Homo sapiens
ggctaatttttgtatttgtagtggaaaagggtttcaccatattggccaggctgctcttgaactcctgacctcaagtgattcgcccgccttggcctcccaaagttctgggattacaggcgtgaaccaccatgcccggccctagattttgccttctttatgtaataatctttaatgccctcagaatccctcaaaccgatgtccctgaatttcataaccatcaaagttatctagcctaagtacaaagttcagttttcctgagaacttaagtatctcacagattgagtcagtggtcttcttcatgaatgtattacagaaacaaattgagggacataactctcagatattaaatttttctctactgcacacactcatttttcacttcacaccccaagagcttcctgtttagtcaccatgaacttccttttttttttctttgcttgaccttaaggactgtgttctttatgcatttcttgatccaggcatggcagttcctcttttcctgtacatattcacactcctgccacttctaccctttctcttatccctctgcttttcacctctgactgtaaaaagaagtagcagttccgaaagcaagagttccctatgaacacggaaggaaatattcattgcatacttgagtgtttaggagctagagggtttgggagaaaaactccccaagttttgtgactgactttctagctgggcctttataatatatatgatgtgcttttccttttttgtttcctctttctttctaatagagactacccagtaaagaactaccagattcatcatctccagttccagcaaacaacatccgtgtcatcaaaaattccattcgactgacccttaatcggtaaaagcagtgcctcctcacttaagtgaacaagcaatcatttagtggcatagatgcagccacttgttttttaaatagaagtggctgtcatacgtgaaataaggtgaaagtgacagccttcagtctaataaccttgaagtggtttttgaactgtcaaactttgacctgtagatgctgtagcattctctcactgat

SEQ ID NO: 94453 - DNA, 1326 bp, Homo sapiens
gtctttttttacgctgcttttttcaatgcatttcttaatattttttaagtttcatgaatgcatgctcagtttattaaaatccataaccatgtaattcttgtaatatgttgattcagtgttttgtaaatgaagtcgtatgtattttcagagtatttttgtatgtactgtaagataccatcttttcaaagagaaacgtttaaaacctttattgtctctccttagtctaattttttaaatatggattatgcttgaattactatatttaaaatgaaaatgtatagattacacagccaggaatgctagtatctaccaccttctttagatttcactcagcatttagtaggtccagtaggaaaaacccaaaatggtacattgagtagtgtggggaagacacctcgtgtattataggactcacgggatgccatctagcaagtggagaaatagcagtccattttctcttgcaagccctttaccattgagttgaaattcttgaattgccagagagccgtatcctccaggtcccactcctgttcattgccccttaggtctccaaaatgtaaattctaatgtttaccttgtaccatggaaaacatgaaaagagtcttagaagtaaagaacaacaaggaaaaaaatgtttgttctattattccctttttatatagcagcaaaagataagaataaaatcacataaccaagttgaagcttccttggcaaagctgttgtcttagctgactctttccctttattcagatgttttgggattgttctacaaatagtctatttgagcaaaaatgaatgattatgaaagaaccgaagaattatcacctgacttcaacttttgaaagctttagtaaggaatttgattaaattttatatactggatgtgtatgcatttctgcatttcatatcttttgcttttaaatcagccttcaaagtatctttaggaattccttctgtatccatgtttaccccattatgtaaatagatctttggagtgactagtggagtttttctttaataaggaagcaacaagtctaaccttgtactataggataggcatttattttagattaaggagcccattcaacatgtcaatgagtcaacattagagtcctcaaagatagcattcttcaacctgtttggtaactgaggagttgataaaatacttttgagatggtggggtttgtcagaaataaaatattttctatcctgaccagtaggtagaactttgagtacatttcgttaacttggtgggaagcttccattgtactagttccaagtaaaaaaggagaaagtatgatctgggattttgtgttatgatgagag

SEQ ID NO: 94454 - DNA, 1045 bp, Homo sapiens
aaattagctgagcatggtggtacgtgcctgtactgtcagctacttgggaggctgaggcacaataattgtttgaacccaggaagcagaggttgcagtgagctgagatcacaccaccgcactccagcctgggtgacagagtgagactctgtctcaaaaaaaaaaaaacaaaaaaaacacacttttttatatttctttttataatgttttaatgtattcttaaatttcaagcaaatttaagataaaacttgtaatggctatgccattgaaaaacttaattttttatttttgaggcccatgggccaaggtaacccctaaggggttttcttaggcttcttggagcttagatttgtatgtatatcaaaatgtctttaaaatgttaagttgggcagaaggcagttgaagtgagctttcaaggtatgggaggttttctacattttatactatttcaatctatgcctttaaagttgcttatgattttagctgtacactcattttttaaggggaagaagtttccttggaccattcgcctttcttagatgtcctcactccctgtgatctcataaaactgcctatttgacatctctatctagaaatctaattaaagctcacactcagcatatccaaaactgaattcttggtcttccctcccaaacttgcttctccttcagtcttctccaactcagtaaatggcaatgccatacttctggttgctcaggccaaaaaccctgaagtcatccttgattcttcttttagcacccatatccaatccattagcaaatctggtagaccctaccttcacaatatatctaaagctgaccacctcttttgacctctactattaacgccctattccaagccaccatcatctcttccctggattgaagctgtcatctacaaaaattcttcttatatccttgcattcctacagtctgttccccataaagtagccagaatgattatttttaaaacaagtcaactcataccattcatctgctcaaaaccattcattggcttctcatctcactcagagcagtcaaagtcctta

SEQ ID NO: 94455 - DNA, 1048 bp, Homo sapiens
acattccatgctcatctttgtatttcctctgcactaactctgcaaggtgctttttctctaagatctggtctcttttagcagaaaatggtatttagaaaccaagatctgggcagtaggtatgctcattgtttggtgccattgctgttcccaagccctctcatggaacagagctagggaacaaacatgaatgcatgtgcatgcacacacacacacaccccactcatacacacacacctatacatctctgtatctacacataccgaaagctgtaggagtttataccagtacttccaattccaaccttattctagttttcaccctttccaaatttgtaattctctgactataagaaatctggctcctgctctttccctgctgccactgaattgtatagaggcggagtctcgggtgcattcaagatccggcttcactcgtaacccactgccatggccgaggaaggcagtgctgctggaggtgtaatggacattaatactgttttacaggaggtgctgaagaccgccctcatccatgatggcctagcatatgaaatttgcaaagctgccaaagcctcagacaagtgccaagcccatctttgtgtgctgtgtgtgcttgcatccaactgtgatgagcctatgtatgtcaagttggtggaggccctttgtgctgaacaccaaatcaacctaattaaggttgatgaccagaaactaggggaatcggtaggcctctgtaaaactgacagagaggggaaaccgtgtaaagtggttggttgaagttgtatagtagttacgaactatggcaaggagtctcaggccaaggatgtcattgaagagtacttcaaatgcaagaaatgaacaagtaaatctttggcacacacacacacacacacacacacacaaaagaaagaaaaaataacctcaaaaataaccaatctattgctgcctcaattcacagtcccctccctgctgccctcagacattctcctcaggctccacactgcagcccaggaaagaagcccttcaccaaacgaggccaaatatttctttgtggg

SEQ ID NO: 94456 - DNA, 1002 bp, Homo sapiens
ataggatattgtctccattttataaatatggaaaccaaagactagaagttaaatgacttatccaaaattgttagctacttctatattgaggactagaactgaagtttcttggtttctagggtctttctaataagccctattactgagcacctgtttgtgtgaaggggcagctatggatgccatttaaactcatgtaactgataattaacttttggaatgtagttaccaaatcaaagagcttaccaaaaaatagcccaagactatttaatacaatcttatatagttaccatttgttattaagttaaacctcagttggtattatgaagaggaaaaacattaagctaaacctaaaaaaaatgaatgggtcatttaagtttcagaaaggagcctcattacaatttcagatttgagtataatttccatcaccctaattcaactatttgagctttttttaagaatacatgtgacttgactagtattagattactaaccatttcccatctctatattaaacataaatcacagataccaagattcactttagatatgaggaaaatggttttaatggacacaaaggagtcagccacgttggaaccaacatagtttcataccacgttgaaaccatgtgtttgatatgcaaataacagcaaataattttttcactcttgtcaatgccaatgcattgaaaggcccagaaaatgagaaaaggataacaaacttttgataaaaaggtaagaatttctgtgtggatgttcctcagtttctgggaaaattttgctacaaaagagatttaaataatttaggaggcagtcttttgcatggtatttttggcttacctttgaatctagtggacctgtaatatgtaagaatgaagaatgtgcttagcaaactgaaatgagaagatttctatttcttaaatttctattcctgagattatataaaatttcacgcaaagagtaagcattagctttaaatacttcttccaaatgttcctagaatttt

SEQ ID NO: 94457 - DNA, 1055 bp, Homo sapiens
actacaggcgtgtgccaccatgcttggctaaattttgcatttttagtggagacggggttttgccatgttggccaggctggtcttgaactcttgactttgagtggtctgcccaccttgatcatgttgatctatataattgatcggcctcccaaagtgctgggattaaaggtgtgagccaccacacctggccccataaataccatttaaaaaatttaaatgtattctcttatcagtcaaaaagcacagttaataaccaactgagtagccaaatactgctactcaattaattcagaagacctcaggcccaagaatacctagaacagacttgagggttaatttatggtattcaatagctcttttcttcaaatgcagtttcttctgttgcactatattaaaactattaaatttatacagcattaccagcaaatgcttaccacaacagtaatatctgttttaatgacttcttttctcccttctagtctgtagatgttgactggccacctgctctggatgactagctttcaaatttggagacaaagagtatggttttcctggcatgatgtggacatccatggagcacatgccgtaaaatggctgtttacccaccataacggtgtcttgaaaactatttggatcatgttgatctatataattgttaatttgttgtaacatctcaggatctatatatgtgtatattttgtgttaaattgttccaaggatgtcttaggatttttctcattccctctttcacccccacaaaccaaactatgaataatgaaataattctccttaattctttcatttagagaggtgcacaaacaggacacattctctgttaacctaagaagctgtaatttcagcaagatttccctccacaagagatataccacctttaaaatcatgttctaatttttgtaaattatctgaataaaagttatatctagatttatgcagcataatatcctataatagtctaagattgcaaatgcaaatctgacatcattattttccccaggaagcctcaaacaagctattaccaatgaagttcttttggc

SEQ ID NO: 94458 - DNA, 1032 bp, Homo sapiens
gaaaggtcccggtttattatgcacatcgatttgtaattattatattgaaatgtcaccctaaacaagatgtattcataacttttccagacatatccttttgtataacccttttccttcaccaaaaaaaaaccaaaacaacccacccctgacagtaggtatgtggttctccctaaaacacgcaaactcgacggggcgcagtggagcacacctgtaatcccagcactttggaggctgaggagggcagatcacctgaggtcaggagttggagattagcctggcagatatggtgaaaccgcatctctatcaaaaaaatacaaaaatcagccgggcatggcggtgtgaaatgagtaatgatagactgggttatgagaagtcccacagagtttgaacctaaggggacacaattcattttagttctctcaaggaagcatctgtggtgagctatggatggtgagggaagggctaagacaggattcactgggtggcaaagctctgactctgggactgtgtgtcatattctcccctaggacttaaaaatcgaccagaaaacacctttgcgcgtccttcaccgaaggcccctggctgtgcgagctcgcgtcattcacttcatggagacacagtacgtggatgagcaccacttccgcctccacttgaaaactcaggctggcacgtatccttccacctgctgcactgccgccatcgaaccagaactctattggaaaagttcatggtcccctagaaaacagggtcagcttggtctgggagggattcgggaaaggattatactgaagaagaatatttttgtttgtttctttgttggatgtggttttttcccacttaattttctttttcttttcttttcttttttttttttttttttttttgaggcagagtctcgctctgtcgcccaggctggagtgcggtggcgccatctcggcttactgcaagctccgcctcctgggttcatgccattctcctgcctcagcctcccgagtagctgggactacaggcgcctgccaccacgcctgacta

SEQ ID NO: 94459 - DNA, 1252 bp, Homo sapiens
tagttaaggttggattttaacgtcagaaacacctagctctgccatttacttgtgtgaccttgggaacattacctaacttttctgaagcttggtgttcttttattttatacctactttataaggttataataaggattaaatagtacatggtccaggtgcagtggctcacacctataatcccggtgctttggtaggccaaagcaggagaatagcttgaattcaggagttaaagaccagtctgggcaacaaagcaagacctcatctctacaaaaatttaaaaattagccaggtgtgctggtgtgcacttgtgatcccagctacttgggaggctgagacaagaggattgattgggcccaggagtttgaggctgcagtgggccatgatcacgctgctgcactccagcctgggtgacagagtaagatctcatttctaaaaataaataaataaataaataaaatttaaattatatatataacatttttagtccaatgcctggcatataataagttctcaataaatggtgtttactattagcattactatttttagtagagattgacattagaggtgggatgatgactctccctggggattctcctatagattgttcaagaccttcagttgggtttctagcaaaggttgggaatgaatatcttagagctatgatgtctctaatttttttttctttatctgcttttcaaaggttttaatttttcatcctctggaagagaagatgtagatgtgagaacattaggaaatggtaagactgcaacagcatcacctgattagaactaactttctgattatcatcctttctagacagcaggcttagcatagtcactcagtgaaaaacaaagtgagcaaggcccagagcttctccaagggaggaagctttgtggattatggaggcccctttatgaattatatgaaatacaccttaacaggaatcatttcttcagaggccatcctgattgcatacctataggttataagggacttgcatgtgcattaacaaagaggtgcttgattttttttccaaaagtttgattattaattttttcatttaataacatttcagaaggaccagtacagttttcagaatgtacatcttcatttaaaaagtgattctgctgtcttaaccttcatgtctctcattttaccctattgcattaccagaaagatgatgacatttaatcctgaactgtttgaggcttatagttccttcctctcatggaaccaaagcttttccatt

SEQ ID NO: 94460 - DNA, 1044 bp, Homo sapiens
aataattttacatgttgtatcagtgagaacagaaaatagaaaacaaaagatgtgggttgagtgaagtttccctgaataaaaggaatgcgttgttcattttaattattgtatagattagaataaggagcgagaaaaaaaaagctattcattattgtgattctagagtagctaataggtctactaactatccaatgaactcagtaaatataaagacaaaattgcaacatagtatggcatttttagctattcctgcccctgacccctccccgatatggaattttgtatattctccatggaggtaaaagtataaaatcatgctttttttggtgtacaaggatgttcattatagcattttttttttgttacagaaaaattttctacagcttaaatgtctgacagtccctagagttgaaaagatttccatgatataatattaaagcaattttccaaaagcatgtcttaaaaaataatacatatacatttatattcacaaaaatgcctagaaagaaacatcaaattgttaatggttctgcttcagtggcgtgggattgaaaaactgtcttgtatttgatcattttataatttatgtgtataatttttgtaataaaacaaaaaaaattaagatctggttttaaaactcaaatccattaagacgtttgagcactttaaaaagaagcttcatatggtttttagggatctgaatagtatgttttttgccttgctaataattcaaatcatagtattggcagaataattcttcatttctctctgttattatttattttcaattctgtaaattctcattcatctttatacctaatttacacatttgtccaaaaagtatacacatttattttaaaacttttttggtaggatcactaatgactgagttttagaagttaaaaaaaaaaacaaaactatttcctttacagctgccctgataacaagttgatttgagagcagtagtatttccagtttttctggtcattcttttctgagccaatctttgagaattaatttctatttccattaataagttgttag

SEQ ID NO: 94461 - DNA, 1050 bp, Homo sapiens
atcagaggagacacctagattcagtctgttacattcatttaatcacacgtctgacatccaagcctttggggaaaagaagaaagttttgagatggggaggtggcgggggtgaggagatggtggtggtgcaagagtcaactaagtggtagatcaaacagtggttataggaaaatattcccccttcctctcttaccttcctcttttttgccaccacgcctgagacacaaggagaggcagatgttcaaggttatagcatgctgccacaaccctgacacacggtgaggcacaggccctgatggagcagaagcttaaggcactagcatgctggggatggggaggaggagaaggaggaaatcttaggcagtggtctggatagagagaaggaagaagaatttctcttgtcactaacctccttattgagcccagtttccaaatggctattacagtgcaagaaaaaattacataaatgtttgtatgtatgtatgcatatgtgtatgtgtatgtgtatgtgtatgtgtatgtgtatgtgtatgtgtatgtgttgggagaagagtttggagcagggggtactgctaaatgcctccagctgcccacacaactattgtcatttttctattgtcattattctcagtctatatttattttatctttgttattataaatgagtccaagagatgtgtaagattcaaaagaatatagtttgaagggcattggtggtgatttagaaacctcaacatcactgccaatcagcaagtcctgccaatctgtgttctcaatagttcttaaagttgcctacactttatcatcactagcattgctgtaatatattttttcttgcttgaattactgctttagtttacgacaaatcttccttttctttaattcccatctttttcttctaattcacaatgcaaccagagtgggcattcctgaagacaaatatgatcatgctacttcattccttaaaatccttctgtgggaccatattgccttaaggggaatatctaaaccccttagtatgggtccagtagttctgtgatctaagtcctgc

SEQ ID NO: 94462 - DNA, 1027 bp, Homo sapiens
gattatttttatttcttttgatcaacttagttatattgatgtattttatcataatccaaaatgctacactaaattccttagcaattagaaacctttaccggatccatcttatgaacttccttaaaatttgtattttataatatgtgtgtaatgaaaggggcttggttagagagtacacaatagtgtttttcaaatgaaagctagtttttatccctaaacatgatgacttgtctgtgacagtaaaacgcagaagctgctcattagttttacttcttttctttctagttataattattcaatatgttcccactgactgaggaaaacaagcatgtggcccagttgttgctcaatactggtacttgtccaagatgtatcttcagattctgtggtgtggattttcatgcaccttacaaacttccatacaaggtattttcttttctttttttttttttttcaaattaagagaaggttctctgtattttacaatgaatgcttgtacttttgagggcaggtatctattcataactcttttttaaattaaaaaactataataaaatgagtgatattcataattttggaatagtctcagaaatgtaagttccttcttaagtgattatatctagctttctaacatttagtgtaatgggatctttgtggaggaactccctggtgcatttgaacacttgtatagatgtttcctaaaggatatctaaacagaatatcacaaaatattgcttcctcccaggaggggctaatattccttacatgtcctactatgtggaagcattgtgggtatggttgcctttttctgtttttcccattttctgtattaccagttgtgtttataaataggtatttggaatcctctagaaataaatgcttatcatcattattactgttattaatgacaaaagtaatatacagagatctttgacatttatggtaatatacagagagctttgaggtttaatataacacttttttgcataagatatgtaacatctttatgaaatgtttgattctaaaa

SEQ ID NO: 94463 - DNA, 1028 bp, Homo sapiens
aaggtagataaaaccacaaagatggggagaaaccagagcagaaaagctgaaaattctaaaaatcagagcacctcatctcctccaaaggatcgcagctccttgccagcaacggaacaaagctggacagagaatgactttgacgagttgacagaagtaggcttcagaaggtcggcaataacaaacttctccgagctaaaggagcatgttctaacccgtcgcaaagaagctaaaaaccttgaaaaaaggttagatgaatggcttactagaataaacagtgtagagaagaccttaaatgacctgatggagctgaaaaccatggcacaagaacttcgtgatgcacgcacaagcttcaatagctgattcaatcaagtggaaaaaaggatatcagtaattgaagatcaaattgatgaaataaagtgagaagacaagattagagaaaatgtttattgtatcaaccttctattgttgaaccatccttgcatttctcaatgaactttgattagtcttgatttttttctgatatgcaattccaaattctattctaaaccagttggagtggttcacatttgtaatcctagcattttggaaggccagggcaggaggattgcttgaggccagaagttcaagactagtctgagcaacataacaagactctgtctataaaaaattttaaaattggccaggtgtagtggtgtgtgcctgtagtcctagccactagggaggctgaggtgggaggatccctttgagtccaggagttcaaggctgcagtgagctgtcatcataccactgcactccagcctgggtgacatagcaagaccctgtctccaaaaagaaaaagaactctattctaatattgtgagactgttgcatacatgttcctaggtgaaattgaattttttttctttgtactattctggttttgtatcaaagttttatagctagataggtttttctgttgagtctaatttccttttttttttcagacagtgtctcactctgccacccgggctggagtgcagtggtgcagt

SEQ ID NO: 94464 - DNA, 1050 bp, Homo sapiens
aaaattcttggcaaaagaaaaggtaggaaaacggtggaatcaagtaaagtttccaagcagcaacaatcttttaccaacccaacactaactaaaggagccacggttgctgattctttggatgaacaggaagctgcctttgaatctgtttttgttgaaactaataaggttccagttgcacctgattccattgggaaagatggagaaaagcaagatctttgatatctttcatgtttgcctgcagttgaacaatactttagagtactttttaaaattatttctcacaaagaaatgaatgtacaatccaatgaaaacatttgttattggctatttcaggtgttttgctgctagaaattattaaagttacacactagtatgttggtctggtgacctggttacattttattatacacattattggaccataaggacatttgtttcacctagattttaagattatggagactgctgtcatttttatcttatttaaatctctaggtttattggaagagtaagattgatgaactatagcatgcacagtttggtacagtagagatcattaatacttttaaaagttctgcattaattgacttggaatccttagaaatggagtggtgacatgtcagtatgagaacaggcaaaaggtaaatttttttttttttttacaaccttaagtaatctcaataataaaattttctgatctgtattatatccagtgttgggtttatattttcacccacaaacaactgacactgctatcttttactgtatttttaaaaatttaatttgaaaaggtcacccagaagcattctgaaggaaatggttctagaattatagagtatgtagccctaatagttttccctcctagcaaaaagtctgaaatttatctttcttacaaactgttccatttcttctaaggatcccttaattatttatctctttaagccaggcatggtggctcacgcctgtaatcccagcactttgggaggctgaggcgggcagatcacctgaggttgggagttcaagaccaccctgaccaacatggagaaaccc

SEQ ID NO: 94465 - DNA, 2858 bp, Homo sapiens
tttatgaaggccaaacatggtgatccatgtgtgtgatgaagcaaaaaacttgaaagaagattttacttgcccgcgagatcttttgatatcagaaatgaagtactttgctgaatatttatctatggatgcccagcgctgggaagaggtggacatttcagttcattgcgacgttcacattttcaactggttgataaaatacattaaaaggaacactaaggagaataaagattgtgagatgcccactttaggtaaaaaacaatctgttgcttaatttgtagtgaaatttgtgtgtcacctggtagtttcttcaggccaaaagtgaaatgtggaaaattgtttggacaccggtgtttatgctcatattagtaacagccttttaggaaactgataacctcatcttttttagtaaattatagtaaatttatggcaaatgaacagatctctagatcagcagttcccaatgtatggtgtatggaccagtgggatactagggacccttttagagggtctacaaggtcaaaacagtttgcctaataataccaagatgtcacttgactttctcactgtgttgctcagatggtacaaaagcaatagtgggtaaaactgttgaagctttagacaagatcaaggcaggggcaccaaactgtactagcagtacatagttacatagttaataagaaaaaaaaaaagaaaagaaaaaaatctagtttcacttaagaatgtccttggtaaagcagtaaaaattactaattttattaaatcttgaccattgaatatacatatctttactgtgatgaaatggaaagtccactcctactgcacagcaacacatgattctcttgaggaaaagcacttgtgcgattattttcagtcctgaggtaaattagctgctcttttaaaaattgaagaccatttttacttgagagaacaactgacagagaaataatggtaattcagacttaggtgtttggcagacattttcttgaaaatgagctgctcagttaaagctgaaagcatttgtcacctgctgtcagtgacaaaattcaaggtttccagtgagaattacagttttggaaaacttaacttgcttccatgtgcttgacagaaggcttctcaatacctgacttttctgatgagattggtggtcatattaatgaatgtgatttttaaatatattgtacaatgaagtatttcaacatttggaatatctgtataactcattgagccaacattttccaaatgaccaatacattttattttcaaaaagtcatgcgtgagtgaaagattcatgcaaagtgaaagataaattagagaattttgttattaacggagtcagaaaagttcactgatacagttcagatacattgcaattaacctttaagaaactaccatttgtcaagtttggtgtaggctacccacaaattgaatgcagaaacagatatgggaatccagttgtcttctgttaagtcagacattgaagagatttgcaaaaaatatcaaacagtgctactctttactcttttttttttgagacagagtcctctcttgtcacccaggctggagtgcaacggtgcaatctcagctcactgcaacctctgcctcccgggttcaagcggttctcctgcctcagcctcccgagtagctgggattacaggtgcatgtcaccacgccctgctaatttttgtatttttagtagagacagggttttgccttgtttgtcaggctggtctcgaactcctgacctcaggtgatctgcccgcctcagcctcctgaagtgctgagataacaggcatgagccacggcgcccgacctaatatttttcattttagaaaaggtggttattttaggcagggcatggtggctcacactggtagtcccagcactttgacaggctgaggtgggtggatcacttgaggccaggagttggagaccagcctggccaacatggcaaaaccccgtctctactgaaaatacaaaaattagctgggcgtggtggcacccacctgtaatcccagctacttgggagggtgaggcatgagaattgcacgagcccatgaggcagaggctgcagtgagccaaaattgcaccaccgcattccagcctgggtgacagagtgagaccctttctaaaaaaaaaagaaaagaaaacatagttattttaataaaaatatgttaacatgtaaataggttttttgttctttgtaaatgaattcatattttttgatttcctctattttaatttctaatgtgataaatactggcagatacaacccacataaagaaaaaccctttaggattctcagtttttaagattgtaaaggggtcctgagatcaaaagttcaagagccagtgttctaaatggtagcatactactagtattactagtagaattactgtaataagaataattactgagtaatatttcaatgggcatatacttgtatgatcacacttgtggtttaatagtctttctatgcactagaattgctatttacagtagtattaaaatagaactcttatggaaaataaatctatgctgacagtgtaaaagttttttaaaaaacttaataatttattgtattctttagtgatcaaattaataggagaggtttctagtggtccttaaataaaaattacaagattgctaaatcaaaaatttcagccagaatccagagattccagactaaccagctataatatgtatgtgtgcaataaaaatcaaaacatgtagagagagaaaaaaaattattcgattcatcatatttatgtgtgtagtaaaggtaaaagaaatgcagcaagcctggccaacatggtgaaaccctgtcactattaaaaattcaaaaaaaattagcctggtgg

SEQ ID NO: 94466 - DNA, 1050 bp, Homo sapiens
agtactaatacatgaatgattctaatgtttagaatcaccagtaactaataacaacttgtcatataacatatgcaattagaataaagcttccatttaacatttgcctaattcccaactcttggcctgttcaaactatatttaatttgtaatcctttatctagcttagcaaaattatttggtattcaaatcattcataccttttcctgttgtccaccaaatatacaaaccctgcctctactaaaaatacaaaattagctgggtgtggtggcacacgcctataatcccagctacttgggaagccaaggcaagagaattgcttgcatcctggaggtggtggttacagtgagccaagatcatgccattgcactccagcctgggcaacaagagtgaaactccatctcaaagaagataataattaaataaataaataaaacaaattgtttatatcacttgcttgtaaaattgaggctctttctccagagataagacatgggatgttcatgagtatttgaatagtcttttcgaagaattaaaatcttggagagatgtatactggcgattgtggggaacaatcaattggctgacttgttcaagatgttatcaggtaagatttttttttttaaatatcctgctctgcaaatattgagagcaagattattttgatatctgctgtttaattgatatgtttaaatgtgttttgacaatatccaacatctttttaaagaaactagtggcagctgggcatggtggctcgtgcctgtaatcccagcacatttagagaccaaggcaggtggatcgttttagcccaggagttcaataccagcctgggtgacatagtgagactccatctcttaaaaaaatgaaactaggcccggtatggtggctcatgcctctaattccagcactttgggaggccgaggtgggcggatcacgaggtcaggaaatcaagaccatcctatctaacatggtgaaaccccatctctagtaaaaatacgaaaaattacccggttgtggtggcacatgcctgtaatcccagctattcgggaggct

SEQ ID NO: 94467 - DNA, 1031 bp, Homo sapiens
gccagtactatgctgtctgccatcaatattcacaagaatggaacaggaatttggattagtgataacagacagtagggcacagagatgcaggaaagtaatgcagatatggttaaataatccaggaccacattcacccagagaatgtgcatatgtgcttgtttataagactactttaatattggtggttactatattgtaatttaatcttaatatcaaggaatatacatttacttgagtgatagaggtacaattcaacaaatactgagtacttatgtgcctactactgttctaggttctgtgaaggaattaaaaaatatatgaagtaatgtaagcctgctccaaatataaaaattcttatgtctatttcctggatattgtgctagccagaggttattttatcagctcttgattgactgattcattcaaaagaaatttaggtaaatatgtttgaaagaattcaataaaaaatcataatattacatttataatagatttttttttaacttagaaacaacagtcactgttttcagaagaagaagaatataccactggatctgaggtcactgaagatgaagttggagatgaagaagaagtatccaagaaacaaagtattggtttataagttaaaatcaaatctccctgtttatgaaggggttacattctgaagcctttaatgcaagggatggggaattggttttatatagagagtaggttgcaacatagaaaaaaaattgaaaggagacaccatcaagatttcctaacccgggcatgaacacaaaatactcaaagctgtaaagaaagggcagtacactgagaaagaactctccaggttttcacttcaggtgcaactaaatgtgtgactcatttcagatgaaatgtgatctgagacgtgtagctgagatgatttggagtgatactcaaatgaaccattaaataacattcatcaatgtatgatttttttttttagtggaaagcatgttttttttgtgtttgtttttttttttttttttttgaggcagagtctcactctg

SEQ ID NO: 94468 - DNA, 1058 bp, Homo sapiens
gaaagagtgctcagggaaaatttgttccaaactataaccatataataaattatgtgtttgtaaattatatgtaggtctctgaaaaactttaagatgcactgtttctatttttttaagtcttaatttgccttataactgacatttcttcaaattattcagagaacagactttaataatgtgtgacaaaagagcaatttccattgaaatattgaagtgttacactcagtttacacgtacagaaatcattctttttagtgagtcttttagttgataaatgaagctagatgttatttgataactggctttgccaaggtttttgaactgctgtttagaaattttgttcccatttatatttgtttcaattgtttgatactgtggaaatagacttttattttcgaaagaaaatgtcttgtagtacatattatatgtaagtactctgttaaataccagagttttttttgtagtttactgtgttttctgattaaaggatttggatttgtacatgtaaacagtgctgtaatggtcacgactagataaggaaaaaatatatatgctcttttgatttttaactgatggtaaaaaggcaaactgcttctcccctgggaggcctataccactgaattaatttttacaaaccagagtttatcagaatttgattctcttcagaatgcttttggccaggtgtagtggctcacgccagtaatcccagcactttgggaggccgaggcgggcagatcacctgaggtcaggagtttgagaccagcctggccaacgtggtgaaaccctatctctactaaaaatacaaaaagattagccaggcatggtggcatacacctgtagtcccagctactcgggaggctgaggcacaagaattgtttgaacccgggtggcagaggttgcagtgagctgagatcatgtttctgcgctcctagcctgggtgacagagcaagactccatctcaatttaaaacaaaaaaagaatgtgtttttaattttgttaatgtttgtctgttatacatagcactggtaccgcaaacattttacttaaactcttaatag

SEQ ID NO: 94469 - DNA, 1035 bp, Homo sapiens
gatagctggtattgtcatgattctgattagttcactactgctactttccctgtggcctaggctttgcctatttccagtgggcgagctagctagatcctcctcccttaaataagccagtgtttttaagacagaatactacttgcatagtggacaataatatcttaaagaactgagcaggatgaaaagaatttgatagaaagcaggtttgaggagcacattggaggttggcaggtttcgaggctgcttgagaggacttgggccgatctgggctgggcttggacgtgaccctggcacccaggcaggtggatcccagctggggcttccattcacgactttctggtccctggcaggacagagcgggatgccaccagcttgtccaaagggaagttccaggagctcctggtgggcatcgttgtggagaatgacgctggccgcggcgagatcaacgagttgaagcaggtggaaggggaggcttcgtgcagcagccgcaaaggaaagctgattttcttctatgagtggaacatcaaactgggctggaaaggtaacaggggcctcagggtactagtggggctggggacaaagtgcgttcatcattcagcgaatgtttttacagcccctgctatgggcctggcacactgactggctcctgaatcagcgttggtagatcctgacactctggccacacttgagttccatgggccaagaaggatggggatttcccttctcgcagcactcgcagctgcttagagctcattgctgtcagctgggccctcttctaccaggcccttgtgaacaggagtctcccggcattgctgcctggagcactcttcccccaggtagctgcctgcctccttcaggtctttgtcctgagtaaagccatctctgtgcatccttggagactcctgccttgtgccatctttcttccctactttatttttccccaaggcactgaaacttgctttacaaaactattttgcttactgtcctgctccctctttctgtcattcagtagggtagggatttcttttaaaaacg

SEQ ID NO: 94470 - DNA, 3029 bp, Homo sapiens
ggccctggagtggtggaaccctgtgagggcagctgagctattcagtgaggtagggcagtttttcataaaatcaatttttttttcttttttgagacaaggctcactgcagccttgacctcccagcaatcctcccacctcagccttccaagtaactgggaccacaggtgtgcgccaccatgcccagataattttattttgtagagacagtgtctccctgttgcccaggatggtctttaaactcctgggctcaatccatcctcaccacagcctttcaaagtgctgagattataggcatgtgccacagtgcctggcccagttgttactttgtattataattgaagaacccattttgctcattttaggcatcgttaaagaatctggagtgaagcacaagggattgattgaaatacccaatctttctgaggaaaatgaagtagatgacactgaggtatgtgatcaagtttctatttcttttgttcttttttcagtcaagcttctgctacagacattgggcatttcaaatagtgttgatcagactgtgtggttcctgtgtggtagttcgggtgccttgtggagggcctgtttgccgagaaggattgccgtactgtgggggcagcgtgttgtgtggagctggagtggtacaggaaagagagtaagccccaggaagccctgagctcccccgaggaccaggcaaggggcctgggcagctggctgcaccctccttagcctcctcatctgtgaaaaggggttaatttctcttccaggggtgttgtcacgttagatgtgacagtgtgtgcactgtaaactgctcaggcagcttgcatggcttgatgaatgtgactctccctcttctcctgcacctttgccgtttccctttaatggtgaaaagtctcagcctttagctgctatctctcccttggttatgcctcacggttttttgtaaactacccagttagtacgtgttgcttttgtggctctcttggttctcttgggagacagagccttgtgtaactcccatgcttggcttcaagttagtgccctcttttggctgaaagctgggttttgggggtgagaccatttgtacagccgctatatttttcaaacgaggatagtctgacaaaggattttttttgatttgtgaacgtatttaacatgaaggcttttcaagataggctgactcctgcccagcagtatgtcttatggcacgaaggttatgcagtgccacaggccgggggctgtcccagacctctgtcttcagttatgtggttcctctgctcagggcctgagattccactttgttatattcagatccatcagctgagaaatttttcaacagaatgtttaactggtttttaagatttaatctctcagtagcattacggaacaaactctttagattcaaactggggcccgagatcaggcccccctcaactgaagcatcgggacactaaattttttcaaatcgacccctttttcttctgggaatactagagacatccccacagccctctgttgcttccttctcccttggcctcccccttcttccctctcttcttccttccctctgcctgtcttctactcttctccctttcccaattttcctctctgccaaaaaagtatataatccaaggctgggttgtatgggaacttgatttccctaattacggtggcttttgggttctataccagcactgttccatgtaaatataatgcaagccacatgtgcagtgtaagttttactagtagccgtacttaaaaagttaaagctgtggctgggcatggtggctcacacttgtgattccagcactttgggaggccaaggtacgaggctcacttgagcccaggagttcgaggctgcagtgagccatggtcatgctactgaactccagtctaggcaacagggagacccttaaaaaaaaattaaagccaggtgtagtggcatatgcctataatcccagctgcttgggaggttgaggggaaggattgtttgagcccaggagtttgggtctagcctccgcaacataacgagatgcaagctcttaaaaaaaaaaaaaaaaaaagataaacaggtgaaattaattttaataatatattttatttaacccagtatatataaaaaagattttagcatgtaattaatataaaaattatgaggtattttacattcatttttggtagtaagtctttggagtctggcacgtattatttcacacagcacatcttgattcaggccagccatatttcaggttctcagtagccacatgtgactagtggctaccatactggacagtgcatttctagaccccatgaaagccatggaccacatcagcaataggatttatatacatacacatgcacaactttgtatgcaaattaaagggtttacattctatgaagtccatgcaagatttggcccccaaccctgtcatggaccctggattaaaaacccttaaaatcctgccctatcacatctcttacatctacttctttccttcctccactgccatagttctctcatccatacagcccaatgttgtaagaatacatcaaaccagatctttctttggtttctatttttctgatttgtaggtcaacgttgagtaaaaagaaaggagatggggttatactgaaggatcttatgaaaactgcaggcactgccaaggtcagggaggcccttggagattacctgaaggcacttaagacgggtaaagaaggcatcccttgtgaatcagaggggtcccttttctatttacccaagttatactctacactgtggtcagaggctccagaagcaagtttatacttcagaataaattgtagtctggaagttgagagctagtcatcgttaagaccataattagtgataattagtattgtacacagcatgaaccattttgcctacagaactgttaattgtagttttctggaatgaaaatcagttgttcgtgtaattacttgtttaatgtctgacttccttgctagactataagctccatgagggcatggaaggtgtctgtcttgttcactgc

SEQ ID NO: 94471 - DNA, 1097 bp, Homo sapiens
cataaccttcgtgccataagacatactgctgggcaggagtcagcctatcttgaaaagccttcatgttaaatacgttcacaaatcaaaaaaaatcctttgtcagactatcctcgtttgaaaaatatagcggctgtacaaatggtctcacccccaaaacccagctttcagccaaaagagggcactaacttgaagccaagcatgggagttacacaaggctctgtctcccaagagaaccaagagagccacaaaagcaacacgtactaactgggtagtttacaaaaaaccgtgaggcataaccaagggagagatagcagctaaaggctgagacttttcaccattaaagggaaacggcaaaggtgcaggagaagagggagagtcacattcatcaagccatgcaagctgcctgagcagtttacagtgcacacactgtcacatctaacgtgacaacacccctggaagagaaattaaccccttttcacagatgaggaggctaaggagggtgcagccagctgcccaggccccttgcctggtcctcgggggagctcagggcttcctggggcttactctctttcctgtaccactccagctccacacaacacgctgcccccacagtacggcaatccttctcggcaaacaggccctccacaaggcacccgaactaccacacaggaaccacacagtctgatcaacactatttgaaatgcccaatgtctgtagcagaagcttgactgaaaaaagaacaaaagaaatagaaacttgatcacatacctcagtgtcatctacttcattttcctcagaaagattgggtatttcaatcaatcccttgtgcttcactccagattctttaacgatgcctaaaatgagcaaaatgggttcttcaattataatacaaagtaacaactgggccaggcactgtggcacatgcctataatctcagcactttgaaaggctgtggtgaggatggattgagcccaggagtttaaagaccatcctgggcaacagggagacactgtctctacaaaataaaattatctgggcatggtggcgcacacctgtggtcccagttacttggaaggctgaggtgggaggattgctgg

SEQ ID NO: 94472 - DNA, 2234 bp, Homo sapiens
cgcctgtagtcccagctacttgggaggctgagggaggggaatcgcttgaacccgggtggtggaggttgcagcgagccgagattacaccactgcactccagccttgccaaagaacaagactccatctcaaaaaaaacaaaaacaaaacaaaaaaaaaaaacaactaatgaaatgctgtagtatcttaacactggctttctggttttatcattctaagaatcccagagaaaccagggtattcttaggaaagaatggattcctgggaaaataaacatctgcaattaactgtaaacaactgcatcaaagtgttggctttagaatttgaaatgttcctatctgggtttttgtaggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaaggttagctttatggactactatcattacctttagggtgggaggagggagtaatacacttggtgtaactggtttaagagttgtgtgttcagctgaacctcctaaatataaatgctagaaacaaaattaacttcccacatccccccctaacgtgatcttaatgactttcagagaagtttcccttttggcatgtgttttcacagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagctgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgattgctattctgtgcacttaattaaactgattgtgatgacttttcatttgtttacatacgttgcttcagtcttctcaggtgaaagtagtgagaaaaccgtgaaagaggggggaaacatttatccattatatgctgtttcactggaagtgttaccagcagtccacagaactaatgtgtccccacagacttctcaatcctctccacaccgaagtgcaaaaccacagcagggagatgtgcagggagatgtggagcaaaacacagccaatttgccctcacctcaacatgcttttgaatgcaatataccactgttttacgacctaagat

SEQ ID NO: 94473 - DNA, 1117 bp, Homo sapiens
cttaaagtcactaatagcattattttatgcccacgaaccagtaagtcagaccaaagcctgaaatagtgttttctgaaaaatggaaaaggaaatataagaattttaaaaacaaaccttgaaatcagtttctcaagttaaaattctgatggatgtcacaaatagtaaggtcttccttactgagctctgtcatctgttttggcttttatgcatactgtgatttgggaggctgctgctcaacattctagcccatttccagagtgttccattattctaggacatggctgtcatgggagtctgcacaaggcaactaatgctctagatttaactgccttttttaaatcagtagatcattaattgtttcagttacataggagccataggcagtaatagaaacatcacaagtattgtttccaaaaatatacccaactagagataagaccactaagatgttccctttattacctttcagcatttaatgataccagcttgtagcttccaaggtgatagagtgtgctgtgtacatacaaggcatagtaaacgtgtatttaaaacttgtttttttgtcgcacatggcttaagagtttgaatcagtaagttaaagttacgagagtaaaatcatatgaaggccacacagttaactgaaggacagtttaaaagtgtgtgccgccgcctctgcatagttcttaccccatttaaagaagcacttgctttggaaatttcaactcggttggagaaatcagactgtaggttctgatactggcttatcaagtttgtaataagagtgctgatcaaattggcacagtttgcttcagaaaacacttgactttgaacctgaaaaagaagatttaaaaaaatctccaaaagaccagcataatgaaaccacaagcattaactaattagaaatgacacactgagtttccaaagtactacgtacctttagaaggaaatgtgtcatgaacgtgtagacaatgttgttgtttaaaaaagttctttcatccattaggatacatttaatatattctgcgaaaacaggatcttcacacaaaagcttgatgcagttttttgacatagcagactaaagtggggagaagatggttgagcacttacggttgagcac

SEQ ID NO: 94474 - DNA, 1044 bp, Homo sapiens
cattttggagaattgattttgattcttaaaatgtgtctttttgcaacatatgctctggttacctataaatacattaatttggcccttgaaaacattcacatcctattctttgttagccttatttttccagtccttgttaactctctcagtgctggataataaacctgcatttcttttaaaacatttgttcagtttcggcatcagtgtcttcccccagcactcccttaatctaaattagtaacattttactgtatgaaaaatagttgctgttaactaaaaattcaataggtgagttagacatggcttttcaagtaggattttcagtggcttcagattccatcatacacaagtgtatgttttttctgtgtaagttttttccgtgtaagttttttccgtgctcaaccgtaagtgctcaaccatcttctccccactttagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggtacgtagtactttggaaactcagtgtgtcatttctaattagttaatgcttgtggtttcattatgctggtcttttggagatttttttaaatcttctttttcaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggtaagaactatgcagaggcggcggcacacacttttaaactgtccttcagttaactgtgtggccttcatatgattttactctcgtaactttaacttactgattcaaactcttaagccatgtgcgacaaaaaaacaagttttaaatacacgtttactatgccttgtatgtacacagcacactctatcaccttggaagctacaagctggtatcattaaatgct

SEQ ID NO: 94475 - DNA, 1438 bp, Homo sapiens
acgccactgcactccaacctgggcaacagagtgaagacactgtctgtctcaaagaaaaagccattcttagctcacaagtccatataaaaacaggccatgggtcagatttggcctgagggccatagtttgctaacccttcctctactttgatgagtaattaggatacaggaacatgggaacgtaggaactctcttccctatagccacagatgtgatgacatgtccttgtttacctatgtgtgtggtgataccgtggtgggtatatgctgccaaacaccaaccagattaggttaggataaaggggaagtagcatttccttgcctcttgtgtctaaagggactcatcttgacaggaaaataaattggcttacctgtggaagggatcctaggcatccttggtaagttctgagtgagtgacctgacttgcctgtgtaggatgttctcaagtccttggtctaacccacggtttggcaaattacaacccacatgctgcctgtttttgtataaccatggctacctgctagctaagaatagttttcatatttttaaatttttttttaatatagaatattttctgacatgaaaattatgagattcccatttcagtgtttgtaaagttttactgaaagacagccacacccatttccttactcttgtctaaggctgccttcacactgcctcagcagggttgagctgtgttaacagagcatggccacaaagcctcaaacactatttggcccttcccagaacaagtttgctgactccttgtctaactcagtcttttcttaactggaagaggatggtctgtgttatatttcttcttctccatgattatacttgccctggggaccctaggggatgtggaagatgggaaattcatttaggactgtggtaatgaagcttctgtactttcagagataggatgacagaggataggggcacacatcttagtgacatattttacatctggaatagtcaagaagtggagaagtaaattcatagaggttccaaatagcactctctgacatagtgccagatgcggtccactcagaagatcctgggaacaagccaagaaactggtgttaagggccgcatttacttaaatgtaccacaaaggtcattctatctttgaagaaagaaggtaaaagaggaaagatatgtttaattctccacttttttttttttttttttttttttacctttcccctcctccctcctgcagtctagccaccctatgaaaattatctaataggcagagtggtaccttaatccaagaaagatttggagccacttgcagtaactttttcttttcccagataaagttctaatactcaaaaaagaagagttgatttaagtcccatatccttcaggaatgaggtataggatataaataaattcaaagtaccacattctaagatatttcactaaacattggaatga

SEQ ID NO: 94476 - DNA, 1003 bp, Homo sapiens
ggccaaggcgggcggatcacgaggtcaagagatcgagaccatcctggccaacatggtgaaatgtctctactaaaaataaaaaaattagctaggcatggtggtacgtgcctgtagttgcagctacttgggagactgagaggccagagaattgcttgaacctgggaggcggaggttgccgtgagccgagatcaagccactgcactccagcctggtgactaagcgagacccagtctcaaaaaaaaaaaaaaaaaaaaaaactttctatgaggatggaaatattctttgactgtaccaccatgcatagtagtcagtagcccatcatttgtgagtgttgagaacttgaaatgtgactaaggaactgaatttttactttaattttaaccaaaataaatttaaatagccaaatgtgactggtggcacagcattaaatataaatcaaaacctccacaaattgagcaagaaaaaaatttttcttggttaatacagaaaattggacattgtcttagatacaaagttcttaggtcttagacaaagacctaagaactttcctattgtttcctaaaaacaatcctatcattaatgcctcctataaatggaaagagttgtgtcccacagtttgagctgaccgaatgactgtttccaaggagaggcccaggaaagggcttgagaaaagaaagtccacattaatgaccacacagagttggtagagaattttaatttgtataatttcttcaagaaattatatttggcaacaagaaatgaaaagggtaagtttaaattggttatatctttaatcatttgaacgttgaggttacatgtccaagggccacaatattaaaatattgtgaccattggtgagaacatctcaagacctataatggattgcaagtcatttccagttatgaggaaaagtctttgtggtaatttttatatgggcaactgagcagatcttaagattggttagaggataaagagaaatatataataattacagatttgaatt

SEQ ID NO: 94477 - DNA, 1020 bp, Homo sapiens
ttatcttagtttcaacttttttaaaaacaatttttccctttatctttctttacccacacttcattcacactctcccttgcttgccatcttcggattttcagtatacttgagaagttcttataagataaaatatttaaaataattaacattacaggaataacttggaatctatttcaaaagtcaaacttaattcatttttcttgatatgtctgtagagctaaagtgtcacattttaaaatcctacagtaattttactttattaaagtatatagaaataatgggtaattttaattcatagcatttgcacactgaaaataaacttacgacaattaagatcataacattactagaaatttggattttaaaactaggttcttatagaatataaatattgaatcagctttttagttaaacttattacatttgcacaaaatatgctctttattatacaatttaagtgcaaccattttatcatctttaaccttcagggcaaagatgacgtttatgatcgtatgctgctagactacttcttttcttatcatcagttcatccatctattatgccgagttgcaatcaactgtgaaaaatttactgaaacattagttaagctgagtaagtataaaagatgagcagtaaattccactgaattattttaagcccctagtcattcaggaaggggagaaaaattatgagacaatcctttttttctttttttaaagtgaatgcttaaaaatattaatattcttgggaacattttaattttcattaagaaaacaccaacttactggtttccattgaatagttctgcccagagtttcagctggcctataaaggagtgtggagtagggctgatcacttctgtacatagaagcccacatcctccaccatctgcccagcagattctgaaaacaaaaaacaaaactgctctgcttagggaggcaggcgtagaggtggactccccagccctgctcttgagggtgcgatgagatctatagtgccagctgtgctttggagctggca

SEQ ID NO: 94478 - DNA, 1180 bp, Homo sapiens
ccaggagctcaaggctgtagtgagctgattgcaccactgcactccagcctgggagaccaaaaaaaaatccctcactgtatgttgccagaaaatatctcatacttaaaacaaaataccaataaatagtgttttaatcttttgtttccaaatgatgccctattgtcgttaataactctgttgatctaaacttgattgagcataagacagaatttctactcgtgtcaggagcttagttttagactcattaaactggttgtagtgaggcaatcataggatttgtaagatggaaagtagtaggcagatataactcttaattttttgctacccaaactttgtttttattttcagatgtcctcaaggaacttgtacttttgagtccccatgattttcttcatactctggttccctttctacaacacaaccattgtacttaccatcacagtaatataccaagtacgtatttatctagcacagtacttcaatatggttcgcatttaatcgttctgcacactgaagcatggagatttattttttccatttattcttactgtacacttttaatatcttagtgtctcttggaccttatttcccttgtcgagaaaatatcaagctaataggagggaaaagcaatattcggcctccgcgccctgaactcaatatgtgcctcttgcccacaatggtggaaaccagtaaggtatgttgggatgccaggaaaatccatgttgctatagtacaaagtaatttgaaatttttcccctggcagttatgaataggttagacttaagtgaccaattttgtggatcctaagaagattagattcatttggactttttccttttagtgctctgaaatgttggttgaacatttgcaaaaatcaacaataagcacaagtagtaagttttttttccccctcaaaaattaccttaatagtaagtcttaatatttgtcactaggctaaattataactgggtcatatatctaaatttgaaaagtcattaggtactgtttttttttttttaatttggccatataatcaatgacttcttctacttcccttaaattatattcctttgacctaagcataatattgattgatagatttgtcatcatttttagtctggttcctttcttctaactcatattctaaaataatgccaattctaaattatagagacaaggt

SEQ ID NO: 94479 - DNA, 1188 bp, Homo sapiens
ttttgcagctctttttacctctttcaggcctactcttttgagtatggctgacagtcactttaccattgtctttggacagagaccctggaaagttggttaaagcagttgcctattctccctaatcttttgtgacctactgctttgtaattttgaagacttaacaatcttagagcaagtacttttttaaaaaaatgtgattaaactatttcttcagactagaatatacacacaaaatagcagagctctgaaggtgaggaatgtttaaaagagcttaatgagagtttaacttcaggatagaaagcaaatacgtttgctttgcacacatgtgcacacacagtctgagtctgaaaacatctatcgtagaggacgagtactaccattttgtggctcagtaagcaaaaatgaaattaagttttcaattttttcaaatcatttgtagtctttcaacactttgcacatgatgtatcacgaagctacagcttgccatgtgactggagatttagtagaacttctgtcaatatttctttcggttttgaagtctacacgcccttatcttcagagaaaaggtttgctcattcctacttcttatgttttgttcgtgctactagtaaagagagagaaggttttaaaatcatgtgccccagagaaattgtttttatcctagtttatgcacagaagatgaggctgaagctagctaaccatcaggaaatgtttgtcatgaactcctgatgtaaagctggaaggctcttttatgtttttgtacctgcctgaaaaatacgcaagcaggtatcaagatttcagagattggaaaacatttccaaacacagtaacaagctgggcactttgtaaagattctccagctggaaacttctttggcttagattagatcatttgcagtttcatgcgagatgactataaaacctacctgtcttatgtccctataagatactgtgaactctgaacttcttcatatacattcctagaaagtgggacatattatcaatgaaatatgttctttaagaaatctagcaggtttaacattagtagtaatcatctcatgaaaatgacttagctttcactgaagatgtttttgtaattaacctgaatttctagcattagcattctgtagtttacagtagaaaacatttgtgaggaagtttgatctcagatggcatatttatatgtgct

SEQ ID NO: 94480 - DNA, 1593 bp, Homo sapiens
tatatctatttctttctttataacaagtatattttaccatatctgtatgttattacaaagtaaattatcattatttttcaattaagaagaaaactaagactgtagaacattgaatgatttgacctcctcaggtaccttttggtaggtcttctgactgcaaatgctgggttccctctgttaaatcatactacttcctgagaagaaataaaagataaagtgggaaaattctgcatcttaggcaagctaaagaaaagtggtttaaaaattattgccacttcaaaaataacaatggcagaatagaaggtatctatttttatcacctcttgggatctttttgtggggccaaggggaaagcagaaagatactaaaagagatgttcatgtccctttttattcattttaattattaaagggaacagtggctttgtgattaatgactgctgttcagtctattttatatcttacaaggatctgacagttttgttttacattttatagctgcagcttatcttctggtgtcccttataccaagcaattcattccgtcagatgttccggtcaacaaggtctttgcacatcccaacccgtgaccttccactcagtccagacacaacagtagtcctacatcaggtctacaacgtgctccttggtttgctctcaagagccaaactttatgttgatgctgctgttcatggcactacaaagctagtgccctattttagctttatgacttactgtttaatttccaaaactgagaagctgatgttttccacatatttcatggatttgtggaaccttttccagcctaaactttctgagccagcaatagctacaaatcacaataaacaggctttgctttcattttggtacaatgtctgtgctgactgtccagagaatatccgccttattgttcagaacccagtggtaaccaagaacattgccttcaattacatccttgctgaccatgatgatcaggatgtggtgctttttaaccgtgggatgctgccagcgtactatggcattctgaggctctgctgtgagcagtctcctgcattcacacgacaactggcttctcaccagaacatccagtgggcctttaagaatcttacaccacatgccagccaataccctggagtgagtaaaattgatactcttttatctgtatcctcaaatagattggaaatacctgtttttcccctggtgggaagtggtggcagaatatagaatagtctcaccattctttcttaagaacttaatgtgtatttgttttcttaaatacatatataaaatgctgtgttgttataaaattgataactgtgtagataacttttcttagggtgaagttaaagttgcatatccagtaaaacttacctgttttttaatttgtggttttgtaaatgtattcttcatgtgtgcctaatgaaaaaagccagcttcatggtacagttttaaggaattgagtactttgctatttaaaaatcagatacttagcaaaatctacatgctgtggtaaactgtgagctagacaattttatatctaaaactagtagtattccgcagtattttttctcaagctgcatccaaacaaatgaaat

SEQ ID NO: 94481 - DNA, 2564 bp, Homo sapiens
tgctgaagtgctctctagtgttcttaagctcaagaaggccatgatatgacttatagggaaaatacgtgttagacacatttcattcatatgagttttaatactattggcagtgagttaaacgttaatgaatcaacaatatatactaaataaggtatctttaacagaaacactcataaaacaaagtaaatgtatcgattggttgacaaaaatattaccagaggctcacagaaacttaatcgtgtatttgccctagtagtaataatttggtatttgctaattcagtatttgccacactttatagaacacaactacctcaaatacaagaattgactataaatcaaaaacttttttttttaatggtttccagtggatagaggaataaaaacagggtggaggggacaggaatggatttttgacaaatttaactttggtatcatataaatgtataattataaataaatgaataagaagtaatctctaaaaatcaaaagcacagtgaagtaaatgaacctaactatatattaaataggtaaatttctagtgggatgtatatgaaggacaaaaagaattgtaaaattttcctaaactgtaatagtaattatattatttgtaataaaagtattattctgaaagtattaatgtatattacaggatgaaacaaataagtaactgttaatgtcattggaaaccaagattttcagcaaaagaaagataaaaatattaaattgtagggttttgcataacttatttaaaactaaatttgaattggaaatatctgtagcagtttatggtatatttgcaaacagaaaatctgttacagaaaatctgttacagaaaatgttttacctaccactgttttctgaaaagacctggaaaccctgtacaacccagaatcaatgagtacccttggcatctagggtatagtctctaggtttcatttcccactgaaagaattggggttccttggaaaaacgactagttacagttcttgggaaagaaatgaatgagaagtttggaatgtcttgtcattttggaaagcaaggaggcagtctaagactactgaggtcatggtaaagaaactcaagagccaacttacggaggtttctactggtcatagattgaacagctttgagcatcggtaataactgcagtggactgtgaatcacatcaaagatgtttaaatccatgagttcataatacctaaaaagaaatttttttttagtttacttgcaacttttggagtatattaggaaatcaaatcattatttttgaaactgataaataatggaaaacagtatcaagcatttattctacttgcaagtatacttcgtggcaaccaaatggtgattgaggggaagtttgtgttcttatatgtattcaagctaattaatgagcaaggacaattggaattagaatatcactgttttggaatcccagatgaaatgatggatctaggcagttgtcaccactgacagaaaaccttacaaaaagactaacccttcattgtgtgccttctacaagatactgttaattaaaaagtcaaacctagatctcatcaagtctggatctgactaccagtttatagaaaatgcagggacagagaaacatgttaagacagcaccataaggatacaatcagcaaagtgtaaatgtgagagaaactacaggacaaatgaccttcaacagataaattgcaaacacaaagctggtggggaaaccaatagattaaaatatttaagagacttttcaactaattatggcaaaaggctttatttgaatcctgattcaaacaagttaattttaaaaatctttttagaaacttcaggaaatgtgtacgctggatattgtatgacagtgcggaattattcatttaggcatgaataatggtaccgtggttgtttttgaaacctatctgttaaagatactatgatttatggattaaatgataaaatgcctggaatttgcttcagaataattcatattgagtggatgggggttcaaatgaaacaagactggctctgattttggtaaatttgaagctgactgatggaatacttgtactattctgttttttaatatagctgaaatttttataagttataaaagaaatatgcaatctaggtgtagtggcttgtgcctgaatcctggttacatagaaggatcccctgagcctagtaattcaaggctgcagtgagctgcgatcacatcactgcattcccgcctgggcaacagaagtagactccatctctaaaaagaaggaaagaaaaaaaggaagaaatatacagtaattttaaactgggagatgaaatgctaatttctagaagtccatttggttttgaagggtctcatgtcaaaaaaaaaaaaaagtaagtaaaataagacccatcctactgttttatatactaaaatagtaagttaattaaatgaaaatgaagtacatttgggctttcatttaccaatcctggaatgttgaaaagttgcccaaaagacatttagcaagcaaatgtagctagcaaaaaatcattttatgatggcaggttaatacaattataattgaatcaacaa

SEQ ID NO: 94482 - DNA, 1084 bp, Homo sapiens
agtggtatcttattgtggttttggtatgcatttttctcaaaatggttacacatttttttcatgtgattgtgggtcacttgtgtatctttaaagaatcctcacatttccttctcctagctgctgaccccatgatgagcagcggcccttccccattccactcttcttaaggaattggatactagattttcttttctctgtatctccactagctaaaaggattttttgaagctttgtttttgatcatctgtattactgaaatgtacagtttgttgagttttttctctttatcataaaactgaatttttttaatgctacctttgcctcatttccttagtccattgttgagactccagaagagctccagaataccaagataatcttgtgcaaactataaatgggtggcagagaattttgaatcatgttaatttttcaaatctttgttacctgatgagttggctcttgtttgatctttttctttcttcacagatgtttcagcgtttgtgtatccatgtgattcagaggctgagacctgtgcatgctcatctctatttgcagccaggaatggaagatgggtaagaagtactttttgaataagtttgtgtgtctgtgttgtgtgtgtgtggtgtttttgttttttttttttgttttttttttttttttttaagagatagggtttcttcatgttgcccaggctggtctcaaactcgtaagttcaaatgatccgcccgcctcggcctcccaaattgctaggattacaggcatgaaccaccatgcttagccctaatttttaagtttcttaacaacctgcctacaaaatattttttaaaatccacactgaaatatttgttctgtttaaaaaataatctgtaataatacattcaagaaggtaaaactgtttttgttttatttaaattttgcatctgcaaaatcctctacaaattactttatggcttagtctttttgtttgcattgatttagccagtcacaataactacttaagttattgcggttcatattcattatctcaaagataaaagaaattcagagtttaaaaagtactttttctctcgaacagtatttccag

SEQ ID NO: 94483 - DNA, 1005 bp, Homo sapiens
ggctcactgcagcttccacctcctgggctcaagcaattctcccacctcagcctcctgagtagctggaactacaagcacacaccaccacacctggctaatttttgtatttttttgtagagagagtgtctctcccctgttgcctaggctggtctcaaattcctgggatcaggcagtcctcccaacttagcctcccagagttctgggattatagttgtgagccactgagcctggcctaagttacaattcttataccataaaatttacccagacctttcaaaatgtaaaatttagtggtttttagtatagtcacaaagttgtgcagccatcactactacctaattttggaacatttgccacccccaccccccaccaaaaaaaaaccctatacccattagcaatcagttcctatttcatcctgtcctctctcctcaatacctgacaactactagtctactttctatctttatagatttgcctattttgaccatttcatataaatggactcatacactattagtcttttgtgacttactgcttcgatttaacaatcttttcaggatttattcatgtcacagcatgtatccatattacattttctttttttgccaaatagtttgtcaaatgtatatagtccacattttgtgttacctgttcatcagctgaatatttgagatgtttctactttttggctgtttttagtaatgctgttaggaacttttagtacaagtttttgtttggatatactttgtcacttctttgtgtatgtttttagaactggtaaactgttttttgtttttgtgttttgttttttttttttttgagacggagtttcgctcttgtggcccaggctagagtgcagtgccgtggtcttggctcactgcaacttccgcctccagggttcaagtgattctcctgcctcagctttccaagtagctgggattacaggcgcgcaccaccgtgcccagctaattttttgtatttttagtagagacgggatttcaccat

SEQ ID NO: 94484 - DNA, 1044 bp, Homo sapiens
cagtggatttggcatgataacatgcagtttcttcaagacaaaaacatttttgaacatacatattttgggtaagtttggtaaatttcatagtagatattttacacattttaaaaaaatcttacgtgtgaattttaaatgattatttttaaattctagatttatgtggcaattgtgtagttgtattcccagtacattaccagatcctaaagctgtgtccttaatgacagcaaaggtaataaatatatgaactttaaataattctgtcaaaatttactactttaaaatgattgaagcttttttgctttatcttttcttacagttaagcacttcctttgtcctagagacatttattcattctaaagaaaaggtatgtgttttctactatggatttttttgtcatttatgtttttatcagatatcttttggtttttgttattgttggctcagaagttcatatgctttgactgacttttcttttctagcccacgatgcttcagtggattgaactgttgacgaaacagtttaataatagtcaggcagcttgtgaggtaaggtgataattcaacaactaatgcatagtttaagattcttttttttttccccccctctgatctaagatgctacagcagagttgttttatctgtcacagggagccaaatggaagtcattcttaaaatcatttggtagctgagaaagttataatttatatatcacatccattacactgattaaataattgattattaagtcacttaaaaattcatgttttggccaggtgtggtggctcacgcctgtaaccccagcaccttaggaagctaaggtgggtggattacgagatcaagaggtcgagcccatcctggccaacgtggtgaaacactgtctctactaaaaatacaaaaattagctgggtgtggtggcacatgcctgtagtcccagcacctcgggaggcggaggcaggagaatcgcttgaacctgggaggcagaggttgtagtgagctgagattgtgccactgcactccagcctgacgacacagtgagactcca

SEQ ID NO: 94485 - DNA, 1151 bp, Homo sapiens
aggtagatgttttgacatgtcagaataaattacagcttcgtgccaatgagatattttaataatatgctttcctcatttataatgttgctgagaaagaactatttaaattcagtttttatttccacttatttattgcatttaccaaaattaggacaaggccaactactttcttgcctcactgtcatcatttgttttcttttgttatagtaaaattttctcagtctcaactttatagtgttctctatctaaaaataataaaaataataaaaactaaaaaaaagatattaggatatattggccaaattgtgaagtacgtagaatttttatgaaggcggcggtgtttgaaaactacttacaaagttactattaagtataaaatagctgtttatgaaataatttatatataaatatagctgagtatacccattttttcaaagaagtaaaacttttgtatttttaaacagaccaagacctatgattctgttacagataaatttatggacttctcttttgaaaaggtaaccatttttttcatgtataattttatattgttttttcttctgcattgtctacttttagagtaatactttgtcaaaatgaaaataaatttttttcttgcctcttaaagacacacagtgcatatatgctgttttacaaacgcatggaaccagaggaagaaaatggcagagaatacaaatttgatgtttcgtcagagttactagaggtataagttaatttcatttgagcaacattttaaaaatatgttaagtgtttatgcaaggaatactgtagtgtaagaacaggttctacaggttgatatctgcaattctgagtagatcttaagagtatttacaaatagtcttggtaatactgatataagacccgtaaatgaaaatgaatgagattaaatggagtagaaaatatcactaaaagagagtaggcgactgggtgtggtgattcatgcctgtaatctcagcactttgggaggccgaggtgggtagatcacgaggtcaggggttcaagaccagcatggccaaatggtgaaactctgtttctcctaaaaaatacaaaaagtagccgagcgtggtggtgggcgcctgtaatcccagctgcttgggaggctgaggcagagaattgcttgaacctgggag

SEQ ID NO: 94486 - DNA, 1214 bp, Homo sapiens
taatacgtagtgttttttattaactgatatatatttggaagctgccagtacattggttcgttttccttttttttaaaaggaaaccatgtttaaaccacttttcttaacatgagaataaaagaagtatgctaattcctttttaggtcttaggtttgtctgctcctagtaaagattaaatagaatggagcattttatattacctatttcaaaagattagtcagattaaagaaatattttatatttatactttatattgaagttgtccataattatgtattaacacatggttgtttttctagtggtttgtttaatatgtcctttatggtagtaggctaaggatggtgaatgactagcagatagttgttttgtacctatttaacatataaactatttgtgcctatttctgtaaataaagtttattataaaagtgattctaagtaactcgtcacattgggaaaattatttttattttattaaaatgacttaaaatattgtaattgataaagtttattttaaaaagtgtttctaagtaactgttgtgaagtttggaaaattatttccattctgtgtaaatcatttcaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtgagttttaaatatttcaaaacttctttaacaatttatggtagttttctgatatgttttcagtgtttagttttctaaaaacttgccacaaaagttggaaatgaggcagacaaaatttttaaatgaagataactttcaacagacagtgtaaatcagttcttaaacatacggatcttttaactcttgagaatttgaatcctttccttggagaaatgaacacagttttgcagacaactttaggagatttatagacaacatttcaactcttatcttctctattcattcaagagctgttcattgaatatcttctacagtgtagccttatatgtgccattagaagttacctgcatgctctgcttgtttcacctcctattgggaggaccacacacacttctttttatccttttatcaagttaatggttggaagtcattaaaccagtccccagtacctgttttttggtcttcagatattgttagg

SEQ ID NO: 94487 - DNA, 1058 bp, Homo sapiens
gaaagaaatagaagcaaccatttaaaactaacttagtagatttactacctgttcttttgtttttgttatatgttcattgaagaacctataattttcttatttttatctgacacttagaatgttcccctttttatttgcaggagagtgaatgcaaagcatataatcctagacctttctgtaaaacatacaccatggataagcagcctctgaatactggggaacagaaagatatgacagagttttttactgatctaattaccaaaatcgaagaaatgtctcccgaactggttagtatcagaatactgaaaagtttctttgaaatttgaacaaatttgcctgcgttttaactagtttcttattttttgtttgttttatattaaagaaaaataccgtcaaaagtttatttggaggtgtaattacaaacaatgttgtatccttggtaagtattatacctggtttttactttttggagatcttaatatattttcatttatattataatttactagtttttattaattttttatgtgtattgattaggattgtgaacatgttagtcaaactgctgaagagttttatactgtgaggtgccaagtggctgatatgaagaacatttatgtgagtaataatgcacataatttttttactttatgcttttacctatttgtgtatagcgggtttgtgttggtcatcttgatatttttaaacttttttcatgtttttatgtattttcttcttactgtactattcaaataagagttaaacatcaaccataaagctttttcttgcccaatcaaaatttaaatttttaattaacccttcaaaaaagttactaagattcatagaatatcttaatatgaggaaaaacagttttttactaaaatttaagaattcacttttaaaaaaaaaatttttttgctgagcattctgtcaaaattgtaattgccaccttttgtatatttgcatgctataaacaataatatgaaacttttaaatgtggttttatacacaggaatctcttgatgaagttactataaaagacactttggaaggtgata

SEQ ID NO: 94488 - DNA, 1053 bp, Homo sapiens
aaaacctaaaaaagttaaatggagctcgtttgaactggctttgtcataactatgtacctttctttttcttacttttttatttatttatttatttattttgagacagagtcttgctctgttactcaggctggagtgcagtggtgtgatctcaattcactgcaacctccacctcccaggttcaagtgattctcctccctcaaccttccaagtagctgggactacaggcgcacaccaccacgcctggctaaattttgtatttttagtagagacagctttcaccatgttggccaggctggtctcgaactcctgatctcaagtgatctgcctgcctcagcctcccaaagtgttgggattacaggtgtgagccaccgtgcccggagctgtctgtcagttatctctgttatttgtcataataacttctaaaagttatctcagttgtctacattctgttaatttgtcctttgaagaatctgttgtgtctcatccttcttctgtcacaaggtcctccccttttatgcttgcagctttctagctgatttatcttagtatcccttaattacaatgcctaaaactataaaagtgatcaatcttttaaaaagatagtaaatcttacaatattattcccctgcttaaaactcttgagtgcttcttcattacgaacagaatggtattcgagctcatcaccatggcacacaccctctgggttttttccccctacccttcaacctcctatcttatccctctccatttggagcccatcaccctgctgcttcattgcttgtgggtttatttatgccattgtttcctacctgtgtcactcttctccattttcttctgatgttcatttttcaagagtcagcttggtttcaaactctaagagaccatctattccacagattaaccggagtattccaagtcaccatgcctctttgttgtttctgccttgtatatatgttacttttctcacctgttaaatcttgaggacagggattgtgtcatacttctttgtgtatttttgactatttttattttttgaggcagggtctcactctg

SEQ ID NO: 94489 - DNA, 1008 bp, Homo sapiens
gttacatatgtatacatgtgccatgttggtgtgctgtacccattaaatcgtcattgacttattttattatcaacattccattgattgtttttttgtagaatgatcagtgatgtttaagactcatttggttaattgacataatgtataagtaaagagtaggtgtattacgtttataacttattgaatttgggagaactaaattattgttacctataaggaaatgattttaataattttatgtttggtaaaacataaaaaatttatatttgaatttttattttctttttgtattaagacaacgctcctcgacttagatgccttggcaagacatttggctgactgtattcgaaggtaaaatttgatgtgaaattgacatttatattgtcgaggaaagataaaagacataattatgtgaactatcttgcttgtgtgtattttttttcttttttgtagtagggagatccttgatcatcaggatggtaatgtagaagatgatgggcttacaggactcctaaggcttgcaacaagtgttgttaaacacaaaccaccctttaaattttcaagggaaggacaggtaagtgttaagataatcaaatgtttctatgaaatgtgattgaaattttttgttgttacattgtgtattagtccgtttttacactgctcataaaggcatacccgagactgggcagtttacaaaagaaaagggtttaattcgactcagagttccatgtggctggggaggcctcacaatcgtgccggaaggcaagtccgggcaagtccgagcaagtcgcatcttatgtggatggcggcaggcaaaaaaagaatgagaaccaagcgaaagcggtttctccttataaaaccatcagatctcaagagacttattcacttatcacaagaacagtatgggggaaaccgccgccatgattcagtcatctcccaccaggtccctcccacaacaatgggaattataggcaatataattcaagatgagatttgggtggagacacg

SEQ ID NO: 94490 - DNA, 1034 bp, Homo sapiens
gagctctcttctctagtaagtcacagttttctttttatctttatgatattcagaattttaaattttatttcctaccctagttcatatactagtctttaaaaggcttctaatacataataaatttagagcccactttttactaaccccagaaattcagtgtgttgttggatttacattattttcctccctgttcatatcttttttaatgtcagtaatttgagactaatattttcctaaaagttcttacgtttgtcatttttttgcctggttattctgattttacagaaactaagcgtgtactccatttttaaaaagattttgaatactgtttagtggatataggaatttatttcataaagcctctagtttcttaaatgtattataattttatttatttttaaaatgttttcacaaagtataaaatttttttaatagatagatgattatgaggaagaaccaatattaaaaccaggatgtaaagagtatttttggttgttatgcaaattagttgacaacatacatataaaggacgctagtcaggtatgttcagaaaattatatactattctatgtattctcttcttgttaatatgaattatgacatatgttcatgactttattggttattaagtgtacttcattaatctataacttggtggtggtgtcctatttctactatatttgtgcttttccaccttcttctaattcctttcgtgtttttactcagaccttagttgaaacgtcttcatctggtatctatccataatttcctgtctcttctcagtaagatacgtggatgtaacatcttatttggaaagggaaatgtagattttaaatttaaaaatacagctttctataatagcatgtagtttggagtcccaaatacgtaaaataaaattgcagttcagatagaagttactttaaagaaacactgtcagtttttgcatatctaattttcttatactggactaaaatgacatttccattcaaacaaagtaatgtttaaaacaagtaaatttcaggccaggtgcagtg

SEQ ID NO: 94491 - DNA, 1050 bp, Homo sapiens
tgcagtgagccatgatcatgccactgcactccagcctgggcaacagagtgagaccctgtctcctgtcttttaaaacacacacacactcacactctctctcactctcactctcactctcactcacacacccactgctttccttttttgggggggaagtgataaccttaaaggatatatgttaataaattgaattatttttaattcattgctgaatttaattggtggtggtggtgtttttactttacagagttttaaaagctcagtctgatcacaggtctagacatgaaggtaagggttccacaaagttaacttttaataaataaaaacttgaataatatattgatatattttacctttaatattgaacattgtgttttcattttagcacaaaccttttatagtgaactgttttctaatttttctttagtttcacattattcaatgtggctcttggtgagttgggctcattgctgttctttagtgaaatctagccttgctgatagcgatcatttacaagattggctaaagaaattgactctccttattcctgaggtaagataaagattgaaggttagtactgttattttttgtatgttttcatgttattagcattgataataaaagagctaatggaaacaaatatgcgtgagtccataaatatatcacattatctgcttaatcctttaaggtctagagtgttttgaactatgtacaatgtttaagaacttctgactattatatattatgtagcatttatatttttctgaaatgtttatagaatgattattttgctttggattaataaaaaaaagtttttccaggtagtaggaagggcttgagaatttattttggtaatttatgttttagaaaagttctgtggccttttttttttctttctttgagacagaatctccctgttccctgtatcacccaggctagagtgtagtggtgcaatcaaggctccctgcagcctcaacctcctgggaacaagcgatcctctggcttcagcctcccaagtagctgggaccataggtgcacatcaccatgccc

SEQ ID NO: 94492 - DNA, 1061 bp, Homo sapiens
tactgtgacttaacctgacagctgaactgacggcattgttttaaagcagtagtgattatgaagcagtattgcttttcatttcatcatccagaatgcagaaatgagtcgtgccattttaatatctgtgagactgaatttattatttgaactcagtaatttatatactttggggatgcatttatgaaaacagaagccatagttggtatttcaacataggaaatttaaaatagagaatcagttttacacgtatgtgttacaaggctttaaaaacaaaagggagtggtgaggtaagccagataaggagccatttatcacccctagatcttgtggaacattagggaagtggttgggttatcaggaacttagaagcttgcaggagggatcctgttaaaccggggtttaggcctctgagaaagcagttacgctcttatgctcatctgctataagattatcagaggggacctgataaagctggtgctaggagtgcctaaaaaagctgaaggctgaaacaaactctgtcttctaggtaaatacttttagataaatgctgacagaagaaagaaaggaggagtctctcaagtatcctagactggcagaacctaataggaagccacctggcaaaggaggaatttggtttttgatatatttgccctagcataatagaacaagtgtataaaagggtggatttggagatgaaagaaaatatggttggcccttgaaaaatagaggagttaaggatgctgaccctccatacagtcaaaaatctgtatataacttttgactcccctagaacttaactactgatagcctgctattaaccagaagccttaccaataacaaacagttggtgaatgcatattttgtatgttaatactattatatactgtattcttaaagtaagctagagaaaagaaagtgttaagaaaatcataagagaaaatatatttactgttcttcaagtggaaatgggtcatcataaaggtcttcatcctcatggtcttcacattgatcaggaagtagaagaggaggaggaaggtgaggggttggccttgctgccttag

SEQ ID NO: 94493 - DNA, 1203 bp, Homo sapiens
gtatatgaattttattgggtttattttcagaaaatttaatgcataattgatgttttaagcataccatttgtgccagttatatacctagtcttcatatgttttaatatgtttcaaagtatatataatattttgagtttttatgtagtgtcagtttgtttaaagtttttcttttttgtgttccctgagtaagttggcttgagaaacatgtttttctaatttaagagtaatgatggatttaattggaaagaacttctcaaaattaagagcgcccacaagctattgtatgctctggaaattattgaagcactgggaaaacctaatagaagaataaggagggagtctacggtaattgcatttccattattatcattaaatgtttgtattctctctggagcaaaattctataatgtattgtcttttccattctataataattctttcttccgccattctgccttactttttttgcctttctcatagggaagttacagtgatctttatccagattcagatgattcaagtgaagatcaagtggaaaatagtaaaaattcctggagttgcaaggtttgatcatatgtgtttttcaatgtattgataaaaataatttatcttcagtttttcaaaagtgggtaccataattcttcattgattttaaactaatatactattaaaataaagcatagtttaaaaatcatgtattactttaagttgcaataacgtaaactgagattatttaatgccttggtgctcctgcttttagctctgattttccctctattgaaatactgtgagagtcctggcatggtggctcacgcctgtgatccagccctttgggaggctgagacggatggatcacttgaggtcaggagtttgagatcagcctggccaacatggtaaaacccgtgtctctactaaaaatgcaaaaatgagctgggtgtggtagcatgctgcccataatcccagctacccaggtggctgaggcaggagaatcacttgaacccaggaggtggaggttgcagtgagctgagatcgcaccacagcactccagcctgggcagcaaaaaaaagatactgtgaggacatcccagtgtctaggactaaatggctaatggaatagaaagatgtttataggctttttcgtgtgtgtgtgtataaattttttttttttgaaatggagtctcgctctgtcacccaggctggattg

SEQ ID NO: 94494 - DNA, 1090 bp, Homo sapiens
gtgagctgagatcgtgccattgcactccagcctgggctacaagagcgaaactccatctcaaaaaaaaaataaagattttcttgccaccaaagtgcaccatgtttctgccattataccaaaagaactaagtttctttttataggcttatagaatatccctagaccatgttataccaaagaatcactgtgatagtagcagtagtaataaatttatactccgtggaaaataccaaaactgtcaattttagtttttactctttttacctctcagggtggtactttaaatttttgtttaattgcctatttcctaagtggtttttgaaacgttgtttagcttactcttgccttagcaagttttggaacttagcaagatttaacaaatgataatggaaaaaaataggtctctaaaattgtttgctttcttcttaacgtctgttcatctgagactggaaaatgaggtttagattagcaacataagagaaacaggctcttttcctaaatggaagttcaaggatttaattcacccagtctttattgtgcttagaatagtgacctgcaaaatggaaatagatgattgtcatattgaaatttgttagaattttctggcctttaaacagatgttttcacttttatttgaaaagtttcatgaggaacatgatcagtcttagaggaaagcttttctagaaaaatgttcagtaagaagttgaaaaaacactgcttggctattaattttctcaaatatgtatcatataacaaatgtttcatttctcacttttcaaaaagtgaggctaaaaactattagcaaatttgatcattactttatgcaaaaatttgaacttaaaactttttcttttctgatctgttttgataaagtagttgttcttatttgtgtagagcttacgatgtgaagaacttcatcttcatgcagaaaatctgtctaggcgggtctgggagctactgatgcttcttcctacatgtcctaatatgttgatggcattccagaatatctcagatgagcaggtgagcccacaaaatctctttactctcctagaggctgttaccagtttacattcctattgacagtgtagaag

SEQ ID NO: 94495 - DNA, 1047 bp, Homo sapiens
atcccttcccagataacaaatatgaggtgttaacaagtgctttaaagaaagataaaggagagtaaagggttaatggtgaagtgaagcttttagattgggcggtaaggaaaaagctcccattggatgagagacttgaaagaggtgagaaaataagtatcttgaattcctggagagaaatcttagtccttgagttggtaatatacttgttattttcaagaaagggcaaggaggccagttggctgaacatagtgtgagatagggaagatggtgggaaatgaagttgaaggtgtaggcagctaaaaggacttaatgcattctagaaataactatcctcaatctactgagttttctgtctttaccttagattacatttaaacttaacatacagtgtgtttaattgctacaactacatattcttatcagcaagtaagttaattcttaaaaacaaattcatttccatgttttgctgtttttaaggaggcctcatgggacctgtcaggatgatttcatctggacacgagttaacaacagattatgatgaaaaagcacttcatgagcttggttttaaggatatgcaggtacatatataaaacgtggtttgagttttaatgatctgtttataatcatcagttgaatagtcgcagatgtagtttaaaaacagctcttattgctttgttatattaaaattttaagtgattctatacttcagatttaccgttttattaaactaaaagcttgatatgcataaattttttttcctgttttttatagatggtatttgtatctttgggtgcaccaaggagagagcggaaaggggaaggtgttcagctgccagcatcttgcctcccaccccctcagaaggacaacattccaatgcttttgcttttacaagagcctcatttaactactctttttgatttattagagatgcttgcatcatttaaaccaccctcaggaaaagtggcagtggatgatagtgaggtgactatgtttcattttcacaaatcttgttttgtgtctctgttgagaggatatagtaactttaat

SEQ ID NO: 94496 - DNA, 2521 bp, Homo sapiens
aacttcttactgccttataactttaaccacttaaaaaaataaaattttaaaaagagcaaatgtggtgtaacttattcaaattaattaatacgtattataaaattcagatattacactgtgatgtagaaaatgaaagtctgctataatttctgtcttcctcgtggagatactgttaatgatacccatacttctaaaattttttctatgctgtgggatcttcaacaaaccaacaaggtcctgttgattcacacccttagtccttgcacagcattaccaatgtctaaaataagtgcttattttaagtctttaaaaatgtatttgttttttgagcattcagtggtggttttataaatttaatgaatttaagtccaaaaattccttctcagatgtacaaatttttttctgttgtgaaaaaaaaaattgttatgtccttgatatctttttatttgttcatgttttatgctaaaagttaatgttgatgttaaatagtttatataaaaattttttgttactagtacaataactaggatatggataaaattgaagagtcacaaaactaagcagtagtttaaaaaaaatttacttaggtatttttcatgcaaaattttgttcttgatgtgcttagtgctattattaattgaaaattgcctaacatctgtagattgaaaatataattgttctttgtgttctgtgtattaagggaataaacaataatgtcttaatttgtttactttttaaaaagagataaagttataatcttaaacagtggttctcagccagaagtgtttttgtttcccaagacatagtacgtaatccctggagacacttctgataatcacagcaagagagcatgttattggtatctggtgagatgctgctgaacatcagagcatgagatacagcctccttcacccctattcttctgccttctgataacaacaaattattaattgggcttaaaatgtcagtagtgccactgtggagaaactctggtcttgaatatgtaacaggaaacattgttttaaggttactcttttgctcatacattggatcatgtggaaattagacaagttcattcattccctcactttttatccttctattccaaatttgctgattagttttagacttttttttttttttttaaactcaggtaccttggatcctgtcttccacatctgaaaattagaaaattgacacgtgtttagtgattatcatgctaggtgcctgtttcctttgaaatacaagtctttgtaattcactttataattttaacagccatgaattgactctcaaattctattaggctcgttagtatatatttaccagaatgtttctgtccctgaaaattttttcttaatatcttttttccttctgaatgcaggaatcacagcttgctatttcatttgctggattagttttttttttttaattcctcctatctctcctattaatatttctactctctttattaaaaaaataataaactggccttaaggagattttttttttcctcagtaatttctcgtggtgactattttgttaggagctcttagctgttattatgcagttacgtttgattcagtatgatgaatctgaacttaaatttgttgctgtagaatacattggaatgaacttagaacttcttttggacttttccagtctgtaagatgataaaaatttgcgtaacattaaaatggtttaaaatggtatcctttctatgtgttgtttgtgtcatgttttaggtttgcatatcatctgagacagtggcaaattgaaggcactggtattagtagtcatttgaaagcactgagtgacaaacagtctctgccgctaagggttgtatgccagccagctggacttcctgacaaggtacttacatagttttaatttcgaagttgataacatttcccaggtcaaatatctgttctttttgtatttttaaattggttgcatctcatatttcagatgactattgaaatgtatcctagtgaccaggtagcagatcttagggctgaagtaactcattggtatgaaaatttacagaaagaacaaataaatcaacaagctcagcttcaggagtttggtcaaagcaaccgaaaaggagagtttcctggtaagcctttcaattcaaattttctctttctctttctctctttctttctttttctctttctctttctcttttctcctttccttttcttttattctccttttcttttctttcttggttatatcatatagcaactgtcttggtttgtcttgtgttgctgtaacaatactacagactaggtaaagaacagaatttgggaagtccaagatcagggtaccagcatctggtgagggctcctctctgctttcaaagtggcaccttgaatgctgcctcctcacaggcagagggtggaagggtaaaaaatgaacagactccctccatcagacccttttataatggcattaattcattcatggcctctccaaagaccccacatctaaaacctgttgcattggagattaatgttca

SEQ ID NO: 94497 - DNA, 1598 bp, Homo sapiens
tcccagctacttaggaggctaaggcatgagaatccttggaaacctgggaggcagaggttgcagtgagccaagattgcgccactgcactccagcctgggcaagtgagtgagactctgttctcaaaaaaaaaaaaaaattgggtgagaacttgagttagcatatgttgttaattttctgtgaatacaagaaagcagtggttttctcagtttaggttggatggattcattgaagcattgtgctcgttattgtgttggttttattcctttatagtatgtttttcaggactagaattttcgtactatgtagtcacaacttgtgagttaaacatgtatatattgttatctgctgtataaatattttttagaactagtacaggtgtatttcatcaattgaggaaatttttaaatcatttatttttattatttaatagctgaataataggagttgcctatgatttttacttttgatacttcagtcttaatgagttacatagtttgacaaacaaaatttagagataccatatttttctttcttagctgtgtggtatggaccaattttggggcattgctttaagagcacaatctggtgatgtcagtcgagcagctatccagtatattaactcctattatattaatggtaagtgatttgaaacattgtctgataggtaatttctatgtgagggtgttttgtgaaactaaaatttttctttgatatagctaaacaagaatataaggctaatatatgtgtctaaacatttggctttcaggtaaaacaggtttggagaaggagcaagaatttattagtaagtgcatggagagtcttatgatagcttctagcagtcttgaacaggaatcacactcaagtctcatggttatagaaagaggactccttatgctgaagacacatctggaagcgtttaggagaaggtaatttttaaaatatcacactgttagaatgaatttcatttttattcctgacatatccagaaatattcttaaagtgaatctaaagtttttgttggggtcaagtagaaagcataatttaccaaagtgaaggatcagtaacataagtaatttttattaagaatatataccattttgccttggaataggcaatacgggttcctgataaatattgcacacctttaataatagagtttgagcagatatgcatgaataagaattgttagacagaattccatctctaagataaagtattgactttgattaaaaaggcagaacaccactactaaaaaaagtttctctaaaactcttaccaagaacatcaaataatctcatagttgaatcaagttgagtcatatgtttcatttgctgttttttttttcttcctggactaggagacagtattttaattttgaatttccatttaccatggaaacatgaccaaaaaattctgttaatgaatatctgtataattaatttagacataacctgtgtaatacagaaataaagcaaattaatatttatgaatatatcgactgaaatgaaaggtgagtagatagttttaagaaattctatttgttaaaaattatgagcaaatgtaaaagtactaagaactgtgttgaaaaaaattgttaa

SEQ ID NO: 94498 - DNA, 1807 bp, Homo sapiens
acaaaaactgtacttgtagctatacctctcataagtttgtttagtataggtatacaatgcatgatagttgtctttatttatgtcctctgatttgggtctatgtacatcttcaaaattgaagcctgtatcagacacatttcagttattacctgaataaaatgttcattaaatcacatatatattttcatttttttttttttttttgagatgggcttgctctgtctccaaggctggagtgcagtagtgtgatcacgtctcactgtagccttgacctcccaggctcaagcaattctcccactacagcctcccgagtagttgggactacagccacacaccaccatgcccggctgatttttgtagttttcatagagatgagatttcgccatgttgcccaggctggtctcaaaactcctgagctcaagcgatctgcctgccttggctttccaaagtactgagccaccgtgcccagcaaaattattatatatttttattttttaaaattatcactaaaaattcaaactgatctgtttccttctacagtgttttcagtaaagtttatttaaatttaataaaatctgtgaattaccacactaaattagctttgtgtttccccctacccttccaaagatgccccagctaaaacctgaaacaattagcatgactggcttaaacctgtttcagcatctctgtaacttggctcgattggctaccagtgcctatgatggttgttcaaattctgaggtatggatttagacttactttattaggcaactttattcctcaaattagattatcaaattcggtttccaaattatttttctacaaagtatagaatttactacctgtgcagtgcagttgggtttgttttgagatggagtctatctctgttgctcaggctgtagtgcagtggtgtgatctcagctcactgcaacctccacctcccagattcaagagattctctagcctcagcccccgaagtagctgggattacagacatttgccaccatgcctggctaatttttgtatttttggtagagacagggttttaccatgttactcaggctggtcttgcactcctgaccttaagtgatctgcctgccttggcctcccaaagtgctgggattacaggcatgagccaacgtgctcagcccaattctgttctctggtttcaaaagttttatgaagcaaatttatttttcagtatgaaagataacattgggtgtgcttaatgaaaatctattacatgtttcttgatttataaagaagtggccatgtcagtgttctttgagtctcctagacattcctagataatacagccaaatattttacttcaaataaaagattgatttgtctcagatatgatttttatgccatttggttcagcctgggcaacaaagcaagactccatctgaagaaaaaagaatacttgtatctcttagcaagtttggggaaatttttttaaaaaggaaaaagaattatttttaaaaatttttattattattattttttgagatggagtctggctctgtcacccaggccagagtgcagtggtgtgatctcagctcactgcaaccgccacctcccgggttctagcaattctcatgcctcagcttcccgaagtatctgggattacaggggtgcaccaccatgcctgactaatttttgtatttttagtataggtggggtttcaccatgttggcggggctggtctcgagctcctgacgtcaggtgatccacccgccttggcctcccgaactgctgggattacaggcatgagccactgcaccaggccattatgattattttt

SEQ ID NO: 94499 - DNA, 1104 bp, Homo sapiens
cctggctggagtgcagtggccgatcttgtatcactgcaaccttcacctcccaggttcaagcaattctcctgtctcagcctcctgagtaactgagattacaggcacacgccaccatgcccagctaattttttgtattttaatagaggcagcgtttcaccatgttggccaggctggtctggatctcccaagctcaggcagtccacccacctcggcctcccaaagtgctaggattacagatgggagccacttcacctggctgctgtgattcttttttttttttttaatcataaatatgctgtaggaacataactcttatttatatcaattaacatatggtaaagttagtttcattatgcatcatttcaattaaaattgcaatttccaagaacctatctgtgttaagtgaggacttactgtacatacacatgcctaagagaagtttaatttttttgtatgtagttaataaagtataaaatttataatttttatctagggttaagtttagagcaagttgacatcttatggcattgtttagtagaagattctgaatgttatgatgatgcactccattggtttttaaatcaagttcgaagtaaagatcaacatgctatgggtatggaaacctacaaacatcttttcctggagaaggtaattacatttctctcagtttgttattatttttccatgttccctttttcatctcttgaaatacgaattctgtaatgcctttttttttttgacagtttttttaagtagccaaatgtaatgaattttagcagtcctaatataatttttggtcagattgtgctctaattttgttgtttacactgtttacctctaaattaatagtttatatttataaaaatgttctattagctacaataattcaacaattacaataacttttgaaggcagcactaattttcttagtgtttgtttttttgaaataatcagtaatattgtagtccaattttcaggggtggtgcccacacccacaagtgtgagagctgttttctgtgactcttcatgatttaaataactgtcattgcagtcagtcttttgggcaaagataagccattctccagatgtgtagattgtgggaag

SEQ ID NO: 94500 - DNA, 1008 bp, Homo sapiens
tagctggtattataggcatgcgccaccacgcctagctaattttttgtatttttagtagagatggggtttcttcatgttggtcaggctggtctcgaactcccgacctcaggtgatccacccacctcggcctcccaaagtgatgggattacaggtgtgagccaccgtgcccggcctccttttttcatattttacaaaaataatgcttacttatttatctcctatatacagagaatgacctttgaacatggtatacactctatttataatactcaaaccttaaccactgattcctcaatttttaggattacctcccccaatcatttttactattatacggatgtgctcctattttagggagaagaattttcttcctaaatgggttctttgagaatacttcgtaagttgtgtatttttaggtgatttacatatgggttatcttaaactacattttaaaaacataaattatgtgaaaattcgtattaaatacttgtaaaaggctgtaagatatctcctttgtgtttctggctatattggtgtttctggtacattcatttagggccaaaatgttgtatgaatgtgattttaaattttacaaataggatgacataagaaatacttattgagatagttttgttttgttttttgttttgagacggagtcttactctgtcaccaggctggagagcagtggcgcaaatcttggctcactgcaacctccacctcccaggttcaagcaattctcttgcctcagcctcccgagcagctgggactacaggcatgtgccaccacacccagctaatttttgtatttttagtagagacagggtttcaccatgttggccaggatggtcttgatctcctgacctcatgatctgcctgcctcagcctcccaaagtgctgggattacaggcatgagccactgcgcctggccatttttttgtttttttttttaaagagacagtctcgctctgtcatccaggctgaagtgcatgatcatagttcagggcagc

SEQ ID NO: 94501 - DNA, 1029 bp, Homo sapiens
ttcaaaaatacaaattttgtatcagctctacttttcatgaactagatttatggaaatattattttattagtgtttcttgggtacagaatatattatcactaaagggactatgatatgaagtatgtactttttagatagagatggtgttttttacttgttgcctattctaacttatgtgtgtgttacatacttttaaaatgacatacttcctctgcttcactgttgaatttttgtgtgctttcttatgtaatttgaaagtaaactttgttgtagttttgagatttgtgtaatttattaaatagtataaatttttttgttttgcctttatgaacttctttcgtgtaaccaaagatacttagttaaaataattatgaattattaaaacaatttttggtataagttatgcataggaccactaaatttttaaaagtaattaagaaataggatatttaattattttaatgacttttaaattataggtacagccatagtgctgaagttcaagttcgtcttcaattcttgacttgtgtattttcaactctgggatcacctgatcatttcagtaagttttttaatcagtactttttaaaaatctgttttgactattggaagaactaaatttacttttgcttctgatttctgcagtttttttttttttttagtttaatttaattttagagtcagtgggcacatgtatgtttgttacagggtattgtaacaaatccctaccagtattgcgtactggtagggattgggcttcttgtgtacccattactcaaatagtgaacattgtacccgatagtttatttttcatcccttatcctgttcctgccatatccccttttggagactccagtgtctgttagtttcatctgtatgtccatgtgtacccattgtttagctcctgcttacaagcaagaatgtacggtatttggttttctgtttctgagttagttcacttagaataatggccttcagttccatttatgttgctgcaaaggacatgatttcattcttttttcatggctg

SEQ ID NO: 94502 - DNA, 1079 bp, Homo sapiens
aaaaaattttgttcaaaaatataagcaaattaatgacaaaagatatatgcagtaagtttattgtatgccttctgtatgccagatattgtgctaagtaatgaccaaagcacatagtatattcttatatgaaagggtatcatattacttttaatattaactcaaattagtcattgataatagtactttcacaggcattttgagattaaaaacttacaaaggtactttaaattcataaaaatgaaggaacattgctttatatcttttcaccattcaaatataaataaaacgtgtatatttttcgtaactaaaattttacatttgaagattttttttagatttgcatatttactgtcatagcatagatttattctcttaccctgcccactttaaaattattttttcttttatttgggccaggtgggcagaaaaagaactgaacatgatgaagcttttctttgataatttggtatactacattcaaactgtgagagaaggaagacaaaaacatgcactgtaagtacctctcaactgggttaaatacatttgtgtcgatgtctttcctttgaaagatgattttccagtgttttaactttttttcatataataagtaattgtaacagaaaactttatttgtataaaattatgaaaaggctgctagaactttttaagctgaaagattcttaggaggttactcttaaattcttaggtaaatgtagctggctcacttttgggggttggttaaccttcactattgagatttgttcaaagataactgtttttaaggaatcaaaagtaaatacattttttcagaaaccatagatatgcttgttttaacagtttagagcattgattctaaaatttgtaaatatttacttcaaaaataattaacagttaatttaaaacattttattataattgcatactagtattagaaagtttaggacgtgtggaaggttttaaaactggtggtatatcattaatattttctcattacatcaaaatattctctggatatattcaagtgatttgggacaagaattggtagaaatggattggtggtggtatagctgtatttgaag

SEQ ID NO: 94503 - DNA, 1851 bp, Homo sapiens
tttttggtttgattctacagttgtaaaaaaccacactttttatggtttcacattttatagactttgagtataaaataatatgtaaacagtgagtattagtgatcttgcctaaaattgttctttgaatttgttttaatgaggtgtcttaataggcctggtaatatgactgtatattgtaaaattatttaataattctgacagtgtgaagttttcagtttcgtaaagctctcaacattccatattgttaataagcagatgtcggtttgtttctaagtgtatttgtaagtttaagagaggtattttttgtggttcacaaattagattcacattcgtaattactaactttgtgcttttctctgttttgtaggcatatggttgatgatatgctaagtgcagatgatgtcagttgtagtagctcccaggttagtgcaaaatcagaaaaaaatatggctgattttgatggtgaagaatctggatgtgaagaggagctagttcagattaattcacatgcggaactgacatctcacctccaacaacatcttcccaatttagcttccatttaccatgaacatcttagtcaaggtaagactctacagtaagtaaaatatattaccttcttcacaacaggaataatttatcttactttgttgaaaggactcaatagttaaggttatggtacttaaatgtttttgtcaaaataacttacatatggtagtttttttttttcccccaagggaattaaattattataaatagtccatcatgaatataaataagtcctgcagttctattgagatattcagcggggaaagaaaatatatagcaataatatgtaataattaaagctctatattttagaaaatatatggttgtattagaatttatactcagaaatcctaggacctaaaagtataggaaatcacaaaagataaaattgtatgattccatttatatgatatgtctagaataggcaaatctgcaggcagaaggttagtggttgcttggggttagggaagggtaggagggaataaggaggggcgagtgtgagaaatgattgttcaagtctaaatcactcttaaagtaataggacatgaccagacttgaaagaatggaggatggaggaaggtaaagagtagtagggaattaatgagtaaagcaagaaaaaataagaaagtgaaaaacagttttagaattggcagtttaaaggccttaaacctcttgtttggttggtatcatcaacatatgctggcctagtaaatgggttttggatagccagtacattataagtaaaccggatggattacgtttatgcaaagaggccataaacacacttagaaacacaacttgtggaccttggcaacaatttactgatttgtatgtgttttttgtacatgatctgtctaggttaagttactttgacttattttattgttgtgctgttgtggttgttgagaaaggaataggttagattgaggtcatctgactgaatgtgatgccatatttgtaaattgttaccattcttttctcaaattttcctttaatcaatattttacctattttttactgcgtggagttagaaattgaacaaaatggttttcttttcacaacccattgtagacagaataaaatgatagtatatgttaatgctttccaaatctaccttgttttacaatgtttttagtactagaagacctcctccaacagagtaagacagtcagtttaaaaatgggcaaaagtgttgatcagatactacataaaagatgatacatagaaatggtcaataagggctgggcatggtggctcacacctataatcccagcactttggaaggctgaggtgggcagatcactt

SEQ ID NO: 94504 - DNA, 1271 bp, Homo sapiens
ttgaattgggtatatatacataattcatgtttgggcttgtcctctcctttacgtaatatttttgacatcctttgagtttttaattccattttgtattgttcaaaggagtataacaagactggcagcctttttaaaaagtacagtttattaatgttggttaccttttttcttactggtttaaatatttatttaaatctatttgtttcaaaatacaggaatccatgcagggaagttctgacgaaactgccaacagtggtgaagatggaagcagtggtcctggtagcagtagtgggcatagtgatggatctagcaatgaggttaattctagccacgcaagccagtcagctgggagccctggcagtgaggtacagtcagaagacattgcagatattgaagccctcaaagaggaagatgaagacgatgatcatggtcataatcctcccaaaagcagttgtggtacagatcttcggaatagaaagttagagagtcaagcaggcatttgcctgggggactcccaaggcatgtcagaaagaaatgggacaagcagcggaacaggaaaggacctggtttttaacactgaatcattgccatcagtagataatcgaatgcgaatgctggatgcttgttcacactctgaagacccagaacatgatatttcaggggaaatgaatgctactcatatagcacaagggtctcaggagtcttgtatcacacgaactggggacttccttggggagactattgggaatgaattatttaattgtcgacaatttattggtccacagcatcaccaccaccaccaccaccatcaccaccaccacgatgggtaagcctacttcaaaataaatattcagttcatatttcctttagggaagtattatatcctatattcaatttgcaatttattctgtattagtgctattcattagtagtatagtgcaaactataaatgtaagctacaaatagataatttcaagttttctattgggcacatttaaaaacacaaaatgaagcaggttgttggccatgcacagtggctcacacctataatcccagcactttgggaggccgaggcaggtggatcacttgaggtcaggagtttgagaccagcctgaacaacatggtgaaaccccatctctactaaaaatagaaaaattagccgggcatggtggtgcacgcctgtaatcccagctacttgggaggctgaggcaggagaatcacttgaacctgggaggtggaggttgcagtgagctgagatcacaccactgcac

SEQ ID NO: 94505 - DNA, 2021 bp, Homo sapiens
tttttactgttttatgcactgccattcatcatcttagataattagcattttaccgtcatattaaaaaatattagtgtactggccaactttttgactttcaaactgtttttatatcaggtaatctacatgtattgggcaattatttttgaccattctctctaacttgattttctagttgaaacattgtagtcggtatatacatgacttatttccttcactcatcaagaatttggatcccgtaccacttagacatctacttaatctggtctcagctcttgagccaagtgttcatactgaacaggtaatacattcaaaacatgatagttttttttttttcccgtgaagtgaaaatttccttgtgattcagataatttaactttcattttattgtcttggcatttcagtttgacaaaaaggatattaaatttgttagtgttgcctggaattctcaaactgaaatctctccctcttttttttagacactgtacttggcatccatgttaattaaagcactgtggaataacgcactagcagctaaggctcagttatctaaacagagttcttttgcatctttattaaatactaatattcccattggaaataagaaaggttagtaatgtcatgtattttgaagtaaattgttgagagcttctcactcagatttgaaatattttctgctaatacattcagttcaatctttattttaaaataagtgtgggatgggtagaagagtgcatataaaaggattaatactgtgattagttcgtgttttggtttaccttttaagtgaaggatagtgatgaagtctttgtagttactggattttctcagctttggttatcttttttttttaaacaaaagctttggagatttcattttgtaaacaaacaagttttgtttcagaaataattttaagagtagaacataatgattcagttatcttgttgtgttttctgcttcaaagttttctgccatgtcaggtgctttgtggggtttttttgttgttgttgttgttgttgttgttttttgagacggagcctcggtctgtcacccaagctggagtgcagtggtgctatcttggctcaatgcaagctgcgtctcccgggttcacgtcattctcctgcctcagcctcccgagtagctgggactacaggtgcccgccaccacgcccagctaatttttttgtatttttagtagagacggggtttcaccgtgttagccaggatggtctcgatctcctgatcttgtcatccatccgccttggcctcctaaaatgctggggttacaggcgtgacccactgcatctggccagtgggtattttttttaacatacatagctttcaagggctttctgaaacattagttgaactcagtttttgtctcctgacaacatatactacccctctcttaggcttttctgtgcaggcacccccaacaactactgtaggtggtggggacttaaccttattgcaggtttctccacttacatcttgttgattatgtaatatgaacaactgatacgctgtctcaaagaagctgagtcacttagaatgtttttctcctgttttttccttttccttcagaggaagaagagcttagaagaacagctccatcaccttgtaagttgagccttagaaattcatggcaacatgacttagttttttatagtggttttctagagttcattgattttacataataatatatttgtatcagtcataaagttcattttgaggagatgtaaacctttaacatattcgtgttacccatttttcttaaaatcttaaacatcttgacttttaattgaatcttacatcttctttagaaatcatgagcaaatgttaacatatttagagattttatttttggctacttagcataaagctttggtaactaggtcaaggaatcaaatgataatgtcattctgttaagtcaatgttaatataaattagaagtaaaaacaaaaaatgtattttatatagggtcacctgcagctagtcctcaaagcagtgataatagcg

SEQ ID NO: 94506 - DNA, 1387 bp, Homo sapiens
acatgactgtctgttacttcacttttcatctattgaatcttcaatagtatcagccaggagacttacagtttggcttggggataattcttttgttgttcatccttttgacaacctattttcctgatattatctcattataaagggcatactgggaaacctttcctgagtgcttcaatacatactgtggaaattaaaaagtgggaaggcaaagacctcgagtaggataatacatcactaaatcagtgttacacttgtgtacttggtgttaatcgttaccttttcagttattcgttgcttgtttataaactcagggaatttgaatttataaattcagcatcatatttcattctagttatgctttgtagtattctataaaactgattgtatctaattctttataattcctataggaacaaatttaggttttcaattgactctaccttttagacatgagaaaagatgacaattttttttaatgtactattttcattgcttgactttaggtccattgcaaaagaacttgcagactggcttattagcaacaatgtggtggagcatatatttggaccaaatttacatattgaggtttgtggatgattacataacttctctgttctattgatagagaagaatatttttaaaaattgatattaagtttttcttttccagattatcaaacagtgccaagtgattttgaattttttggcagcagaagggcgactgagtactcaacatattgactgtatttgggctgcagcacaggtaatattaacagctcacatttattgagtgctttgcttatcatatgttctaagtgcttctctgtgaggtaaattctattatcctgttttatagctaaggagaccaagacatggacaagctgggactgaaatctggcttccgagtccatgtcttactatgttactggtagaatggaaggaaatcagagtcagtcagttggagcttcttcatgaaaccatcctggtttaataaagagacattttcctgttattctcatttatacagtctacccttctatcctgaattattgtattggtatgtttcttgtctgatgtactgtttttttttttttttttttaaataggcatatatccacatgattcaaaattccaaaagtaaatataaaaaatatattacatgtttttcctttctgccccatctctcaagcatgcagttattatcttctcaggtatatcagatttttttgtataaatagcgaactgtatacatttttcttcctctttctttttcacaaatgtagcataccaaccagatgtggctttgacttttttttttttctttcttaatttattctggagatttctcatcaatatatgaagtgctttttatcttcttgtaaaactgt

SEQ ID NO: 94507 - DNA, 1062 bp, Homo sapiens
tttttttttttcgtttttttgagatggactctcactctgtcgcccaggctggagtgcagtggcgcgatcttggctcactgcaacctctgcctcctgggttcaagtgattttcgtgcctcagcctctgagtagctcgcgttttaggcgcatgccaccatacccagctaattttgtatttttaatagagatggagatttactgtgttggtaaggctggtctcagagctcctgacctcaggtgatccacctgccttggcctcctaaagtgctgggattacaggtgtgagccgctgcgcctggccattatttagtattttaatataacagaaatagttttagtaattgggaagcgtgtgtctctgattatgtcttagattttataatattaatctagttattgtgatctacatatgtcaatcagtttaccatgttagtatttgctgacaaatgcaagaataattttggaaataaaaacccttaatttcttgtctttaatcatagaatcaactccataccttcaatgatgtgtgcaataatgaatcattagtatcggacacagaaacgtaagtaggagcattaatttatatataagtataccattttaatgtacagttgtttatatggtaaattctaatttttagatttaaaatttttactagaaattctttgccctttgacattgtgtacagttcttcatgaagctttcagaacattatgctgtctgtaacataactcactctccctcttttttttgagacagggtcttgctctgttgcccagggtggagtacagtggtgggaccatggctcactacagcctcaagttcccagggtcaggtgatcctcccacctcagcctcccggatagctgggaccataggcgcatgccagcatgcctggctaatttttgtgatatttgcagaggcagagttttgccatgttgctcagtctagtcttgtagactcaagccatccacttgcctcagtctcccaaagtgttgggattacaggcgtgagccactgtgtctggccacatttctctcttttaaaagcgtatgcgaacata

SEQ ID NO: 94508 - DNA, 1104 bp, Homo sapiens
ggcaagctcaaaggcttttctagcttccacttatgtcatgtctattaatatctcattggccaaagcaagttacatggcaaggcccagatttaaggtgtagaaatagattacaccttttgatgagaggaatagcaaagtcacattgcaaattcttgtacatataatgatgggaggaatttgtggccattttgtaatccattacaggccttgaggaagactaatgttgaaaggttggacagcagagaaggaatctgccaaagagattaggcagggcctgagaggaaaaccagaggtttgtgggttttggacacaaaaaatgttaatgcttacaatgtacattttaagttactgagtggtctttaaaaatgctttatgaatttttgtgtattttctatttctgaatcatttcaggtatttatgcaagctctcggatcaggagttacgacagagtgcagctcgtaacatggctgacttaatgtggagcacagtcaaagaaccattggatacaacattatgctttgataaagaaagcctagatcttgcatttaagtactttatgtcacctactttgactatgaggttggctggattgagtcagataacagtaagctgtatttgttttatttttggtcatcgtttatttgttttctggtctatcataatactacccactatttatggagcacttcatactaggcattgtgctaagtattttatgtggattactttatatggtcttcacaaataatttctgtgtttctcttattttaaataagtctgaagcttagatttatatggatttatactgtgggtccatttgatttccgggtccaactctttcatcattttgtttctgtctttttaaactatttaggtttttatgtttatagatgttttgagaaagaggaataattggagggctttataagcagttaattaattttccaggcagaaaccatagattattgggccgtaggccaaattttactaaatgtttgttttgaatagtcttaaatactgtttttaaataggacaaagtaacatgaaaatctgtattcttggcttctcttggtgagggggttggaagaaggcctggtattcttg

SEQ ID NO: 94509 - DNA, 1040 bp, Homo sapiens
aatcagatagtgatgaatgctatgcaagtaagttagtgtgatacagagggagtatggggcctttctgaagggtgatatctgatggacgtgagtcagctattcaaatgattattagaaagacgtattgtagaaggaacatgtcagtataggctttgaagttggcatatgacacaaactagaagcagattggtgtggagaataatgtgtaaggggatatagttttgaaggtggagagataagcaggggcagattattcaggaccttgtaggccactgtaaggagtatggatttaattttttcaatgggagtctattgaagggtttttagcagatgtttcatgattttttaaaagttttatttggcttttaaatagatcataaatatagggtgactggaatagaagctaggaggagaccaattgaaaggtttatatattagtcctggaaggaaagtgatgattacttacagtaggattgttaatgatgattttgaaaattggatgaatgtaagtgaaaataaaatcaataatactggtcattatagggtataaagaaaagggtagcattgtggatgtggatgacattcagcaccccccctcctcaattttttttatttgtactgtggatatcattactgagatgtgaaaatctgggagaacttaaagacaagactttgagaggcctgtgggacttaaatggcactggcaaattgggagtatgaacttgtagttcagaacagttttcattaatgtaagagttgtgagtgtaaagatggtatttaaaaaccataggagtcacctgaggagagcatacaggaaaagagtagaggtgagtctaagatagagctctgtatgggttggttttgctgtgtaagaaaacatccctcaaaacttagtggcttacaacaatagccagccaggcatggtggctcatgcctgtaatcccagcacttttgggaggccgaggcgggaggatcacctgagcccaggagttcaagaccagtctgggcaacatagcgagactccatctctgtgcagaaga

SEQ ID NO: 94510 - DNA, 1011 bp, Homo sapiens
aggactaaaatacaccttagagctgaatcctattagcttcagttaggagtatcactgcttatcaggagtaattgcaaaataatctgtttattcggtttttataaaatcagtcttttatagaattgtattttttaaaggttagtagttgtaacctaattttacttgcttttttttttttaattaggatatatcaactcaagaaagtaacatattaggggcattctgtgatatgaatgtaagtgtttaccttttttattcttttatggaaaattttatttttttaacaaagcctcatccatatgttttattatttatatatgtcttttgagtttctcatcagtatctttccagtattgctaagataaaaattatttgtacgttttcaaataatgacatgttttctttattttcccaggatgtagaagtaccattgcatttgcttcgttatgtatgtttgttttgtgggaaaaatggcctttctctcatgaaggattgctttgaatatggaactcctgaaactttgccatttcttatagcacatgcgtttattacagttgtgtctaatgtaagtattgttttgaattgatcttaattttgggagcaatgtctagcatatcagtaacatgaattttatgctctgaaaaggaaggttttgaatgatttgcatgtgtaatttttttttattttgacaaaatgagtacagaaacgttttaacgatctttattattaagattagaatttgaataaaattaagttacctgttttaaagctaaaaggggtcatgactatctataattatctattttatctaagataggtgactgcataaaacttttgctaattttcattttttaacttatttttttttttttttttttttttttgagagagagggtctcactccgttgtttaggctgtagcttctacctcctgggctcaggtgatcctcccacctcaccctcctgagtagctgggactagaggtgtgcaccactgtgcctggctgaatttt

SEQ ID NO: 94511 - DNA, 1056 bp, Homo sapiens
agggtcaactgtttcaaatggtcttagatcaaagacttggtagcatacatgttataaaattatatatatgtataaattttgtatgtatatacacacaattattttaaagcaaacaaattattatgaaatgtaatacagcttactagagatttttatcccacttttctttgaggaaattgtccatctagtcttttctttgtgctgctgtgctatcctttcttaagcctttgattttgatttttcgttaatattttttaaagaggcacaacttagccaaaattcttaggaggacaagattcaaaactcatgtgttagtattttgatagctgtgtctttagaaacctactcaacacttttattttatagaagaagcaactggcctacagaggttaaaagatttgattgggcatattgctgagaagagtcctagaatccgggtcttactctactgcactacttctaaatcattttgaactaattactgtattctaaataatatgggaacttggagccactccttctgtctcccttccttcttctctttcctattgtccccatcaaagctgatattttaaaaggttcggtaattggacataagtagtactaattcaggatcaaaagggggaatggcctagttttaatttttttccccttaagagacagggtcttgctctgtctcccaggctggagtgcggtggtgtgatcattggtcaccataaccttgaattcctgggctcaaacgatccacccacctcagcctcctgagtagcttggacactaggcattcactacagtgcctggctaagtttatttttattttattattacttttttaagagatggggtttatctgtgtttatggggtttatcgagaccagcctggtctcgaactcatggcctcaggtgatcctcctgccttgacctccaaagtgctgggattacaggcatgagccatagtgccttgccatgctagttgcattttttatcctgaataattatgtgtaattctgtgaaatcagataattgctctagtgttgtaagtttttttctaagtat

SEQ ID NO: 94512 - DNA, 1046 bp, Homo sapiens
ttgctaaacatatattgagtacttgacactggagaaacaaaatgtcacaattcttgtttttaaatagttccatgtgtagaaggacagacaaatccatacgtaaaactgaagataatagctgtaaacctaacatgatgactttacactaactaaaatatcagttgttgttgcgatgctatctttatgttattaaggtgtaccccagcaggaaggaaaaaataaaaacaagtctagaaataacttagtatttgcttacttgtttttttatattattaaaaaatacagctgctgctttattactaatttattcaattttttttctcttataggcaatgtctatgctgcttcaaggaatataagcatttggagatttttaatcaagtagtgtgtgcacttattaacttagtgattgcccaagttcaagtgctccgggaccagctttgtaaacattgtactaccattaacatagattccacgtggcaagatgagagtaatcaagcagaagaaccactgaatatagatagagagtgtaatgaaggaagtacagaaagacaaaaatcaatagaaaaaaaatcaaactctacaagaatttgtaatctgactgaggaggaatcttcaaagagttctgatccttttagtttatggagtacagatgagaaggaaaaactcttactatgtgtggcaaaaatttttcaaattcagtttcccttatatactgcttacaagcataatactcaccctactattgaggtatgtaaaataggtggtgtgaattttaagtaataccaagtcttaacttcgcagtctgtttcttactgataaatatgaagacagttttctgctggcggaaaatcattattgtcaccagaattatttaatgtttctccagagcatttcttcagcagtttgtgctgaaaatttgctcggcatagttcatcctatcaaggaaagatctatacattgaactcagaaattaatctggtagtgatctaaacattttactgctatagatctatgcttattttatgactcttaataaataatag

SEQ ID NO: 94513 - DNA, 1438 bp, Homo sapiens
ggccaggctggtgtcaaacccctgaccttaagtgatctgcttgcctcagcctcccaaagtgctgtgatgacaggtgtgagccaccacacccagcctgacctcttactttaaacctgatttttcctaaacatcaaaggaaaaagctgttaatcagaagaattgtaggagaaatgtgtttatttttcttcttgtgggagttgtgatactatagaattgtaaagctggaggaggccttggaggtaaaaattaaaaccctttcattttgccacagataaaaaagatgtgatgcattatttatatatatttataattatatatttctgtgtgacaaaaatactccaaaagtagtactatatcttaaaacagcagtaaacatttattatcctcaaagtttcaatgggacaggaatttgggagtcctttagctgtttggttctgggtcgggtttcctataatgttttagtcaaggtgttggccaggtcatagtcatgtaaaaagctcatgtggggctggaggatatacttccaagttggcttgctttagatagtgaccaagttagtgctggttgtttattttatttattttttatttttttgtgacagaatcttgctttgtcacccaggctgcagtgcagtggcatgatctcggctcactgcaatctttgtttccccggttcaagtgattctcctgccttagcatcccaagtagctgggattacaggtgcccaccaccacgcctggctaatttttgtatttttagtagagatggggtttcaccatgttgaccaggctgatctcgaaatcctgaattcaggtgatccatgcacctcggcctcccaaagtgctgggattacaggcatgagccaccacacccagcctcagtgctggttgttaatgagaggtcttggtactttctcatgtggtctcctctttaggctgcttgagtgtttttcagtgataggtggcttcctctagagtaagtgatccaaaaaagagcaaggcagaagtgacaatgtcttttatgacctagtctcagatgtcacacattgtcacttccaccactttctattcactagaagtgagttccgtctacacagaagaatatcaagtaatttgtggctgtacttcaaattcacacttggagaaataagattatttccacatgatcatacagggcattggtgatctatttggactacaatatagttgttttgatctgatgctattactgggtgcagattataaattatagttgcttagctgtcatctggtacaagtattattagaaccaggtacttgcgtatgtattaattgcctattgattcaccagaccgttccctgcctttttttgagacatggttttgctctgtcactcaggcatgatcagggttcactgctgtctcagcctcctgggctcaagcctctcgaatagctgggact

SEQ ID NO: 94514 - DNA, 1233 bp, Homo sapiens
cattctttcagcagaattgggctagggaaatgatattggacccactggaatatttgttgctagatggaattctaaaacctaacctggaaagaattttattttgacatgtagattcctcatgaatgtttacttagtattacttttaaaattaaagctacatactttatatgaggcatttagaaatttttatcattgcattttaaaaacataagtgcattttatttaggtgggcagcatataattctacttagataattttgtcaggctggaaataacggtaaaactgagaagaaaataagagaagctcagatggtgggaggatatgtatgatattggtgtaccaacataagtaatacagagtttaaaaaaattaattggcagggaaatgcctataataaagtccctgtgtcccctgtctcctcaccctcctttctgttgtcagctttttgagatgttggttttgatattaacctctatacagtattctgaaacactcttcttatattgctgttgcttcatctatcaattttaggtgtaacctatgaacttccagttatgatatataaggatttcattcttttaccctccccagttctctcagtatagttacatcaattcttagggtagttctaaaaataaaaatgttgctcagcaatgagccaaaaaagttctctagttcattttatatcttgcatgttctctctttcttggtgtactgtcttttcattcagttaattttctatgtgtggatcacttaattctctcaaacgctcataaactatgcatcattaggtgatcttttatccccccacccctggtcataaccctagagtattgattactttctagagttactaccttctcttcagatctcatccttataattcattttgcttgtctctgaggcaggagaaccttagggtctggaggcagggaacctaaggccaattcacgctgacttcctagaattaaaaggaaaaccctaagattccacgccctgagtaacaaaaggaccggaggctaccccgctttgcaacctccccacacatttttgtgtggcaggtgaaaaattgaaattacctctaattggtcccctcctgcaactaatcatgccggtggcagtccaagtcttcatctgcataggagtataactttgtaacttcagcctctgactggtcccactttccataaccaatcagatgtttgcatagggtgtaactttgtaacttcaga

SEQ ID NO: 94515 - DNA, 1050 bp, Homo sapiens
tggctactgctgatacctctgagaggagtaccatgagactggttcttggaatactaagctggaggctggaatcagtgctgctgctttcagatatagcaagctgacaagtctttggtctctcctcctgccttcttcttctagtaccctataggcactggagaacaagatcttaacaggaagacagctggaaatgaaaaatgtagattgcatggtcccagcctcagcatcacaacggaaggctggttttggagatgagagataatcccagaataagtggcaaagtctcactgccccccccaccccttacatctgtcaaaaatctgttcttaagtccatatgagttattaattaaaagtagacttattttctttggaagcaaaagaatgattatctgaaatgtttgcatttgtagctcttggctttattttgaactgttggctttaatactggtttagcattattcataattttaaaatttcttttttatttcagtatcagatgtagaaggtggtgatggactgcagctcagaaaggaacatactctcaaaatatttacttatatcaattcctggacacagaggtatgcatctttaggtatttcgaagactaatttttgtgagttgtgttataagttgcgatttttattgtcacattttctttttagggtgttgggttagataccattagttactaaatgacagtttgtcaatatttattaaatctttactcatgaggtcgatcatgattctgtttttaaaacatgggcataaatatcagtttctttctttgacccctgcttatttagggatatgagagtcacagaaattctgaaaagtaactattttgagagattaaataatttttatggtatagctaaaggcttgtaacaatcttaatccttaaaaaagaaaagtcattgtggtaggggatacttttaagccacttaatatctgttccgtttctataattatgtgtattagaccaatttctaaataatacatatattgagactataggaaataaaattttaggaaaacatgttaatataat

SEQ ID NO: 94516 - DNA, 1733 bp, Homo sapiens
ggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacatttatttttcctttattgactcatttattcctatattaatgatagtgggtatttgtgtttaagcatcaagtaacattttaaatgaagttggaccccttgatttacaaacaagatttctaaggttattgttcctagtaaatgcagcagttgtgtaaaatgaacatgttcctaagataccttttgttctcaagaaacaaattcctcctgtggcattttgactcattttacctttatttgggattagagggcacttcttgtctaactctacttagcatctaaatgtaacaaagaataaacattagccttggaatgagaacacagatgtaacctggtacaaatactaattgtattcttaaaaaatgtaagtaaactaagtagccatgagccttctcaaaagggtgagtggagccaggcttggtagctcacacctgtaatccctgccctttgggaggccaaggtgggcggatcacttgaggccaagagtcccagacctgcctggccaacacagtgaaaccctgtctctacaaaaaaatacaaaaattagccaagtgtggtggcacgtgcctgtagttccagctgcttgggaggctgagccaggagaatctcttgaatttgggaaggagaggttgctgtgagctgagattgtgccactgcactccagccagagtgagacactctctctcagatatagattgatttttttttttgcggggtggggggtgggggtgatagaatcttgctctgttgctcaggctggagtgcagtg

SEQ ID NO: 94517 - DNA, 1583 bp, Homo sapiens
tgtgcctggctaattttgtatttttagtagagacagggtttctccatgttggtcaggctggtcttgaactcccgacctcaggtgatgcacccgactcagcctcccaaagtgctgggattataggtgtgagccacctcgcctggccattatgatggataattctttttttttttttgagacggagtcttgctctttcgcccaggctggagtgcagtggtgcgatctcggctcactgcaaactccatctctagcgttcacgccgttctcctgcctcaacctcccgagtaggtgggactacaggcggctgccaccacgcctggctattttttttgtatttttagtagagacggggtttcaccgtgttatccaggatggtcccgatctcctgaactcatcatccgcccgcctcggcctctcagagtgctgggattacaggcgtgagccactgttcccagccgtggataattcttatatgataaatggaatttgctttttttcctccaagaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtaggtgattctgatttcttacacaatgcagtataaacaaaccacttctcttctactgccttaagtcaaacatttgatgttttttacagatttaaatcagacctcccatttcccaaatgaccctagacatatttaaaacagttaagtgtacctttcccttttaaaattagtcttaaagcttattttcccaataaattttgtgaacttttggctttaaactttttaatggtaaaatggaattgcatctaatgtacacctgagtaccactgtataagtttagtggtaaaattagattccatttgattctgttttgtaggtgaaatggttacaaagcaaccattgattagaagtatgcgaactgtaaaaagggaaactttaaagttaatatctggttgggtgagccgatccaatgatccacagatggtaagtgagagatgctttgcttttgatttctagtgttgatgctgtgttttatggaatatgctatactctattatgtgcattttgctaatttaaagcatatcaactttgtggttattttatggcattttatttattgtagtccttacgttaatatactaatagctgtattccatcttcaaaagaaactgctgttaatcagtagcgaagggtggtgatatgtaacaagatagctaagaaaattgggtcattttatgtttccatagataggttaggaggatttaattaatggagtaccggtgcagtttttgcattcctcttgatttttagaacaattgctagagctacaaagttgtcattactttacctctttagcaaagtgattgcttcccagattaaaggcctgaaagtcttttttacaccctttttcctaaatgatttgcagaaaaggaaatcattttcagtaataaaaac

SEQ ID NO: 94518 - DNA, 1009 bp, Homo sapiens
ctggccagtttgggttgtttgtttgtttgttttttgaggtggagtcttcctctgtcacccaggctcgagtgcagtattgcaatctcggctcactgcaacctctgcctcccaggttcaagcaattcaaacctcccaagtaactggaattataggcacctgccaccacgcttggctaatttctttgtatttgtagaagagatggggtttcaccacgttggtcaggctggtctgcaactcctgaccacaagtgattggcctgccttggcttctcaaagtattgggattacaggagtgatccactgcacctgggccaaaatcagtttcaagacgtttgtgaattgcttgtgtgtggttttccttattagggtgtataacataaacgttaaaatgtctgctttttaaaataggttcatacgttttatgaagctgtggggtacatgattggtgcacaaacagatcaaacagtacaagaacacttgatagaaaagtacatgttactccctaatcaagtgtgggatagtataatccagcaggcaaccaaagtaagtatttctaccttttcttaaaagttttcatgggatttaacaagacgtgttctttacaaatgtattgaattcaagccttttaacatgtatgtgtgatccataagtgcttttatgtgtgtctttctataatttattatctgggcgaggtgtggtggctcacgcctgtaatcctggcacattggaaggccgaggcgggcggatcacctgaggccagaagttcgagatcagcctggccaacatggcaaaaccccgtctctactaaaaatacaaaaattagctgggcgtggttgcacatgcctgtaatcccagctactgaggaggcttaggcaggagaatcacttgaacccaagaggcagaggttgcagtgagccgagattgagctactgttctctagccgagacgacagagcaagactctgtctcaaaaaaaaaaaaataaatgaaaaatctgggccgggctcggtg

SEQ ID NO: 94519 - DNA, 2868 bp, Homo sapiens
cacacacacacacaattcagtggcatattagtatatatacaatgttatacaaccattaatacctagatccaaaacattttcatcacccgaaggtgaccctttacccctaaaacagtcactttctcctttgttctctccccaacttctggcaaccattattttggtttctgtctctgtagatatatctattctgattataccatataaagggaatcatgcatgtgaccttttgtgtctggtttcttttatttggtgttgtgttttcaatgttcttccatgttgtaacctgtatcaatacctcactttttatcatgtctgaagaatattctcattgtatgaatattcagtattttgtttgttctctcctctgtgatggtacatttgggttgtgataccacttattggcacccaaggccttttaaataaatgtcgttccattaggagacatgataaaaatacatattgatcaactactatgtgagagatttttgaagtgctttagggcatgtcagaagaagcagagttactccagagtttgctgtctatttgataagtattgaaatctgagttgtgatgaataaaacatgaatttttattttcccttaaggtgtaacaagtgaaaagcaatttgaagttggtaatgtttaagaattattttaacagttttggtcttctgtgtaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtaacagagcggttggttgagtgttcttcctgttgcatactgtggttttgaggtctgaatccaaatacttctaatctgtgtaaataaattagctataaaaagagaacccaacaacttctccatgagtgtggaaaactagaacatgaaaggagttgagtctagaaccttgattctcaagagtgtggtccttctctcagtatcaacattggttgtgatttcgttaggcaaattcattggccacctgccaatctactaaaccagagtctaggaatgagacacaggaaactcctgtaacagaagttggttaaaaaaatcacattaaaacacacttaaataattataaagccatttttgtagaattacagtgaaaaaaaattttttcttttggagacagggtcttgctctgtggctcaggttggagtgcagtggcgtggtcatagctcactacaatcttgaactcctagactaaagcaattctcttgtgtcagcctcccaagtaattggttgcaggcacacaccaccatgcctagcaaattttaaattttttagttttacttcatttatatttacatagttttttctgttgtgctttaagccccagtatttttattgttttagagattgggtgtcattttgtgttgctcaagctgctctcaaattcctggccacaacagttctttttgcctcggccctccggaatagttggaattataggcatgaatccctacacatggctggcttgtggtttttttggttttgtttgtttttaactaagcttctacactaatgatttcagtgatctaacgatttttttcttgattgatatattgttgagtataggtccgtttattaatggttagtcgaatggctaaaccagaggaagtattggttgtagagaatgatcaaggagaagttgtgagagaattcatgaaggatacagattccataaatttgtataagaatatgagggaaacattgggtaagttaataaatactgttaatctttacctttataaatctattctggggtggaaatacattttaggaaatgtacttgtagtttctaaatattttctaaatgtattgttactcatcaataaaattctgctcattatttgcatttgaaaccatgtttttctttgtagtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggtatgcaagggataggtatgaattagaattgctaaataagtattatgttgttacaataaataatacaaatttgtcttatttacaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatggtaaatctctttctttactatattttgcttttatttttattgaagaaaataaatgaatgtttttgtcttgttagagacccatgatggagtccaggacaaaataaatgaatatttttgtcttgttagagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggtatgttaagcactgagcatatgttatttttagaaagtaacacttgtatcaatctgtatgtatcaatggaaataggagggcaactattggatccaatagaagtgtttctgattaaattttctttcttttt

SEQ ID NO: 94520 - DNA, 1693 bp, Homo sapiens
cacactttaggagcttggtcttttgggagatacctgaccagacagtgggaaacctgggacttgttcctaacattgtgtctgaaggaattcttttcagccctagtttgattggttatctattaaatgatctagaaggttattcataatactgtgttcatggccaggcatggtggttaatactgtaatcccagaactttgggaggccagaatgggaggaccagttgatgccaggagttcgagaccagccaggacaacataaccagaccatacctacgaaagatttaaaaaatagctagctgtggtgttgcacacctgtagttccagctactctggaggctgaggcaataggatcgcttgagcctattaatacaaagttaaaatgagctatggtcacactattgcactccagcctggatgacagggtaaatccctgtctcttttaaaaaacaaggaaagatagattactatgtatgtttgtgatctgaatgaatgaattgattatttttacatttttcaatgtcagtgagaaatactagaaaaatttaaaggctgtgatagcggcctttaatttatttgagaagagtcaaaatctaagtcctagagatataagaataggtatactggacctaggagttctgtatgtggtttaatattagcaaaagggtgttgggatattagggcttaaaaataatagtgttggctgagtgcaatagctcagacctttaatcccagcactttgggaggctaaggtgggaggattgcttgagccaggagtttgagaccagcctggacaacataacaagataccgtctctacaaaaatgttaaaaataagcttagtgcgatggcacatacctgtggttccagctactcgggaggggctgaggaggactgattgggcctaggaggtggaggctgcagtgagctttggtcataccactgcactccagcctggacagagtgataccttgtctcaaaaaaataataataaaatattaagtgtctttagttgttttataaaatgcgaactgatcgtcccttttaaaatttgcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggtaagatatgtggagcttttgctcctaaaattctgctctgcctactaataactcttaaaagtgcctttttctaaaatgtatgtaccttttgagatttcttattacttaatatttgatcagtacattatatatattctcaattctgaattacagttataagcccagttttctgattttatgttctccataaagctaggactaaaaatttataatcaaaattaaattactaattattatatcatttctaaggttaaaatttcaaagaccttattttaaaatttcagttttaattcaaataacatgcatttgttcatttaaagatatacaattcatcgtgtaatcccagcactttgggaggcggaggtgggtggatcacttgaggcaggagttcgagaccagcctggcctacatcgtgaatctctgtctctattaaaaatacaaaaaaattagctgtgcgtggtgtcacatgactgtaatccca

SEQ ID NO: 94521 - DNA, 2175 bp, Homo sapiens
ctggtcttgaactcctgacctcgtgatcctcctacctcggcctcccaaagtgctgggattacaggcacgagctaccacgcccagcctggccaggctgttctcagactcctggcctcaagtgatctgcccaccctggctccccacaaagtgctgggattacaggcatgagcaaccgcgcaaggcctcctagaataatttctacatatctatcaggcagatactaatacacagacagacccattagacggattggacctttcattaggataattgaaaagggtcctgcggtgattaagataaaagactttgtgttttgttttctacccagtagggtgaagagggtggcacatttcttcctttaataaaggaggagaaaatgaaaagtgatttatccttactcctgcctttatccattacataatttctttgaagtttgttttatttgcctttgagaaatgaagtgcgattaacatttcatgtcttgttttagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacaggcaagtaataattatgttttagaattttaaagtgatttctcaaacaatttcaagcagtttggatgtaaattgtagatattttaaggaactatgatcagtaatatgttaaattgcttgtagtggttttcaactgcagattaagaaatagtcctagacggggcctaataatttacctctgaaggttgaaaaatgaattgttcaagacacacttcaggaattgttttgtatggtaactagtttaataggttctaagcaaatgatttgtgtccaaacatacgtattagttattttattttattttgagacaagtcttgctctattgcctggggtggagtgcagcagcgcaatcttggctcaccacaacccccacctcctggattgaggtgattttcttgcctcagtttcccaaatagctgtgactgcaggtgcatgccacagagcctggcctcaaatcagttattgtctctgcttcttttcagttccccaattgttaacaatagtgttctttttaaaacaaaacagaaaactagatttgcctctaatagtaagcaactggtataaactatagttatacttccattaagttttaaacatttgttgtagtcattaggaaatctttttccccttgggttgcccaggctggtctcaaacaatccttctgccatggcctcccaaagttctgcgattacaggcatgagccactgtactgggctttaatcatttttattagtattatagataactgatacttatttctgtgtcttctaaatctgatatttttgtgtgtttttttttttagcatgtgcaatgaattctcacagatatttcaactgtgtcagtttgtaatggtaagtgtttttaatttcatttttaaaaacaataataggaaagcaattatttacaagtgtgttttgttataggaaaattctcaaaatgctccacttgtacatgcaaccttggaaacattgctcagatttctgaactggattcccctgggatatatttttgagaccaaattaatcagcacattgatttataaggtacagtgaatacatttcagttatttgtcaccggatagccacatatattcttttcacatgtaaagctctcatctctgcattctaaaccttattcaaccttgtttctaacacgaggacgctgctcaggagaaatttcccatattcacacctagtaaattatttaaagtgagtttcaaatctgattctgccacttagaccatgtaattttatgaattcattttgaacaatggatttgattatattgcttttagtttgagtaagttacagtgaggtaagtcaagtgctatttctgaaaaatgaaaagttcatcttttaactgataatttaaaattgataccatgttatggcttaagttctataatggtttagcctgggcaagttggtgaaaccggtctctactaaaaatacaaaacagccaggcgtggtggtgtatgcctgtagtcccagctactcgggaggctgt

SEQ ID NO: 94522 - DNA, 1252 bp, Homo sapiens
tatgaatagcacattaaattcattgattttttttttttaagtcttgctctgttgcccaggctggagtgcaatgacgtgatgtctgctcactgcaacctccacctcccggattcaagtgattcccctgcctcagcctcccgagtagctgggattacaggcacccgccaccacgcccagttaatttttgtatttttagtagagacagggtttcaccatgttggtcatgctggtctcgaattcctggcctcaggtgatccacccacctcagcctcccaaagaattgctgggattacaagcgtgagccaccgcaccgggccggaatttttttaaaatgccaatactggtgacaggattagagtatattaactgattttacttagtctttccattcccacattaattagttctcaaaatttatttgcatgctacaaaagagctcaacaatttttttattacgtgcaatttttttaataggaataaaaaaatacgttgttggcctcattatcaagacgtcatctgacccaacttgtgtagaggtaagagtttattttggagcttattgggagagcataaaatcatttagatattgagtctgactacaacctaattctgtcaagacacatagtcacacatatgcacagtcagtcatttacagtagagctgtaatcatttgttaggattgtctggttatattcttatttatacttacctcaggctctcatttaatcttttacttttccttagaaagaaaaggtgtatatcggaaaattaaatatgatccttgttcaggtaagctttaacttaactgttttccttagaagaattatgcttattatttgaacaaaatgttcgacctacttaggaaataaagtatactaatattttgcagaagtagtgatagtattcttataataataggtaacctactgtctagtacttgaatgttaatttgctgtggcagtaatcatcaaataacgttaaagccatcatttatgtggctgcagtgtggactggactctgttggattcttatttatcttttcttttcttttttttttttttttggagacagtctccctctgttgcccaggctggagtgcagtggcatgatctcggctcactgcagcctctgctacccgggttcaagcgattgttctgcctcagcctcctgagtggctggaattacgggtgcttaccaccacgtttggctaattttttgtatttttagtagagacagggtttcaccatgttgg

SEQ ID NO: 94523 - DNA, 2186 bp, Homo sapiens
gaaaatacaggttagtaaatagtaattttaggtaacagtatcaaataggaagaagtaaataaaaaagaaaggacagtgtctttccattaaaaatgtaaaaaagtttggttaaataagatgaagttatctttaagatttttatttgtaactatatttatggtgggttttgtttcttagtgttttaaaggctttttaattgatttttggcaagaggatatattgtaagcagtgcattgctttgacttactgagtcttgacaatctgattttgtgcctataaaattaaagaaaatgcttagggtagtatgtttttaaaagctaattaagaacttcaggcatttggacaactctcttttttttacatatttctcagacctagacataataaatagatatgtttttaaaagtgaacaggttagaaagcatcactatttactgctgattatgaaacattttaatagcatcaaatttgtaattttagaattttgctttggccttgtttttattttgaaagtttttaaggaatgttctgcaaatgtagtactttagttgaaatggcaaaattttcttgaagagtgtgaaatgttaaaatgaaagaaaacagcaaaaacattcactgtttgagcacaatgtagtttgggacagtctatattgtgctttggataaaatgagcattcacatgatccctttggttgaaatactaatgctcctattttattgtgtaatgactaaccattttaaagatgaactcttattctcagccaaaacttgcaatctgaggttatatgtctatatatgaatgagcttacctttcagatattatagctgattcttccctaattctctcagttgaaatgtaccacaacggttttgtcccttttcttcctcctgcctatccacactaattggtcatagtaattcaggtagtaactcctggggctttataaattattataaatattgttgactatttagagtgagtaatcagcaggagggacaaaatggcttgaaagtggtatctctgttttttaattttttatacttttagttataactttcagtatttaggaagaaatacctgaaaggtagatacagattgcaacatgcgtttgtgattattttgactgtgcacaaaagtttatctttaaattagtagaaatagcaactataagggtggggttaaaatataaaataaacccatgggttgtcttgctgctccttaagtaacacaccagtgatgcttgtaaacactttctatagaaagtatctgtgacaatactttaatatttggccaaaagcttataactcctagaggatggtaggaagcttgatagcatccaagctgctaaattcttaggagcctgttcgtgttaaagtacgtgagcctatgagcagtcatttatgctgtgaattcatatctggctgctacttttccttcgacagataagcctatttggctgctaaagggctttttatttggttcttcctcctggtgtgagcatgtataaacagcaggacgttatatagagtagcaaacaataaaatgaggaaaatgcatgaaaactcagtatatgggtgaatagatacttgtttaatatgtgtaattaaacttggtagcataatgtttttgaaactttagatgtaaatgtgtgaatgtctgtccatttgtgaatcctgagagttgccagtcctataagcaatatattcacatgcttctattctccaattttcagtactatggactacaaattttggaaaatgtgataaaaacaaggtggaagattcttccaaggaaccagtgcgaaggtaggaaaataaagaattataaattcagagttttgtttttcctggcatttttattgtagttgactgtttgagggggcatgtaatgaatctttagtatattttgctctaatggagcttattgcttttatcatgaagcaaacaggtctgtttgtattggtgggtacaggaaggccacttacaggttatcttttgggagaaagaggagactggactgttgaaaactctgacaataaatattctagttaaaaatatgggctatggcacagtggcccacgcctgtaatcctaacacttcaggaggccgaggcaagtagatcgcttgagtctgggagttctataccagcctaggcagtatagcaagacctcatctggacaaaaattt

SEQ ID NO: 94524 - DNA, 2599 bp, Homo sapiens
acttatttgcttcagaatagatctttggttgaaatgcagttcagttttgagactaaaaaataaaccagatttactcccaaaaatgttactgtttcaaataagtaaaatatttgcacctttaaagattaggagttggctgggcatggtggctcactcctataatctcagcactttgggaggccaaggcaggcagatcacctgaggtcaggagttcaagaccagcctggccaacatggtgaaaccccatctctactaaaaatacaaaaattagctggctgtggtggcacctgcctataatcccagctactcaggaggctgaggcgggagaatcgcttgaacccaggaggcagaggttgcagggtgctgagatcgcaccactgcagtccagcctgggtgatagagccaagactctgtctcaaaaaaaaaaaaaaaaaattgggagtcatatttatataattttatttctatttctgtaaggtctaatttttgagtatttctgaacatcaataatagaatctctgtccaattagaatttgtgccttgctcagtagttttcattttaatgaatgattcaaaagaatacattagcttaagttttgttttttttaataatattttagcaaagaatggctcaagaagtactgacacatttaaaggagcatcctgatgcttggacaagagtcgacacaattttggaattttctcagaatatgaatacgaaagtaagcaagtggtggttttaaaatctgttatttcttttcttccagtcataaactttgaggaaggtatctcatttttagtattagcatttgttatctcaaattattttatattgttaatttgtttcaaaatttagtcttaagcatataattaattcttgcaaatagtcctaagaattatgaatgaagttttgtaatgggactagtatgcaaggtggcttttttggttgtctgattttgtttttttctttttagtatatgtatacaggtctaagtagcataaattctgaatgttattcagagattaaacataacattaaggaattattttgggcaagtaatcaatataatacaggccaggcacctctgacaccaagttgtgtggacagcttaaaaccctactccatggcattgggcttctaatgggacagcactcagtttttatttacaatggaaaatgttataattctggtccttttttaagtttgaacagaagggttgatcaaaatgtgttttgtctgttttaggcttgatgattcacgcttctctttaaactgccttaaagtaataaatactatggcattctgtttaatacacgaaaggtttccacttgatatacattgtgttaaaacagaagatagccatattcacatctgtttctgaaaccagactttgttaattaacagttttaaaatattaattagttttgacatcttgtaaattttaggtcaaaaatacagtccagaacttcctcaaagtgctaaccttaagtaacataacagtgtttgcctgtttgcttgcctggtaaattttgctttttatactgacagacattactaatgtttaagttgatttatcaacagtatttttaaaaactcaaatttgtcttgtgaaaaatgagatgattagaggaacagaaagaaagcaacaggtaaagaattcttcaatttacataaattacaaatgatttggtgctaaatttatgcactatgacatttggcttttatgcaatcatttttttttctttaaagatgttaacactacctgatattaatcataatgttccattatgttgattgcttgtaataggaagaaaaggggtgtcttcctgtgcaactgacacagctaggctttgacggcaggcctccacaaggtctacccttttgattccctttaactgaattctgttcatcaattgtttttgtttcatgggcggtgggaggggaaaggggaattcaatgcataaaataagtatttctaagggctcagtagaaatttctaccatagggatcatttcatgcatttattttttcatttagtctttgctgttatctgtccctcatcttcataactcagcagtggatttctcaagtttggagatgtaaggcaaaagtataattcttcagaatgtttggattgtagtgatttatcattggctttcagatttgactgtcacttcagatttttgagcaaaaatactaaaaaaaaaaagaaaaaaaattctttgaagagacaggacctctgttgcccaggctggagtgcagtggtgtgattatagctcactgtaacctcaaactcctgggcttaagtgacatttctgcctcaactttctgagtagctagggctacaggtgcgtgtcaccatgcctcgctaacttaccaatttttttatagaagtggggtctccctgtgttgctcaggctgatcttgaactcctggccctcccgccttggcctccccaaaatgttgggattacaggcgagggccactttgcctggccccaaataacattttttcaaaggaatgtaaattttttttgttttagtttcataggcaaagtctttatgtctgggagagattggattttaggatattatagta

SEQ ID NO: 94525 - DNA, 1254 bp, Homo sapiens
cttttactgagttattcagaagaccctacttgggaagaaaagaaaatcacattcacttgaacttaatcctacttgcttaaaaagttttgacatcaagatactgaactgtatcacgttttaggaccataaaatcctaatagtggatgcgtttaaataataggttagcatactttataaatgttagtagaataggaaagtcttcctggtgtataaactaaacactagaaaagttgaatggaccataataatttatgtaattatcaaatagctaagtaatttcagcttttgttacttgcttttactatctcagttttctgtaattaaagtctctaaagtattcattaaaatatttgtaataacatggttgaagtaaaataacttgtaggaagtttttgataataccaaaacttgataggcagcttcaattttttttctttattttcagtaatctatgccagcaattatgacaatgttagcagaccatgcagctcgtcagctgcttgatttcagccaaaaactggatatcaacttattagataatgtggtgaattgcttataccatggagaaggagcccaggtaaagtagccaaccaaaactttataacattatgacagtgtaacagagttgttgggtttagaataaaattttaaattatcacctttaaaaaagatattccatagtttgcattaatttggaattctgtattaaccataatgaaaattggtttggagaaagaaattgcatgtttgacatggttagagtgggttgttttggaatattatacttgttttgtccttaagagccaaatgttattaaatactttgtaggtattaaaggttctctgtacttttatatatacttaatatgtttggcactaatacgattcttctacttttaaaacatttacagaagtacttcacagatatgtttgtttaaataaaaacaggaataccaagtatttttatgttagttgaattttgtgcacttttcaaagtggtactgttaatgtagggaattatcttaaacataaaccaaattttgatcagtttaagatttttggtttttttgaacccaactaaaaggtgaaacagaaatgtgtgtacaattttaaattgtatatgtcacaagaaaaaaaacttgattttttacctgtggggccaaacttttttttgagacagtctcgctctgtggtccaggcaggagtgcagtggcgctatctcagctcactgcaacccctgcctcctgggttcaag

SEQ ID NO: 94526 - DNA, 2952 bp, Homo sapiens
tcccacctcctcctcctccacccctctcctcttgcctttcgaccctccccacttcccctcccccactctgcgggcaaatcgctgctgaaaagaggtaggggccgaagcggcgggctcgtgtggagccgtgaggcgggattgactggcgctcgggccaatgagagataggctcatggcgcggctgtagctggaactgaccaataggagggcgggctgggggcggaggcccaggttccaaacgctccgcggcgccatgggctgaaaactcaaccgagatggaatctcccagtctgaaccggtttcaaccggttccgagtttgaggcactaggaggagggggagaagcggctgcagcggccgcggcaggagcagcgggagctacagcatcagcaagagcaacagtagctacagccccggcggcggtgcctgttccagtctttgctgctgcagtccgtgcaaccacccagagggggaggggggaaccaccagtcgctgaggaacaagagaaggggggaaagtttaggcgagccttgggggggggggggccagcgccggagccgcgtgagagagggagccgtgttttggtaggggggagtcggactgcaactggcagcagagcgtctccccggccgtgtggactctacaccccctactcctgccgcttctgctgctgcctgtggctggagggtccccctggggctgaatctttgggacttgaccccgttccctcccccttccctcactccccagccgggcgggagcatttattccccagattaattccccttttgggggggggcgggtgtgtgtgtgtgtgtgtgtgtgtgtgtgtgttgggggaagcgtccctgaaatagtaaatattattgagctctttttgcccttttcctgtccgtttttttaatttccttttttgaggtgggaaaactgaaacccaccttgattcgtcccctctcccccctccccaccttccctcgccctaatcccccaacgaggaaggaaggagcagttggttcaatctctgggtaagtcgactgtgtcttcggggccgagggtcgggcggcggcgcggccgggcgggcgggaggaggccggcgtggggcgcggcggcggcggccgcgggaagcgagcccgggaggcggcgggcgggccgggggcgcggcgggcccacagcggagcctgcgattgaatggagccgcttttgccgctgggggatggaggcggggaggcggcctcgggaggggagcgcttgctgggtcattcgcgtgtgcgggtggcggtggaggaaggcgaggagtgtgatagtgaagcggggccccgcgcggggtgggaggggttccccagcccctggggctggggagaagttggggtgatttcaggaacatctctgtaaattattaggagtggaagtttccagaaatatttagtgcagcagcattgaaacgtccgcctgcatcacgtggccccctcggtggagagcttgggatgggggagggaggggctgccgactccctgttcctccagcaaggaaactcgaaagctctccggttttgcagagtggcatgtgaagtaggaaagatcagtttttcaggggcctgcacatgggattccgtcttgtagttccttttcaggggtttgaatgtgataagttggttaaaccatttactgttggccttgtacagtggaggatgccctgattctccttcattccgatgtctgtgagtttgggttgggtgggaggaagtggtgtagtagaggaagcattcagtactggctcagcccggacctcctctgatcacgccgaggccatgctgcatagagaaaggggcggtgaacttaaggcgcctggtctaaatgcctcctccgagtaagggcggggtgagtgcgtgctcctgtgtgctatagttagaagggctgcaaatcggttcgggtgggaagcgaggggagggcgggccctaatgaggtgtgtttttcctgaatgaagcgggcgattgcccacacaacctaaggagcagtctttcgccttgtagcgacttgtttttcacctagtgtgaagttattaagcaacggttatgattttctgggttttgtttaggaattggcattgggtgtcacttgtagagtcacattatccattaagctggataatccctagtgtatgttatccagtgagtggattttaggattgaagagcccaatgggaatgagcgttcgtggttacacctctcgcactatggcttgtttgctgtctgattgtatatcttaagtgtgggacactgctgttagtggaaagaatgttttggaagcggtttgatttgggggactaaatgtgcttggcattgaccacaaagccgccatttctgtactatgtacagttcaggaataggtaggtgatttcgaagatagccgctagttctaaggatggcaaactactgtatttaaatccttctattctaaatctcgtttttcacatcagtctagttcggagaattttataagaacagtgtatttgaaaatgaaacttgtaagagtcattttcttaatccttttttgttttagcattcaactatggtagtaaataggtgaaaagtttgttcaatatttaaccgaaatatttgaaaacttttgatacatggatcttggtgctttgtggacattgcttttaagcctcaaataattaagattgttctgatcttttaaattttatggtacttgaaggtggaggagagtttacacattcatttgtggaatatatatttcctctcagtatttagatcttaaggtttttttgtggtgtgtaacaagtattctgctgtttaaaaacgtttgtttaatgcctactacgaaacgttttgaagtctcatcagttttgtcaataatggaccaattcttgaactcctaatttcttgagttttacattatttttacatcatatcaatcataggtgactcatc

SEQ ID NO: 94527 - DNA, 1006 bp, Homo sapiens
ataaataaataaataaataaataaatatttctagttttacaggtcagatccttttcaaaaggttaccttttttcaaattttgaattatcaaaattcaaattatcccatgttaaatctttgctaaacaacattctgattggcttaaagtggattaagccttagtttgttaccctcaggagatcacttgaggaaaagaaaatgttggaagaagagagaaatcggatcctaactaaacagaagcaaagaatgaaagaattgcagaaactcctgacaacccgggctaaggcttatgactcacatcaaagtttagctcaaatatctaaatccagagtaaaatgtctcaggtatcatgaaaaaatcttgaatctccagaccactggttttcaaactcttttttttttaatcagtagatagtaaaatatgagcagattgaaaatagcattagtgttttagcttatggatttaaattgtcatcagttacttgtgttcagtgcacacacactcacctcatggtgagaaccaacatataaactcacctttatggtgagaaccatgaagctatgttgatgaatacagacattttctattgtggccttagttaatggttataatcttataccaatatctgatcttgttctttatattatttttgattgcagtaaacagatatatcaaagagctttgttctaaggtttggatgaaatctgatagcacaaattaacacgttaaacatcggttatgtgatgtgttcattagcacatatgttaatgtttagtagtatgtgttgcattttgttagtttcaatataaaaatattcacggaattcttagaaccccttcactagaattttgcagtacaaagtttgaaaaccagtgttccagatgttgcacataaaaatgttgatgtttaagtaggaaactatctccctcaaagccaggtaagtaatgtgatttattactttttaatctgatttctaaatatgcatatgtgcttttaattacaatga

SEQ ID NO: 94528 - DNA, 2060 bp, Homo sapiens
gtgttagccaggatggtctcgatctcctgacctcgtgatctgcctgccttggcctcccaaagtgctgggattacaggcgtgagccaccgcacctagccaagatatcataatttttaactactgtgatcattttgctaattttgccaatatttaaaaataagtggccaggcgccatggctcacgcctgtaatcccagcactttgggaggccaaggcgggcagatcatgagatcaggagatgagaccatcctggctaacacggtgaaaccctgtctctactaaaaatacaaaaaattagccgggcatggtggtgggcgcctgtagttaggattgggtgactacagcattaattcagtttttccaaattttaattgaaataacatcccacagtgtagagaaaagcttagtagagtatcatattctaatcttcttagacagaaagaaaactagatttaggtcttgaggtacactggtaaccacgtggctgctgatgtgtattatcacagacactaaaagcaacttgtgctgatttgatttgcagggtggtatttccaacattttggaggaactggttgtccagcctctgttggtatcagtcagtgctctgactcttgcaactgaaactgttcggagcattctgaaaatagatgatgtggtaagtgtttccaggttgcaaattttcttaggaggtcaaaaaggcatatattttttaaaggttttttgttgttgttgttgtttggttggttggttggtttttttgagacaaagttttgctctgttgcccaggctggagcacagtagcacagtctcggctcactgcaacctctgcctctggggttcaagtgattctcctgtctcatcctcctgagtagctgggattacaggtgtgagccaccacacctggccattgtttttttaaaagtttttacttttttttttttttttttttttctgagacgaagtcttgctctgttgcccaggctggagtgcagtggcatgatctcggctcattgcaacctccgcctcctgggttcaagcgattctcttgcctcagtctcccacctcccaagtagctgggattacaggcatgtgccaccacacccagctaatttttgtatttttagtagagacggggtttcaccatgttggtcaggctggtctcgaacttcttaccttgtgatccacctgcctcagcctcccaaagtgctgggattacaggcatgagccaccgtgcctggccaagtttttacttttgataaatatttgctagtcatcaaggtgacagcagttcttaatacaggttttccttttattaattgccttaaacattttccagctttaaaattctgtcattacaggttttgaaatctaagtttttctcttatcaggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacatatatgtagcaaatcttacttaaacaaaagggtttcttaactaatgtcttgttccagtgattttaaacatcttgattgccactgtcctgatctaa

SEQ ID NO: 94529 - DNA, 2985 bp, Homo sapiens
tccatagatgaaaagaattctctgaagtttgacagatcacttttttccttctttttttttttttggagacacagtctcactctgtcacccacgctagagtacaatggcgcagtctcagctcactgcaacctctgcctcccaggttcaagcagttttccttcctcagcctcctgaaatagttgggattacagtcacgtgccaccacgcctggctaatttttgtagaaatgaggttttatcatgttggtcaggctggtcttgcactcctgacctcgtggtctgcccccccttggcctcccaaagtgctgggattacagatgtgagccaccgtgcctggccagtattttttcctaatagacgcattcccatttactccattaatgtgccagaatgtactgtggatgttcattttatatagtctttgaagactcagaagacttggttctaatcccaatcatataatagctactgaccttgagtaaattgccccccaaactcagtttgcttatccgtataatagggatagtagtaatatctacctttctagtatcacagagttgttattcacagttcatggggaagtgtaaatttgtggagtctgaattaatacttctaaattcatgaagtattaataaggtttcacttcccaagatgtgctcatttgttaagaaaaatgaggtcaggcacagtggctcatgcctgtaatcccagcactttgtggggccgaggtgggaggatcacttgagccctgagttcaagaccggcctgggcaacatagggagaccctgtctctattaaaaataaataaatgagccgggtgcagtggctcatgcctgtaatcccagcactttaggaagccaaggcgggtggatcacctgaagtcaggagttcgagaccagcgtggccaacatggtgaaaccccgtctctactaaaaatacaaaaattagccaggtgtggtggcgggagcgtgtagtctcagccacttgggaggctgaggcaggagaatcgcttgaacccaggaggttgaggttgcagtgagccaagatcgtgccattgcactccaagcctgggcaacaagagcgaaattccatctcaaaaaaataaaaataaataaataaatggggaaaaaataatgacctagttatttcgtgtgttttatagtgtcattggggacagagtacattttaatactggaattgtactaaaatttccaatagaattggaaatcttaattttgaccttacgaacttagtaaactaaagcatttttcttcagaaataatgattggccatttaagaaacagtaattaaaaccttaaaggcatttgaagagcaaaatttttttaatctagcattgacataatcactgattttgtattttagagatgctcttagtgatcttgcattacactttctgaataaaatgaagatcatggtgattaaggatattgaaagagaagacattgaattcatttgtaaggtaaaacattaacatctgtatttgtggaaaatgtctgataattagataaatgtcttaatttgtggatttgactgttttttccagacaattggaaccaagccagttgctcatattgaccaatttactgctgacatgctgggttctgctgagttagctgaggaggtcaatttaaatggttctggcaaactgctcaaggtaacagtattacacttaaatttttatttgcttaggtttgggtatggggttttaggttgttttttttctttttttgagacggagtctcactctgtcgcccaggttggagtgcagtggcatgatcttggctcactacaagctccgcctcccgggttcatgccattctcctgcctcagcctcccgggaagctgggactacaggcgcctgccaccacgccctgctaattttttgtatttttagtagagacggggtttcactgtgttagtcaggatggtctcgatctcctcacctcgttagccacccgcctcatcctcccaaagtgttgggtttacaggcgtgagccgccgtgcccggcctgggtgtggggtttttttgacccttcaaatacttaatttggaatttgtttactgaagattacaggctgtgccagccctggaaaaacagttacaattgttgttcgtggttctaacaaactggtgattgaagaagctgagcgctccattcatgatgccctatgtgttattcgttgtttagtgaagaagaggtaatgtcagtgttacattattaagtaacattttgaacattaaaactattatattctattttttaaagatataaatagcaaattattaaaaataattttcttttggataaaataagctaaaaatatatttgtgaatttcagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaaggtaatcatttaatctctaatgtagaaaatattgattaatttaaaatattaaaagctttgtagtcatctgttgaatggaaagctctgtaatgaaaagcataatcttggatttaaatatgaggcctgctgcatgttaattaatctatgccattgagtgagaaggaagatggtgacaccttagggggaagtattatttgttcattaaatctgccacttactgactagcttttagcaagttacttagtctgttcctcagtttcctcaggtgtaaaaacagggatgattaatagttccctcataggcctgttgtgagaattaaatgcatttctagttaacaagctcttagatagatgcttggcatatactaaagactgtataaaaaatcattgccc

SEQ ID NO: 94530 - DNA, 2334 bp, Homo sapiens
cgctgtttggccaaatgacttaacctcttggcttcagtttctccatctgaagattgaatgagttaatatgtaaagttctaagaccactgcctggcatatgttaagtgattgataaatgttagcaatttttatcaacccctcatcaggaatgtacatacataacattgatgcctcatcacacattcattttagatagaaaatactcacgtaaaattaaatttatgctttttggatttcctgtaaaactttgatattctacagtcccggctattatattaataaaagaaaaaagcaagcatacatgtttttattttgtgcccctggtgacaacctgaatggaaaagacactttatggactgtcttctcatgagtgtttccctcttcatacccacaccccactgcaaaaattataagagtctttcttaagtatctttgtcattgaaaaattaggacttttttctactgtgaaggtaacttttttttttttttaataattctaggtggtttctcagtattcaagtctgctttctccaatgagtgtaaatgcagtgatgaaagtgattgacccagccacagccaccagtgtagatcttagagatattaaaatagttaagaagcttgggtaagcatctctaattacaacttgaataaaaatttgaaaatgagcatcagattgccaaaaataaataaaaacacctagatgaaagtcacaaagctctcttttctctttttggttttgttttcgtgagaatttgtattagtatgggcatctggagattttgtttatgttaccttatgatagtaaggcagcagtggatcaaagagatccaggagtggggcaataataaatgtgaggctgaatcatattttattggactgatgacttttaatctgttcatctattaaacgtacagatgtccactccctcttaactacccctctttgttttcttttatccttagtgggacaattgatgactgtgagttggtggaagggctggttctcacccaaaaagtgtcaaattctggcataaccagagttgaaaaggccaagattgggcttattcagttttgcttatctgctcccaaaacagacgtaagtagaatccaaatgaaattggttctctgtgtttaactttttaataactcaggcatttctttattaaaaatagaaaatactactagtgatttaaagcagatctcaaaagacttactagaattgagacaaaaatagtaattgttggtgccacaagtgacaagtctgtatcctcagttgggatattgaaattgagagctagccatttgcaacgatgcctgtagtcccagctccttgggaaattgaagcagaaaaattgcttgaacctaggagtttgaggttgcagggtgctattccatgacctgtgaatagtccctgcactccactccagcctgggcaacatagtgggaccccatcttttcactgttgctgttaatttacaaattcacacagattagagagggaccctatcttttgaaaacaactagggtaaccattttatattttttggttataaaaaatttacttgcaaaatgtaagataccagtgtacttagttgaaaataaaagactcaagtttgggatgtgtatcttaatccagactcttttctatgcatgtctatataatttattacttgatatagttttggttgaatttatacaacacatagtattttcgcttaaaattctacttttaaacttaaaatatcttacaatgcaaattatgatgttctttttctgaacagatggataatcaaatagtggtttctgactatgcccagatggaccgagtgctgcgagaagagagagcctatattttaaatttagtgaagcaaattaaaaaaacaggatgtaatgtccttctcatacagaaatctattctaaggtgtggggctatttattttgttcatcccttaatgataattttggatctccactagcagtttattttttctgataaaatatatgatttaagcacttactctaagttcgtatttcttaacagacaactcttaggtgaaacgaaatggagaatttttattttaaaagcacaggtaaaatgttaggcctcaatattgtaccatcatttgctcagaccaagggaaaaaatggtataagttcagttaagatgtctaggaaaagcattttaaacaaatatatgacttgtaaattcaaaacaataaaggtgtaattttcttttacaaaaaaaagtaggttttttaaaatagccaactaactgccagaatgttgtgttttggccttttaaaaaacttatttcttcgattattggcttcagggt

SEQ ID NO: 94531 - DNA, 2591 bp, Homo sapiens
ctcgggagactgagacaggaggatctcttgagcccaggaggtggaggctgcagtgagccatgattgcactgctatactccagtctgggtgacagagtaagaccctgtctcaaaaaaaaaagtttgatactctagtctcatctggaatgccccttttcttagcttccaattctatagagtacttacgatatatttttgctttctaattagaacttttgagtagcagggcagggggagatgacaacccacaatctgaactggagatcatctactagtctttaattttaaatgaaacccaaggtagacaacaaatcagaagaaatcaggaatcatgttgcatcttcaaattctgtttgtgacactggtgcgattatttgaattaggtgttactgggttctgtcatttctcattgagcaacttggcattttctgttcacttagctggtggagctgtctaaggctcaagatatagaagcaggagatggcaccacatcagtagtcatcattgctggctccctcttagattcttgtaccaagcttcttcagaaaggtgggtaggatgtactttattactgaataaagaaaagtttaaaaaacaaactttaggaaaagccaagttattcataagtaatatgggattgaagatttaatttggaataactaatctttttaccaagaatttttaaagttagattttgctatatttataatagagattagaagaaattttccttggcttctgatatttgctgggctcctttttgaatggaactcaattgaattttgctgttcaaaaatgagtggtagaggccgggcgtggtggctcatgcctgtaattccagcactttgagaggccaaggtgggtggatcccctgaggtcaggagttcaagaccagcctgaccaacagtgaaacacagtctttactaaatacaaaaaattagccgggcatggtggcgcgtgcctgtaatcccagctaaggcaggagaatcacttgaacccgggaggtagaggttgcagtgagccaagatcatgccattgcagtccagcctgggcaacaagagcaaactccatctcaaaaaaaaaaaaagaaatgagtggtagaaatattactaatcttggactcttatacaagaaagaagatttgggagagaaagtcaggattgtctttgctttagtaaatggtatttaattatagtagtgactatccaatcacttattttacttataatgtagatttgtgatattttgagaagtatcggccaggtgcggtgactcatacttgtaatcccagcactttgggaggctgaggctggcagaacaattgagcccaaggagttgagaccagactgggcaacatggcaaaaccctgtctccaccaaaaaaaaaaaaaaaaaatacaaaaaaaattagccgggtgtggtggcgtgtgtctgtagtcccagctactcaggaggctgaggtgggaggatcacttgagcctgggaggttgaggctgtagtgagctgagatcagggcgctgcactctagcctgggtgacagagtaagaccctgtctcagaaaaaaaaaaaaaaaaaaaaagtataaaatttggttttagtcaagaccattaataagtgtgtaatctgttttaagttggatggaagtaaattattagccatagttagcaggttattcaagccactatattacaactgaagcataagtttgtaattaagaatagttaaatttgtgcttgctttgacattgagtagaaaatttttaagccatgtcaaatgtgtagtttacctgttacaattaaataactagactttcacaaattacagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtgagacaaacactaacggatacttgtcaaattagttaaaagtgtgttactctatgattcttgatgctatacggtacataaatactaaatctcaagagtggctaggtaactgttataatctgtataattgaattggtttaagattaagagaggaaatgagccataaggctaacaaaggagttaggatatttaatatatactatatccatttccacttttctgtttaatgcattgtaacagtgttttgataaagctagatattttaatttgcctataagaaaccttttcctccaccaaatcagaaagactgccatagattactggcagtatagctaatttttattgaatatttaatatggtgggcattgtgataagttttttacatttattgtcctcttcaaggccctcagatagtcatatccccattttatagatgaaaagagtagatctagaggagtaacttatccaaggaccgctaacagaaacagctgagatttgaacccaggacaggctgcccatcgtggtccatcccttaactaatacttatgctgcttttcttatttaccaaacttaaagcggtgttgtgcttttaaatttctttggaactcatgtcacttgttttctgt

SEQ ID NO: 94532 - DNA, 1019 bp, Homo sapiens
tgatactatagattattctccgctctggatattcaaaaatctatctttcccaaaaatgccattgtcctttttgtaggacaaaaaaggaaaaaagttactgtgttgactgtaagaattgtgttcaccgcatggcatggtactgctttaggggcatccatggtggaaatcgtgtttctgattaataagaaatcattaaagatagcaagtgcttctttataatatttttccttttgtgtgtgtgtgtgtgtgtgtgtgtgtgtgtgtgtgtgtgtgtctacatttcttcacttttagattaccctgcaacaaagccacttttttcttttgtaaagttggactgttattgcgtattcttaaactattatgctaatgtaagggaagagaatttaaaattaagtactttgcaaacagaaattaacttctctattttgaaatgtaaaagtttaataaaactattaaggtgtgacattgaaatataactttaaaattttttttctagattcaagatggaaaaggtgatgtaaccattacaaatgatggtgctaccattctgaaacaaatgcaagtattacatccagcagccagaatggtaagtgtaattttaggtgagtctttttttttttttttttttgagacagagtcttgctctgtcatccaggctagagtgccgtggcacaatctcagctcactgcaacctctgcctcccagattcatttctcctgcctcagcctcctgagtagctgggattacaggctcgtgccaccatgcctggttgatttttgtattttcagtagagacgggtttcaccatgttggtcaggctgttctcaaactcctgaccttgtgatccacctacgttggcctcccaaagtgctgggattacagacatgagctactgcgcccggccagatgagtcttcttttttaagtgtgtttgatacttggtaaacagttaaatttatttgatcacatgatatttaagcacgatgaacacttttcgtgctgaacaggcatattttta

SEQ ID NO: 94533 - DNA, 4650 bp, Homo sapiens
taaaaatacaaaaattagctgggcatggtggcggacgcctgtaatcccagctactcgggaggctgaggaggatcgcttgaacctgggaggcggaggctgcagtgagccgagattttgcgccactgcactccagcctgggcaacagagtgagactgtatccaaaaaaagaaaaaaaaaaaaaaaaaaaggaggggacctcatagccgtgcaaggtggagtgaggaaatgcggatgtcctcaccactcgcctttaaaatcgcgcgttgtcattgctgcctcgcgtaaaggttcccccggcgctcttcacccacagcgccccgggcgtacaatctcgccagcccggagcccaccgcacgcatcctcctcgcccggcgcgcagcggacagcctcctacgtcacgccagcgccgcgcggcaaggaaggcccccttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaaggtatcactctcatggcctgacccgcggcgccgcggggttgtgctctgcgctctcatcgtgggcttgagcgggtttggctcatttcccatttcttcgggtgatcctctcttgtcctccctatagaagcagcccagtggagggatccttatttctgtttttctgccgatgatcgccaacccggagtatggaggcctttggacttgccccattttgcatcttaatctcccttagtttttcatcctgcactgtgcatcattcatattggagccgaaagcagttcaaaatgccgaggattgcatgcagtcttcactagggatctgacgcttgagggctgtcgcttattgcttattggaactggtagaatgcacagtatctttcagctttgttattcttatttaaagaactattaaataaacttcacttggcacaactgttgagacgaattgggtgaactctccgagtctaaattggggcggggcccattgtactgggatggatgtgggaaccgacttacgtgtcgtgtttgaaatagttgcggaaaagttacgttgatgtcgtctccgcatgtgcagtgaaacataggcaaatcaagaaacaattatttgttttttttgtggaagtgtgtggcacacgttggaaatcaggaagaccagagtttcattctctgcttccgttacttcatgtcttagtgacctgtaacctctgtgccaaagattcacttataaaattggaggaaaatgtttgctttttagagttaagattaagagaaatcgagttgaaatagaaaaatctggaaggaaaagtcaggacagaggtttagagatcttgcccgagtgtatattgagtatagtagttcttttgggttggagaatagtagtatgtttacagaagaggtgagattagaaagctaggttggggcagatgttaaaggcctggtgtcctggaaagtatttggcttaatctcccccagctatgggatcatttctttttagccatcgtgtaggcttgctgtgaggattcagtgagaaagcatataaagacccacgtatataaagtacaccttacatgtgtttgcagtcatcagcccaagtaactgggaatgtgatggcgctaagataggtaacgctggatgtaagaaaaagtaatagtttctaacttgtcctaatgagttggaaaggtcagaatggccagatttaggagtcatttgtaagtttaggagataatacacctggaaacgaaggtttgtaggataattgtctagggaccatagttgaagcttacatttattagattaggaacagaatgttgaaagataaattttgggtcgggcagggtggctcacgtctgtaatcccagcaatttgggaggctgaggctggcggatcacatgaggtcaggagttcaagaccagcctgaccaacatggagaaaccccgtctctactaaaaatacaaaattaggtgggtgtgttggcgtaggcctgtagtcccagctactcgggaggctgaggcaggggaatagcttgaacctgggaggcggaggttgccgtgaactgacgtcgcgccattgcactccagccagggtgacgagcgaaactccgtctcaaaaaaaaaaaaagataaatttgggggccaagagagtttataatatggttgatattcaacaaacaaaataagtgggaaatttagcaacctttgaaacaaaagcagacaaagaactgaaacaacagaggagggtgtgcatgtgggaaggaaaggccacctaagttatctgtgaagatgacccgttatgtcttaaactcctggcctcaagtgacggcctgccttggcttcgcaaagcgctgggattacaggcgtgagccaccgcacccggccccagagatgttttataacatactgatgatgaccaaaagctatgatttgagagttttggtttttgtttggtttgttaggtttggtttgtttgttgagatggagtctgtcttgctctgtcccccaggctggagtgcagtggtgtgatctctgctcattgcaacttctgcctcctgggttcaagcggttctcctgcctcagcctcccgagtagctagctgggactacagatgcgcaccgccacacccggctcatttttgtattagtagaggcagggtttcgccatgttgtccaggctggtctcgaactcctgaccttaggtggtctgcccgcctcagcctctcaaagtgctggtattacaagtgtgagccatcacgcccagccttgttggattttttagaagagtatcttgctctgtagcatttccattgtggtttgcccttttggcggtgttggcgggccacctatctaccatgttcacattagtgaacaaaagtctttgctctcagagattacatactagacagagtaaacaaataagtgaattatctgtaaattgagcattcctaatttgaaatactccaaaattcaaaacacttctggtcctaatcattttggaaaaaggatactcctccatcagtattttagatctagacagttctgttgctgcttgtcctgttttaggaatggaggaaatagcaattctcagagctcctaactagattgtaccattttgacatctgaaggaagatgagatgaatcctcaaaatgtattctgccataagctgattacaaatactaggccaggcgtggtggctcacacctgtaatcccagcattttgggaggccgaggcaggcggatcttgaggccaagagattgagaccatcctggccgacatggtgaaaccccatctctactaaaaaatacaaaaaaattagctgggtgtggtggcacgtgcctgtagtcccagctactccagaggctgaggcggaagaatcacttgaactcaggaggcggaggttgcagtgagccgagattgcctcactgcactctagccttgtgacagagtgagaccatgtctcaaaaaataataataataatactgtgtacgttgactaacagaagtgaagcatcatacatttaaaagaaaaataattgttgccaatagattatttttagacaatgaattttcttctgtggacatggtgatttgttatgcactatatcctaataagaacacaatgatcatttgaggggaaaaaaactctattctttaagaagtcttgatttcccatactcccagctattctgggaggctgaggtgggagggttgcttgagcccaggagtttgaggccatcctggacaatatagtaagaccctgtctcttaaaaaaaaaaaagttctaatttgttttcttttttttcccccccatctgcagcggttgctgatgctattagaacaagccttggaccaaaaggaatggataaaatggtaaagagttgagtcattgaatactactaattgagcactgctgttcacactacaagatcttgttgaagggttagatgtgctgtttaaaaagtggggctgggcgtggtggctcacacctataatcccagcactttgggagggtgaggggaggatcacctgaggtcaggagttggagaccatcctgaccaacatggagaaaccctatgtctactaaaaatacaaaattagccaggcatggtggctcatgcctgtaatcctagctcctggagaggctgtggcaggagaattgcttgaacctgggaggcagaggttgcggtgagctgagattgtgccattgcactctagcctgggcaataaaagcaaaactctatctcaaaaaaaaaataaataaaataaaaatagtagaaagtgggtggggcacagtggctcgcacctgtaattccagcactttgggaggccgagacgggtggatcacaaggtcaagagttcaagaccagcctggccaatatggtgaaaccccgtctctactaaaaatacaaaaattagccaggcatggtggcgggcacctgtaatcccagttactcag

SEQ ID NO: 94534 - DNA, 1040 bp, Homo sapiens
aacaaccttttattcttataatcttgctaacttctattgctgctcttaagcaggatgtacatttttcatataaatgacaacagagttcatactttcagttatctatgtaatatcatggtctgtgaagaaagtgaaaatgaagggtgacaagagggtagaagcaaaggaaggaaggaggggacatgtacttcccagcaggggatacagcggacacacgtgttaacagcctccttattgccaactgcctggaaatatatttcacaggccatgttttcaggttcaggtgctccctgagctgtagcccttccctctgactttcatgttgtgtgccaaggtgttatgtagtgattcctggcttttgtactggttctgttttctgtttagaatggagccctcctatcctacttgactgggacattgaccctctctagctttgcctgttaatcacaaaaggacaaacctttcacctgcttgtagatatgcgaagctggccattcacttgctctagtttttatttttgggtagaccctaaggaacaatgaagtcaatgaattgggaatggtgtgtttatttaaggagataacatcctatagataaatactcttgtatttatatataaaatatataaaaggcagttgctaaacactgcccccccctttttttttaagacggagtctcactctcttgcccaggctggagtgcggtggctcgatcttggctcactgcaacctctacctcctgggttcaagcaattctgcctcaacctcctgagtagctgggattacagacacccgccaccacacccagctaatttttgtattttagtagagatggggtttcaccacgttggccaagctggtcccgaactcctaacttcaagcagtccaccctccttggcgtcccatagtgttgggattacaggtgtgagccactgcgtccggcccaacactgctattttaatctactttttttgctcacattataattcaacttcttataggtatgagtttgcgtgatctttattgctattgctgttaacc

SEQ ID NO: 94535 - DNA, 1371 bp, Homo sapiens
gcagaattgcaagaatatctcagtctgagaccactctgttgtaagttcctagacctttttctctgaattctgtagggggagaacataataaagggaatggaaaagaccttgctgttgcaatattcctttcccagtgtcttagccaccctggctgcatttgggagctttgcaaaaggactcagcttctctcattttctctgactctgcctgactgtggtacaaagtctcatcctttcatcccttaacagatcagtaatttgttgaatgcttactatgttcaaaacactgtgtagatgcaataatgaatcagattcctgttggaggaaaagagctgtgatgtacataatgttgtctttgttaggaaaggatgattgtcagacgagtggacagataaagtgctgagagggaccaagatgaggcaagaggtggtgaggttggcatctgagagggatgcataaaagaggatgtctttggcctaagccttgaagaataggtagataggagacaacagagatgggaaagaggtcaagttgaaagaacagtaaaaacagcggccgtctgcagtggcttacgcctgtaatcccaacactttaggaggccaaagcggctggatcgcttgagccctggagttcgagaccagccttggcaacatggtgaaaccccgtcgctactaaaaacacaaaaactagccgggcatggtggtgggcacctgtaatcctagctactcaggaggctgaggcatgagaatcatttgaaccccggaggcggaggttgcagtgagccgagatcacaccactgcactccagtctgggcaaaagagcaagactccatctcaaaaataaagaaagagtagtaaaaacaaaggaaaggaaggagaaagcaggggcatataccaagacaaacaagtggcttgttgagtatttattaagagtatttaggtcaggcacagtggctcctgcctgtaatcccagcactttgggaggccaaggcgggaggatcatttgagcccaagagtttgagactagcctgagcaacatggcgagaccctgtctccataaaaaataaaaaattagcctggcatcgtggctcatgcctgtggccccagctacttgggaggctgaggtggcaagatcgtttgagcctgggaggttgaggctgcagtgtgctatgattgcaccactgccctccagcctgggtgaccgagtgagaccctgtctgaaaaaaaataattattagaagagattgatgtaacttggcagagtcaaatggaaagtgttcagttacttactgtaaacagacttgctctgttaaatttggtttaagagaaggaagaaatagtatttattgttccaatttataataaaattacac

SEQ ID NO: 94536 - DNA, 1077 bp, Homo sapiens
aaacaccatcataaaagcacttttttttttttttgagatggactctcactctctcccccaggctggagtgcagtggcccgatctcggctcactgcaagctccgactttcgggttcacgccattctcctgcctcagcctcctgagtagctgggactcacaggtgcccgcaactgcgcctggctaattttttatatttttagtagagacggggtttcaccgtgttagccaggatggtctcgatctcctgaccttgtgatctgcccgcctcggcctcccaaagtgctgggattacaggtgtgagccactgcgcctggcataaaagcacttttatttagggcattatgtggatatgctttgctgggtaaaatatcacttcgatattaaggtctgagctgggcttgctggattgggaccctgggtattttgagtttggtcatgccagatggccttggctatcttgtggtttccctctaaaatatccttttatgttttccaggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaaggtgtccatgatccctccccactgaccttttctaagaaaattcttgtgcccgcattggtattaaatcctcgcattcagtcttcctgcctctacttgctcagatttctttttttctagctttcatttagtcttacatttgttccagtgcagaggttctcacccttcagtgtgcataaatgttataaggggtacttgtaaaagcattcacttttttgttgttattattaaattcggagtgttgctctgttgcccaggctggagtgcagtggtgcagtcatggctcactgcagcctcaagctcctggactcaagcgagcctcccacctcagcctctcaagtagctgggactacaggtgcatgccaccacactcaggtaatttttgtattttttgtagagatggggtttcaccatgttgcccaggctggtctggaaa

SEQ ID NO: 94537 - DNA, 2270 bp, Homo sapiens
caccttccggacaccctgctacccccgcccggttcctcgccggttccggcttcgtacccgcgccccggtggaggaagccgtccctaggtggctcctgccgcatttaagcctcccttaccttcccgccgtcccagccacccaacctcagcccagagggagaggagagggacaccgcccgctgcggggctttggaacctcccaacccattccgtgcccacctcgccctggagcccggggaccttccccctcctcgctgcaccccaacttccgggggatccggcgccggggcgatgcgggctttggcaaggggcatctggggccgggcctcctcatccggggcgcgcgggcatttcggggaggggggcgcgcgtgattcctcgctcgcacccccgcaccccaccctcgcactgcgccggcctcccgtgccgcatggggagatcaggtgttttgtgagccaaagagccgccggcagccgctccccaccccccacccccaacctctgccacttctgtctccggctcccccaaaactggtttctgccaaacttagggaaaacctttcgctttgaccttttaaaaaaaatattccacactgtttgcgttgaatgattaaccaggctgctagcccgagtcgtgggggtggggtggggcggggtggggtgggtgctgccaggccagggagcgcctgaagccggactctacgagacacccctcgtgggaaggtgggcgtggggggccctgccggggctgcgggcgcgggactggcggctactccagcacggcaggcggacccttctggaggcaataaaccgagtcacccggttaatttccaggccacggtatttgaaactcggggctggggagccgcagaactccctgtacccccatcaagtagaggagccgtcgggagactccccacaagtgtcacagcgtcaaagctcatctttaaaaatatgtacatttataacctgggttggcgaggcggcgctcttctgcccaaaacgtaggggtggttagtttgtagagtgggcttagctcacaggtgcctgagctgtatccccgtggccgcctcagccaccccaacttctcagaaagattgtttagaacaattaaactatattcttttgcccttctcttgttggaaccctaccgtaatatccgatagcgaagccagttggtgaatatagaattctacttgttaaaacaaattcttccggtataattatttgtgcctctggaggtggtaaacgaggtggccgacagggccgggactgggagtgaaaaggcggggaccctggccgagccagtcccggggctccggtgccggcttatagtcgcacccatgcggatctgacagctgacccggagggaggaccggcagggcagggcagggcggtcacttcccattgtcctaactcctgctcctggttcttttgagtagagggtggttaagcctggaggaatttgggagagttttactcggagcccatgcgctcttaaaccagattagattttaagaacacagaagtgaaggagccccatagggctgtacttgagtaatttgagtaatccttttcctccctgctcagactttacaaatgtgtttatcattagatcttctgtttgaaactacttttttagttcggaatattgctttttctccctacagcaagggttcactgtttctcatttagtttttgtgcaggcggcatttgtatgatgaaggcctaattctctgtgaaactgaccagttctcacccttgccattcattagacttgattctgccacatttaattcagtgatcttgggcaagttattcttcacctgagcctcattttacacatctggttttggggatggtggtgtttgctctgcaagattatttctgaggacaaataggatgtttgccaaactcctagcactgcaccaggagagctaagaagtgcttaataaatggtggtcattgctgtaatcaatagagaagttcctcctggcatcgacttccccttaccaaaaacagtaaccctgtggtagccttttagatttccctgtctgagactgaaatcagccacatttggcagatgcacatcagaaggttcttaaaacctaagtagtattttgaggaaaataagcatgatttgcttgttgttcaaaaattatgaatttttttctgggcttctggtgaagggctgaatatatgaaggtttgtagttttgaaaattttcttgttttaaagaaaagtcatgttttaggtttctgataaactaaag

SEQ ID NO: 94538 - DNA, 1050 bp, Homo sapiens
tttttgatggttttattggaaagtctgttagagactttaaaaattaataactgcctatggttacttttataaacattgagaccttgagatcttgcaactaggataatacttggtgatgtgtaatctattgcaacatccctgatggtggtacatacatcaccaatactgaaagattctcataaaggccttttggtctcttatgtaagtgcccaggggaaactaaagtcatttggttgcttggtatttttggtgtgtacagaaggttaaaacatgaattaaactagactctgaagtggtaaatgtttcctggctgcatccagtaaagaaaacagcacaaacacccaaaaggtgtggacccagctgtctttttctccactctctaaggtgggattgctgttcctacgtacttgccaaatatgtctgcaaattacagaatgaatacattcctctctctggagaggcaattactgtttgaataagaggtgtatgtatgtgtggggtaaggttttgggagaattgatgtaatgatttcatcatcactcactggtaaggagactttgccaggctggaacctgttacttgatggagaatttattattagggcttatgtggcacaattactttgctgctggaaaaagttatttgtactgagttttctatttgttacaaattttaagagttgagatttttgccctctgtgtgttgccctgtgagtattaacaacctctgcccaccagctttgtctttttgccttgtcttaatttttgtaacaaaaattcagatgtcttttgagagtcataacatgtatcttgtgcaattttagctttaggtattttcatatataactttaagaatgttacacattattttctgtgcatctataacttaaaaaaaacaaaaaccattttctgatgtggctacagagggggaaattcccagtagccaggaaattgatactttctacttttcattctgtggcattttaaaacagagggttcaggtgtcttcattctgatatgagtaggatgtacgtagcttaccagaatgttt

SEQ ID NO: 94539 - DNA, 1307 bp, Homo sapiens
gatgggttttacctgttgaacttcatgtaagtggaatcagtcatacagtgtggcatgtagtcttttgtgaaataggcttgaattctatttttaccacttattgtgtgactacggacaagttatttaatctgagtctcagttacgtatgggaatgcctaaagttaaaattacacgaactatttcaggataaattttctcacttgtaaaatggggaagataaagccctatgttagatttactggggaaagtaatataaagctacacctagaatacctagcactgtgcctgactgcagtttcctcttcccctttttatttctttaacagggtgataactaaagcaactagatcttttgtgtttaaatgagctatttcattaaaagttctgtaggtcttttattgaaaattagaagacaaatctttatttaatactttgttgatatagctttagctttaagatgtattatttgttagttgcctgtttttgacatttcctctctaaagacagtcattgaaatgtcccattcagagttgtttggccacctgtgtaacatgagctaggatgcagtgatgagaactggtttatggtcaattatggagcttgtggaagagtttagtttgggtaagagtcatcaataagtgcccaagatgctcacaacatctgctttatgtttagtgaaataattatttcagaggtgaaagcacaggaccaattattttaattgcttgcttcagacaagccacttaaaacattttcagctcttgtaatcttaccgtgtaagcggtattacataattccatggcctcatgtctccttatttgtttggtacttttcatttttggactcattctgcaaatgtaacttgggtagtacttggcattctttctaaatgactttcattaaatgtttatttagaaaaagtattcaagataaagtaaaggaaaataaaactaattccaccctctctcaccactataactacattaacttgatgtgggtccttctaagtgctcatttcttcttttgtacacttctagaatgaccttaggaaaaacatacttccaatactttatggaaatttaaaacaaaatatgggcctgcttagagatgtctagcagagaaggcaagagtcttcgtaggcctaagttcaaatctgtccacactgtggtccctacttgtacctttgttagtgctgagcagacagtccccagagactccatcagagggtcccctggtctccagattacagtagccaacacggaaaacctgccctggaatacttctccattaagacctcaagatgtttg

SEQ ID NO: 94540 - DNA, 1305 bp, Homo sapiens
gagttcaaatgtcacctaccaggactggtgatctgccctcctcctcctacctcccttctccccctcatttcactccaggcacaaggcccccagctttcctgcctctggcctttgtggtgactgctccccctgcctggaactatcctcacctcttctctgagaggaggttttctctgatcacccggcataaagcagcctttccttatcccctgtgcagtgcttcatatttcatctaagtgtttatcaaccttacagcaatcaactctgacttggttctttgctgcctgttttcaacactgcttggtttaagtaggcgtttgacatttgttgagttaggccacttcattaaagttagtcttagtagaggggaaactgagggctcaaaccagggcagggatagtacaagattgaaatatgtatgtgtgttgtttggaagaggtgggtgagagaaagactcctggtgggtgtaaaggaatttggaaaccaactaagggaggttaggagaagggccatgacacaggtatattggggcattttttagcatacgggatatgggagtctgtagtgatgtctaggggacaagaatagggggtaagggaagacccagcaatagacttgggcccagaactgtggagcaagtccattttgtgggatggggccaaggagcaaaggctgccaacatgcaagagaaccctgggggttcctgagcttggggtggggtagacatggtggccagcagtattgggtgccctagaaagtcaggagggtgcaaggactgcgaagattctagaaggtgagggggattgggagggtcaaggcaggacaaatgggcatgacaaggagcatgtgcctggtgcctttggagagggagaggctgaagatgggggaaacagtggagattgctattggtgcaagaccccagaagcagcaagagctgtcacagggagtggagatcctgggagttgggggtcagggactggctgatgtagagaacttgaagtaggttttggtcccagagctgacatcaaatgtctttgtagctatggcaacccacttagctcctgtttcccacctccctgcagaatcgcatgaaacctgcacagccaatttcacatgtttattattggaatccattgaactcatgaatatgaaagtgttaatgctctgggaagatatttctatggaccataaacttgctgcagtttatttgtgcttcagaattttttttgagacagaatttccctcttgttgcccaggccggagcgcaatggcatgaccttggctcactgcaacctctttctcctg

SEQ ID NO: 94541 - DNA, 2054 bp, Homo sapiens
tggctaattttgtatttctagtagagacagggtttctccgtgctggtcaggctggtctcgaactcccaaccttaggtgatccacctgccttggcctcccaaagtgcctggtagaaatttttctaattgtttattttctttgagaagcacttaacatccaactggttctccaaagtacttcttttttgagtcttgatcagggaataacacaattgtggtgagttttatgtgcatgtgtgtttttaaccctccaggtctggctctagattgttcactgggaagccgaatgatattttcagattcaaatatatttgtctaataatgaaagggtcgaagtgttacaaatgctatcctttctaaatagtcaacatttggaactagtgagatatatttttacctttattattttatggttgtctttgaagcttgtttataaggaacttttatgtaactttattcttgagatgcagccattatatttttgttcttttcctttaccacataaggaattatttccttcaaatgaacttaaaatatctctcatgaatactcctatttttaactgaatgtttctcttttttaaaaaacttttattcttcaaagttctgatggatcgtctttttttaactctttataatggaaattttcaaacaagtgcagatacagagaatggtatcatgaagcttcaggtagccaccagcggcttcagggtgatgattctttattttcatctctaccccactcacgactaggggcccatgggcaccatctagagagggagagagaagaaggtcacaatggaccacagagtgggcagccatcaatttagagatagcggaggctgggggagaagattggacgcccccagggagagtgacaggcagaccggcgagattggaagcccgtggcactgggattgctgtggtccctcgtccctccacatatgtgatcacctatggtatatgaagggaacgtgcagagactcgtttaaaactgaggtgactcaaattgcttggtaaaagaggcccagtttttaagcagttcaatagtgcccacatattgagcaaacatgttctctttttactgtggcgacaaaaacttttcttggcgggtggccggagaaagctatgttactattgcacttctttaaatacggaagcaagtcttggtcgaaggcctgaatgatgcctccccttttatagaacatttggataaaaggccaaagtgttacttttttttgaggatacgtattttaaaatgtatatggtttattttgatacttaaaaagcaacaacttgaaaacaacagtcctgaaacacttgtcagtaaggtgttaggatttaaccagcctttgagaaagggagaagaggcgggacaggaatccgagatggagcagggagctggtttgcttctttgccgccttgctctgaagttgccacccagggtcacacatcactagaagtgttttcctctgggaggaggatgatgtctgactgtggagaagaggcagcatcccagagggagcccaatttaactggatgctcagtgtgagaggaggagcgctggcatttagtggctgtgtgccgtgggcggggcctgccagcccttggctgtcatttgccacctgagggacaggctgcttagttccagcctcctggctcacctggaaccatttctcctgggaagcatggtagccaggagagtggattccaggtggtgagggcttggtactccttttgggggatcctgagtgccaggagaagaggatgaaatcgatggactgggggaatcaaggctgtcctcatggaagaggagacaggatttgaacctgggccttcaaggatgggggtaaggatggagagaagcaagataagggatgttttaagccaggagaaaccaggctgagaagaggtatgggtggggaggatagtagttgttgttaaggggtgctggtgtctagaggcctccgggatggggttttaggggtggcctgcctggatcaaggatcagcttggacgtgctcagcgaggatggggatgcccatttccctccatg

SEQ ID NO: 94542 - DNA, 1004 bp, Homo sapiens
tcactcagctaatgggtgggcactaggtgtgcagtggttaatttgttttattataaggagtgtccttgatacctttatctcatttctctattttttttcccttccccaaagtgttagaccatgcactttaatccaacattatttttatatgttttttattcttgtagagacaggatctctctctgttgcccaggctggcctcgagtgatcctctcacttccacctcccaaagcactgggattacaggtgtaagccactgtgcctggcctagtacaacattatttaaaaatctctacacatgtctactctgcagaactttctgcactctttgtgcctgcttttggaagagcgagtcaggcagttctctccaagctgctaccctacaagactccaaatggataagccaaggagtcctgcagtctgaggttgtagtacctcactttctggtgtccccttcgctgtaaccaagagcatattctcttttaagaaaatgtgtcactggaaaccttcatcctaactaccaagaaattgagacttcccaaagcaatttattaaattacttaaaatacaatgtcatttgtataattgtgaacacttattgaagttacagaaggttatttttaatatgctatatgtaatctcaagttgcagcatgttcaatgcttttttgattttgaggttacatttttattttggaaggaagacaaatgtaaacgtttatcttgcagggaaatgttggggatgctctcaaactctacagttttgtttttttttttaagacagggtctcactctgtcgctcaggttggagtgccgtggcacgatctgggtacaccgcaacctctgcttcctgggttcaagcgattcttctgtctcagcctcacgagtagttgggacaacacacatgctacaggccaccatgcccagctaatttttgtattttttgcagagacggggtttcatcatttggttagacttacggttcttgagggacaagaattgcca

SEQ ID NO: 94543 - DNA, 2283 bp, Homo sapiens
atcaaaatggtcaaagaatacaaaatgtccttagattaggtcctggttcctttactgtccctccccttcttgttctcatattgattgtgtgttgagtggtaggcactagagatgcagaagtgaatatggcccattctgcccaggagtccttggtgtgtcagacctgttatcacaccgtgtgctaagtcagataaatgtgggtgaggtggtggtaacagcaagggggaagaaatacaagcagcccaacctgggtgggggcagtggggtgggaggaagaggtgacacattggcgcttttttggttgttgttgttgcagtctcactcttgcccaggctgggtcggagtgcagtggtacatttcagctcactgcagcctctgcctcccgggttcaagcgcctcagccttcctagtagctgggattacagacatgagccaccatacccggctaatttcgggccattggctcttctgtttttatgttgatagcccagaatggaagctatagactgtgagaaaaagactttgttactaatgataattttgactactggactggactccccagtcccctgggacacgtggtagtaatcctggttctcttccccagggcagccttgggcaaggctctgtctccctgtgccttggtctcctctgctgtaaaagagatattagagtggatggtctgtaaggccctgggaaagaaattcttggagcttctttctggtaatgaaattgggtcacaatctatgtatgaattcatgtgcatgttgttgaaaaacaagtaaaagaatgaggtaagccaggcgtggtggcacacttgtagtcccagctacaagctggtggctgaggtgagaggatcacttgagcccaggaattcaagaccagatggggcaacacagaacacaggccagaccctttacccgcccccacgccgtcaccccccacacacaccaagagtgagatggtacagttggtgggtaacgctggttctttgatccctttccttcacaggagagctggggtctggaccagccctgtgccactgtcccaaccctgtggcaggttgtaaagttgtgctgatctcccttcactgcaggctgtgatgttggagggaaggaaaagcagattttctccacctgtagccagctctgacaggtgtttaagacgaggctagtttaagccccagcagtctctcatcctttcgtatgaataatcaaaactgagtcatcacaaaacatatctgcaggggattctgcctatggtgcggaagtgttaccagaccaggacccctggatacgttaaaccattgggtgattcccgactggccattttgttgtctacattattactttctcatatcaatttggaaagaaaaaaaaattcgattccccctgcctttccttggaatggtttacatcttcctggatgggtatccacaaatgcaataattttggtaccttaattttttagaactacaactttatttggggattctcaatcctcctcgagcaacggtattgtgtggtagaaagtataagagcttagacccaaggttgggaccagagtccaaacactgactccactgggattagctctgtgacctcaaactaattgcctcacattttttagtttgttgtggagattaaatgagatgagaacatcccaacattaaaaatgggcaaagggcatgggggagtaggaagaccaggaaggaagcatatgaaaagatggcatcaattaaaacagggagatgttcttttttggtaaagattaaaaaggaggacagtggccgggtgcggtggctcagacctgtaatcccagcactttgggaggctgaagtgggcagatcacttgaggtcaggagttcgagaccatcctggctaatatagcgaaaccccatctctactaaataatacaaaaattagctgggtgtggtggtgggcgcctacagtcccagctacttgggaggcagaggtaggagaatcacttgaacccgggaggcaggggttgcagtgagccgagatcgcaccactgactccagcctggatgacagagcaagactccatctcaaaaaaaataataataataataggagtacagtattcactgtcagtgtggatgacttcatgctcttgggtatacaacgagaggataaatcagtgtgacctttctttttggtgggaggttaagggtgagagtgaggggaatagcttgattctatgctaactgactttaaaaggttgggttcccttcgtaatatgtttcctccggaagtaaccagat

SEQ ID NO: 94544 - DNA, 1721 bp, Homo sapiens
gttttcagttataggaaaaatcagaaacaactcataagctcattgattagcaattgataaagcagttgggtggggtggctcgtgcctgtaatcccagcactttgggaggctgaggcaggtggatcatttgaggccaggagtttgagaccagcctaggcgacatggcaaaaccctgtctccacaaaaaataccaaaattagccaggtgtggtgacatgcctgtagtcccagctactcaggatgctgaagtgtgggggcatcgattgaacccaggaggttgaggctgcagtgagctgtgattgcgccactgcacttcaacctgggtgacagagtaagaccctgtcccccccgtcccccccaaaaaaatttgataaggcagaccacatttacctatattctggcaggggagttagagatccgacagaagacaaaccactcttcccctgtgaactgaatctgctttagagaaattaagtcttcgggacaacaaaaccaactaaagttgtaatcaatgggcatccaacttggagttcttcgttttttcccttatttcatgttcctatgtgatgtggtcagttttctgttttaagtagaggggacaggaaagaaaacacattcctccagtccatccagcagcagcatttgtgaagcagccacagcttcacatactttcttcctagcagccctgggccccaccagctcctccctgcccttctagtgtggcctcagaagctgtctgtccatgaactggctgtgtccatctctgcctgcagacgctctgtgccgtaccccatgtcttgcctgccctgcttctctctacatttctgaaatttgccctgttggaagccccactaaggtcctgccttgacccctgctgttgactaaagggctgtcacgtatttattatctctgccaattcagtgtataggacccatgttttatacccgcttttccccaaaccccagacttaaataaaaatgttcgttgttagaaatgactctgggttggtgatgtagagatctataacttgtgccagtttttaagtattgccttcctgctccaaattcaccctcagttgcctgatctctgaaaatgggtctgggccctttaaatgttttttctttgccttttgtaagtagagggctctgaaggggaccttgtaggaggaagggatttttcttcctgatttcatatgtgtgcatgcgcatgcttttcctgcactcctatattcctgcagggcacacctttctccagcatctgttgctctgttttctgcagctctggcatcggtggtaccaggagcctaagactgggtggtccttatccaacccagatcattgcttcctacagcctctcagcccccatgtgtgtaccccaagcccccctggtgctggccatctggtgagctagccacctgatctttgtcctcagcacaaccctaagctgctctggcctagggtatacattgacgtggtaagctcctatggagggaggcctcttcactctggtccagcagcacctgatgactccctgtgtgtgcccctccttccttctgtctgcttgactgtctacacccagacttgcttgcctgtaccctagagggttgcccctgctgcttggtgactgtgggggatctctggcctaggtacccaggagtttttctgccatctatactttcttcaacaaactcagaaaaaacccctgccctaccaaattttggga

SEQ ID NO: 94545 - DNA, 1037 bp, Homo sapiens
aatgtgcttcgtttagggtttggtggaaaaggcagacccctgaagagctattggaggttgtatcatcccattttacaaaggaggaaagtgaggcttagagaggtcgggtaacttgcctaaggtcacacagccagtaggtagcataaccagaatttaatcctggtcctgtcactccagatgccaaactggttttccagtctgaaaatggatctgggacatctccatcctcaaacgtctgctacccttatttttaaattgcataatctttccacctagacctaaaaccctctttagtttactaaaggcagggcagaatggcctctgggagggttaattcccttctcctcttttcctcaaaggttctgtatgtgtttatttgaagaatacttctagtggctaatttgatttgaaatgatgaatatcatttgagaaaatcggccacactgggctttcggggggttgtaatcagtgggggccagaatatgtcctgccagatgctttgatctataatgttgcctgtgggactgtgtaggtgagtagattcattataaatacgtttcccttttaatttgaacatgaaggctaaaagtaatggctgggaaccaaattccttaaatctagctgacaatagttctgtgacttacagactggagagcagaggtagaccatcatcttagctgagtgccagcctcttggtgagggagtccagggagtcctgaggctcccttgccccggtgaaaacccaggccaggcctctttccgcaatcaaggaacaagctgtaggtgtggcccagctcttctggtcccactgagctgctccactcacacccttatcactccaccatctgccagcagtgctgggagctattctctcccctagagccatttagctgcaaactgtctctgtctctgtttatccgagcagaacctggaaggggctggcaaggactaggcaacagatgggacagccagagaggtgaggacttaggtaaaccactcttgccagactcccggaggtggtggggagggaaagggca

SEQ ID NO: 94546 - DNA, 1959 bp, Homo sapiens
gtgtagtattttatctagattgtcacatagtttcagcatcatgtctactgttttgtaagccatttttcagctaaggttttctctgttatactgtctttctaaatattttcatttcattaaacaaaaccaactgaagtttcaaaactgttctgtccctgttggggacaaggtaaaaagctaaggttgctttgtgtttgtatatggggttttctcttatttctgttacaacagaaagtctgtgtttcacagcgagagtttataacatcttcccccagctttggggtgagttttcttaaattcttcttacgcaatgtaacttcctgctgaagaaaggacattggaattgggttttctgtctgcgatgggaatgtttagtcagatatttagagagctttttcccacagatatttttatgggggtcactgctttatcctcctttccatgaacttggctttgttctaagagcctactagaagccgagttctcatgcaagacactgtgcccaggtcacaagtgcacgatgacatttaaccttgatggaaatgtgcagttgagaatcttgttttctccaccttcctcttcagattggcttgaaagaaataccctttagcaagtaatgggaagagttgcctcaaattgagcctttgggaatctgaagtcttttacaagaaaggctgatctgtttcctgaggtggggctgggagcttgtaggtgcccccatttctctttctttggagcctctttaactatcaatgtaccatgatcccgtgccataatcagcctgtgggacttcactgttgacctggtccaggtaactagaatgtggttgagcctcatagaaaaaagagatccagagagtcctggattgggagccagaaggtggtcttgtctaagccttgtcacgtaactcttccataatattcaggcaaatcatcagtcccctctgagcttccattttctcctggtaaagtggcatcccgtgcaatgagaaatgagcaggaaaatgccctgcgggctggaggccttgagcacttaaatgaaagttgagggtggtgttcccgggaaggccattcattagtccctgtgtcttgagccaaggtgatgtgagaactgtaccttgacgtggccttgattgaggaaataaaaggctgaattgtagcagatgaagttggaaatcttgccaggggtcagcaagcttattcctcaaagcatcctcaaaagaaggattggtgttttccgtgatagaggcttcaagtggttatggctggattccagttattcatggcctctcccataatctagatgtataaacttgttaaattatctggagtcatttttacatgttattcactctgtatctttcctaggagaattagctctggaagttcacagcctcctatgtaaagtactgtgcttcccttttttcttccctaagctgtcctcttttactccagaaattttggtaaaggtctattaatgtttaaatccctttactgagttaaatttttgccgggtattaagctgttcatagtatgtgctgttttttcctgagtagttttgctctgtcacccaggctggagtgcagtggcacgatctcagctcactgcaacctcagcctcccaagtagcttggactacaggagtgcaccaccatgccttttttgtatttttagtagaggcagggttttgctgtgttggccaggctggtctcaaactcctggcctcaagtgatctgcccacctcggcctaccaaagcaaagtgctgggtttacaggcgtgagtcactctgcctggcccctttgcaaatctttttcttcattgtagtttttcaccatcacacatttcctgttgcccttccttccagactaggaagggcctgagacctagagacagcagtactgggtcaagggctcactttagcattaggagaattgtcccaagttagagagaaccttttctt

SEQ ID NO: 94547 - DNA, 1339 bp, Homo sapiens
ctcttctataatattcctacttcccataataatgactgatttatttgtaattcaggtatttataaacctattggctacaaagactttgttaaacattatccagtggttttcgtgaaatggaattatgtttatttttatgggatttgggtaaattttaaattgtctagaaaactgaaatttcagttgtcagttgtggaattcagtttttcaattgtggaaatttcctgccaccccaacagtatttttgtgtgttaattaattttgcaaaatgagaatcatggtgtgacactcatctaatttatcttgttgtgatgttatggtcataataaggagaaagagggtttaatttttcttgtatttggtttcctggtggtatcatagtgtaattttagtatttgaaaatcagtgtgattccttaatggccaactgaagattgaattgccgctaacaaccatatcgtgttagtgaattttcaatatggaccaggaaggcatatgtattttgaacttgagtgaaaaggttgaagttacagacttttgcatagatggtttgtcaatttaaaattccagaatttattattgccatattttcacatgctgcttatacaagattattattgagtagtaactgcttccctgtctatgtagaagtgcctgtgtttttatttattgttcagatcaaagaccaaaacattttcttaaatatattttatgtaatattttatttgtatacagtgttgttgatgaaatatttaactagagcatgatattttaaatgttaaggtgtaacatatgttaaataaaactgttatttttgaattttaaaatttgttttttgggggtatgaactactagagtttaaaattctgccaaactattacttatatgtactattgtgtaacatactttcttgaaatatttttgtttatagaattgaaggttcttatcagatgggatactggggactataaacaatggaaataaagccactgtatttttaattttttgtgtaatgtgtaatctataatccttttgtttcccatatttgagaacatttttccctgaaagaggccagtttcctccccagaaaccattacagtagtgttgaactatcactgtctctcagtgcgtcatccatctttgcatttaaaatccccaaagtgctttcccatttaaagtctttaaagaaaagtgagaatatttatttatgcttccattttcagtgagtataaataatttaattagggagtggtgtggcattgtaaagattgtgttatcctaagccatttctattttggagtttgtagccacaaagatgaaatatagaatcagccttgact

SEQ ID NO: 94548 - DNA, 1001 bp, Homo sapiens
acaggcaagagccaccatgtctggccttagtagattgtagaattctgccggaaccatcactccactacaaagccaatttggttttaagtcatgatgattctacccgccctctagaaattttttattttggccctctttttttctttaaaaaatttctgaaacagtttgttctctgattgctcctctttccataggagcctgttcttcatggatgtaaggactgtgtataagaaaatgaattagagttttttttttttttttttacaattcttatctcagggattaggtgagttgttcaccctaattcttatggagaagaacaaatactaagtgatgcttggtcctttaatgcaggactgaactgatttgtagaagttcctaggaggtgtttctttttctgggctgtttacccacaaggccacttcctacactggaaggctgggtgagggtcactgtatggacgtatgtcctggcttcctttcagggactgagcaggttgggggcaggtagacttgaccccagatcttggagctgcctttcttccctttgctctgggtctgtttcgcggtattctactcagctgcttcaacctgaaccctctacctccccttcagtttagggagcattccttagcaggtaagcatctgagctcacgtgcacttaacctgtgtgtttgcgtgtgcgcatgtgcgtgtgcatttgagtcttgaagagttggtgaagccagccccccagttagtcaccccttctgcctcctccaagctgggagcctttccagagaagtcttcctgtaacccacatcccgtgcagccttctccccatcgtgtgctgggctgtggtttcctcttccagtttgtccattaatacagtgccggatgtttcccgtctttcacaaaatgaattatttctcttggtggtattgtcttcactgccagtgcggccttgggcttcttcattatatcttttgttatttagatagggaaggaggcaaacacttctga

SEQ ID NO: 94549 - DNA, 1047 bp, Homo sapiens
gttagtagagatgtgggggtttcaccatgttggccaggctggtctcaaactcctgacctcaggtgatctgcccacctcggcctcccaaagtgctgggattacaggcgtgagccactgtgcccggacttagccttttttccccttttcttttttttttacaattttttatggggcaatatttcatcccataaaatagaatgagtgtcctccctggccttttcactaaaatgcttttatttgtgtcactataaaacaagtctgcaccctatcagtttcctatgcctttgtcataaagttgtaaaataacctaatgagtagtaaatagcaagttagacaaaggtctacacccctagaaagtcaggtaattccttgaacaggcctgccagacaatgcccaaggctgacatgactcaaaggacctgcaggaatctctgctccattttcaagtcttggacaattttccctaacaattttcctgttcctatttcccaggggaaaggaaacaggaatgtgaggcccacagctgtgcccagggaggaaatagtgaactgagctatcaaagaagggagaggcccagggatgtcctgtggtcctaaggaagctagctggtctgcatcccagcaggacatcagtggttttgaaaaatataggcattcatagaaaagatagcaggaaagaaaaccagacagggctgtctggatccacagaccacccagatcatcctcagacccaccagaatcattcttgccccagggttccagacccatggcaggtggcacagcctgggacctggcctctccctctaggtttcatgagcactgttccaactgccatgacttcgggtgagtccctcagcctttctttttcttttctttttttttttcttttttttttttttggagatagagtattgctctgtcgcccaagctggagtgtagtggcatgatcttggctcaccacaacctccccctcccgggttcaagagagtctcctgcctcagcctcctgagtagctgggattacaggcgcacaccaccacaccgggctga

SEQ ID NO: 94550 - DNA, 1010 bp, Homo sapiens
gccccctcatcaggcagtgcctacccacccctcatagaaacccacatgtacagagggactcaggttcaaggccttctcttttttggttgccccgtagataagcactcatggcattttagttttgtaagtttcacagcagataattacaggaaaacagataggggatggtcaaaagagcaaatcccaggaaggtgcgaagtcctcccaggctggtcctgactttctgggaataggaagtgttactcctgaagactgtggcgattcataggacttttatattgaacatgggaccaggacaccgagaggcaggtcagccctggagaaatttcagccagtgctagtttcctgtcaggaagggcaggggagaaatgggcagcttccactcttcacaaaggatagcagtgaatgaactccactgctacagagacaaacccctcaggtcctggctgaagacagacgaggcagccagcaatctcagatgccttacctatttccaggggacagggggctggacacagagaggagggtcaccagcctggcacagagaacacagagagcagaaaactgagccaagaaggctgccccctccaagtgtttacctgaaatattcacaaacatgatgagtcacagaaagaaagcagaaaaaccagtaagatgtgtaaccagattctcttccacaaagcaaggagaagttgtggcaataatgccagtgggcacggtgtgctctgctgagggccctgcttgagaaacctgtgtctccaccacactttcggcctcagctaaggttgagaagggaaactgacaactgtgccagggcaggaaagtccctgcaggaagcctgctgctggtctgggttaccagggcaactggcagctgctctcttctcttgaaagagaatggacttgggaggcccagatgggctctgccctagtagcccaaataagaaggcttaaccttagacagcatcaaataacatcggagtacgccgcccccacagcacttcccatgca

SEQ ID NO: 94551 - DNA, 1040 bp, Homo sapiens
ctaggaaagcccctttccacttcacccctgctgggtgagccctgtcctggtgctcttccacgtgactctacagaggcagccagcagccttactggctggctcttaaagaggctgcggtttggcccagggctgagcaaagagagaaggccgtgtgttctctagcctcaggagagctgggggcagggtatgccagcacatccctggactagcctacaccctgtcaggttttcaaagcatggaaaagaccctaaaaattagaagattgggaccccacatcttcgtttgacatttagcctgaagtccaagggacagtcatctttggccccttaaaatatcagtgacttccagtggaattacagttggggtcctgacttgagctgttgatgtttttgtcacatctacgtttaacctctagattgctagatagaactgtgtgtatgtgggtgcatgtgggtgttgggggagagggttgtcacagtggactgagtgttcaccatagagagaacttggagacacaggggagaaccaaagagtaaagtcccagactgcaagacccttatggttcagctgataagcagacagtcccatatatgtgcaagaaaccaaggatgcttgtatttgtgtttgccagcaaggccgattcagggggctgaagcccatcaagtgtggctgtcagagaactgggggatggctcagaggtgggaggggactagctagaggcatggtagctagagctagcagagtttgacagagccaagtgttgtccttggaacaagaaccaaaggtaacctagaagcccacataccccatttctgaatgcagaccatggggtcaattagggtctatgtcatgtcaggcccagcaatggcagccacccacctcttttaccctctgtcattgcatccccagatggccaagccaaacaatacctttactgttccaggaaatgtacaaatgcatttgatgatatttcaggtacacatttaatttttagttagcataaatgtgtacactatacaggcaacacttagtacagaaga

SEQ ID NO: 94552 - DNA, 1048 bp, Homo sapiens
gaaaagaaaagaatgggctctctctgggcactgtatgggttctcttgcggccacttgaatgccagtgtcgggctcgctgacagctgggtctgcagctggctggttttgtctgttttttgagggacagtcagggatagccactgattaaatcaggaacaaaacatgactacacttgcggctgtgcagaccaatgctgctgaacagcagagaacaattaattgccatgttgtggaatgtgtggatgggggcggggaggcagttggcaaatgtaagaatgtgcaggaaaatgtcaagcaaatgctcgtgttcattagaagctgagggagagggagccagctcagtgtgttcccaggacctaccacggtgtcagagctctggccactgcctgcgtgcccagcaagcagccttcccactgggggcggtcagcccactgatgtgctgcaagggggtcatgctttgtcaaataagatagggagcccctcagctcttggggtggcagttgtatccattttcttgaatatagggcacaaaaatgcccattttctatgtatgttgttgcagaaaaaggctggctccctgcaggtttgctgtgggcttcactctaggcactatgcagcatctactgtgatgctctggaagcttgcagcctgactcttatccaaaaaccagacagggagggcattggtgggaggcagcagtccctcagccttccactaccaccaggtaagaagatggctgctcttcagtgatgcagattcacaacagcttctgcagaaagacaggagcgggaggctatgtggatacaggcactcttcagcttatgatggagctacaccctgataaacccattgtaagtaaaaaatattgaagtaaaaaatgcatctgataccctgataaacccattgtaaagttgaaaaatcctaagttgcaccatcataaatcagggactatctgtatgtatttaagctagggaagtgaaatgcattcatatattaaaagagatggaaaagaagaagagcaagaatggtatccaaaggggtctggaata

SEQ ID NO: 94553 - DNA, 1020 bp, Homo sapiens
tatgtgactatcggggcaggttccccgataggtgagaaggaggaagggaggaaaaaaagagaaagaagctgggaatggttgctcaagcctgtaatcccagcattttgggaggtcaaggcggattgcttgagttcaggagttctagaccagcctgggcaacatcgtgagaccctgtctctattaaaaatacaaaagttagccgtgcatgatggtgcacacctgtagtcccagctacttgggggctgaggctgaggtgggaggatcacttgagcccaggaagcagaggttgacatcgtaccactgcactccagcctgggtgacagagtgagaccccctgtctcaaaaaaaaagagagagaaaggaagggagggaatgactgatagtgtcaaatgttactgaaaagtaaaagaaagtataaagaagtaggcatcagatgtagcaaataaaggtagtttatgacttggagaaaaggactgtaaaagaatgaagtacctttcggccagaaccgccatcttccagtaatttgccaaaatgacaaacacaaagggaaagaggagaggcacccaatatatgttctctaggccttttagaaaacatggagttgttctttggccacgtatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaaattaagggcaagattcttgccaagagaattaatgtacgtattgagtatattaagcactctaagagctgagatagcttcctgaaacgcatgaaggaaaatgatcagaaaaagaaagaagccaaagagaaaggtacctgggttcaactaaagcaccagcctgctccacccagagaagcacactttgtgagaaccaatgggaaggagcctgagctgctggaatctattccctaggaattcatggcataataggtgt

SEQ ID NO: 94554 - DNA, 1042 bp, Homo sapiens
cagcaaggagttgtttcccagtgctttttgcattcctggctgccaactctggctgctaaagtgtctgccacctgctacaatttatgatgtttctctacgtgatgactgttcatttcttttttcattatcttttgtagcaacaggggtctcactgtgttgtccaggctggtcttgaacttctggcctcaagcgaccctctgccttggcccctcaaaagtgctgggattacaggtgtaaggaccatgcccagggccagtttttacttaaaaatttttttcctgtcatgattttaaagaaatgaacctaggatcttttcgtagtgtgtaattttcatacattattttgttatcaaatcttgatttacatactttaaaagttgatttctaaaatgaaattttaagggattatgtgaggaggttctgttcttatgatttagtttagtttcaaatgagttttgcaattaaaatgcccagggaacttaaaattaggcatttctagaaatgtgctattgatgcatcaaatgtgtttgttctgattttttaggaaatttcaacaaaagagccactgaacttgttcactgcatgatataaaaatagttcaggaaaaattgcacaaagcattttgaatactcaatagggatgttcatattctacattaggacttttgcacatttgttaaaaggagtggaactgagtttgaaacagaggcagtgaaattactgcaggatgtaattgtacctggtatttgtcttatgtatcactgttatagtgatattttttggcagctttgctaaaaggtacctgctgattttctttagtaagtttggtttattaaaacattttctggttttattaatccgggtattgttatttcgaaaatagttttaataaagttttttttttaaaaaaaacctataaaatttaactttaattataacaaacactttaaaatttgataacctgcctatgtctgaaagagtttgtcagcctaagaatttaaaataataccatgttgactaatttagggatataaatagaatgat

SEQ ID NO: 94555 - DNA, 1027 bp, Homo sapiens
tgattggctataataatgttttaaaaaccacaagcattgttcatgagatacagagatgcaaaagtagtgaattcatagatttaaattattttgcaagtgccctttttatgcttgtttacttcacattaaagggaataatgtgttagaagtatggtgttaatttatggagaagatatgtgtgtgctttttttctttttaaaatagaccagttctaaatattttattttacttggtttgtccctgtgatttaacttgctaaagtattgttggaaaaggacatggaggaaatattagttatgcaaattaggtcacatctgtagttaacatctactatatttgatagagctttattgtaacagtagctgctttatgtagcctaaagcagatgacatttttgcccttttaaaggcgctaaaatgaaactttatttatttaagataaattatgtttaactttttttttgtttggcaggcaaccagataaactggtggtagtttggaccagaagaagccgaaggaagtcttctaaggttagtgtattttctaaatttcttacctaattgttgaatacaaattagcaaactgctctggttccagtgtagaatattttaaaatattacttgatgttttgtttttttttcttgattgtctactgaaaatggattgatcagatgctataatcttttaactgcttgttctcaaaacgggagccagatacctgagttttggtcttggatttggtaattactatggtttgaaaaaaatcaggtgttgccaatgtaatagaataggttggtgcaaaagtaattgcggttttgccttaaaagtaatagcaaaaactgcagttacttttgcaccaacctaatataaggaggtggggggcctttaagaagtgattagggtaaggacttctcccttgtgaattcaattaggcatccttataaaaggacttgatagagggagtttgtttcctttttgccctctgccttctgccacatgaggatgcactaagaaggccctcaccagat

SEQ ID NO: 94556 - DNA, 1069 bp, Homo sapiens
aaactgatgctgttctttatctgccccaaataaacattacagtttagtgggaaatgaacttaaatgcaaagttatacagttagttttttcttttaaagtatgaatttgtcttaaagttcctagtccacaaaaataatttttaaaatatctcttctaataaaatactttaaacagatagtagcttttgaaaacatgagacatcatgttttcatcatttttgcatgttcttctgtgtgtatgaggggataaagatttgtttacagatagtaatctgtagctgtcatatgatataactatcttggcccaagcttaatgcttgaaaagttttatttgattaagcatttttgtttcagggatactacatagggtcaatataccattgtaaattactaacattgcatttcctgtacttcatattgaaggtatcattttattctggtaaattactaacattgcatttcccatacttcatattgaaggtatcatttttattctggtaggcacatagctggcaacctggaataaaaaatccctatcgtggtgttgttgtgtggcctgttcctgaaaacattgaaatcactgtaacactttttaaggtaagttccatttttataggctatagaatttattatataaccagggtaccaaatgacagaatatttcagtgttcattgttctatacatttgtgtccagtctggtacctactgtgcattatttttagggacatagcaatttataacaatgcaaaggaatcacagtatttcatggtttataaagtcggggatcttcttgaacttattacaattcagatcagctgacatagttcttttaccacttcctacactctacccacagaaaactgtaaaatgccttccctgtggaaagctgaggagtgtggaattctgagtcttgaccttcattttgttagccttgtttgataaaagaatgctttaaaattagtatattataaatatcttattaatgttaatgtaacaagatgtgttttaaattgatatttgataaatattttattgatattagtatttataagtgttgctgcttaaaggc

SEQ ID NO: 94557 - DNA, 1108 bp, Homo sapiens
gaaaaggaatctgtttttatgtcagaggaactatctgtgaagttaaggcctggatttgaagtcttacttgatatagttttgtacacaagtcttagaatgtccagatcatatgtggccagtatttcttatctttgctctcctaatttccatcctttgtttaactctttctttataagttgttgtcttcgcaatttaagaataaaacagagagctgagaactgacttcaaatccagccttttcttctcttttctttagtggctggtttctaaataatccacagcattttcccctataaatctttatttttcttcactccactctgtgttggtggacatgattagtgaaaatctactcaaaagtcagtcacaatatggttaaattatattcctggttttgactgcctgcacccttaaatcaaaataggtgttgtgagaaacaaaattgctacaactagtatttcttggtagcttgataaatagttttatttagaaaagtgattttataaaaattatgaaaagatagaatagacagcattttacatttctcactaactcttcttatgtattcatatattaagtaaacttttcttcaaactgaatattgtttttaatcattgtacatgtgaaaagtaaaaacactttaagtgactatgtgtcagattaaatttgggtactactttcaaataccctaaatttgaggaactccttttgcaatataactttttattctgattgctcaaaatttatgttttttaaaaaagtctctatatttaaaaattagataaaataatcatgtttgcttataccatatttactattgaatcttctttaaactttttatcatcttactgaaattaaaatactaaacagataagtcacaaagcctatttttggataaagagagaaaggtattcagcatttttctagtttctaaaaaggtggaaaaactctacacttcaaactacttaaatgtttttattgtttgtgagcctaaaacatgtataaaccctttcttttaccacgtgtgtatttaaataagtaacacttcatatcttctccatataaagtgaaatatttccttaacactaacacaagttggttctcagcc

SEQ ID NO: 94558 - DNA, 1043 bp, Homo sapiens
ttttgcacactgtattttagagaattatactgtaactatatatgactgttcagttttaaattgtaatagttaattatgacttttaaacttcggaaagtttaaaatatttttatcaccctggagctgaaaagtactttaaaaatcacctgcctaccttcctgctcttagacaatgctgtgcctaagacatcacagaaagctatggtaattacctatatgatttttttaatctaaagaaagaagatcctacaaattgccctgaggcaagctcaacactacacaaatatttaagtatttgattatactggaaactatgaagttggggcatcagtatgaggacctgaataccttcttaccctcgcctttgaattacctatagggggaaaacaactctttaaaaaacaacctaatctactcagtacaaaagcaagtatggcaccagaatatgaaagttcaaggaaaaaaagcgtgtactctaacagtggtgttttatctatatccttcaggtaattttggagttgggcatataagctgctagaatacctacctggaggaggagatgaaatgttccatgtggccaccttgtctcctttagagactgtcacattcaaagtatattgaccacattaaaagtactcgtggtagaaagcaaaggtgctgtttcgtcacctaaaggtgaaaacgtgctgtctggaacttcgaaaaactcaagtattcaataatttttatgccagtcatgtccagcccataattgggtctttcgtctccacctctctgcataaactgaatgtcccttgtccttttttgtagtgatggcagtgatgatgcttgaattttgaagccataaatgtgatgtgttaaccctaaatggtcctcatgtataggagtgtccttgaaaaaaatctcatctacctcatgatttaatatgatatagtgtctctggcagtagataacccagcttttctttctttctttaatgttacttgtaacaaaatctttagtcaccaaatctagtgactctttaaagaatgttaatatcagaaa

SEQ ID NO: 94559 - DNA, 1259 bp, Homo sapiens
gtaataacttttttgctcatgcaaactttgtgtcactaaatttattttaaaaaggggaaatgactttgttaactctaaggcttatatgagataagatgcaaagaattttttaaaaccagtttagtctgtaaagccatactatatttagaagataacggcgtattaagcattactttacaaagaaacagtatcttaatttggctttctgaatttgggggaagtatagcaaagtaaaaattaatttgtaaataatagatacatatttcattcactgtagtttatttgaaatttaaggtgaaaataatacatgatgaaaatataaatgatttgactttgagtacttaatgtaaactttataaatttgtacttaaaatacttaaaacatttaaaaaaagttcagatttatcaaatacatggtatttaacatacaatcatccaaggtagttttttttatcttgtagctcttaaaaaggttagactttgtttttaaagtgcttttcctgctataatagtttcttaacttttgggcggttatggccctgttggaaaaacaatatacttaagcaagatttaagtgtgatttacaggggtttgccactttgtttccctcttacccacaaactcaaaagcctacgtggacttcagatttaaaatcttgttctaattcctttgggcagtttgaatatttaaactctagatcttatctgatttgcaaactgtctcactgtttttgaaacaagtttttgtttccagacttaattctcaggaaaccatactttaattccatgaagaaagttttaggccaggcacagtggttcacacctgtaatcccaacactttgggagcctgaggtgggacaatcacttgagaccagcctgaacaacatggcaagacccccctctctacagaaattttaaaaattagctgggcattgtgctctacacctggggtcccagctactgaggaggctaaggcgggatgattgcttgagcccaggaagatgcagtgagccatgttcacactgctgtactccagccagcctggcttatagagtgagaccctgtcttaaaaaaaagaaaaaaaaaaaagaaaagaatattttagtcttccatatatatctacagcacagaatcgaactaattcctaaccagttaaattttttaaattatgttatttcaataaataagtgaaacaggtggtgtttggttgcataggaaagttctttagtgatgatttctgagatattggtgcacccatct

SEQ ID NO: 94560 - DNA, 1123 bp, Homo sapiens
tgatcacctgcctcggcctcccaaagtgctgggattacaggcatgagccaccatgcccggcacatatatcttcttttaagaattgtctattcatgtctttagcccactttttgatgggactatttcattttttacttgttcatttgtttgacttccttgtagattttgggtattagtcctttgttggatgcatagtttgtgaatattttctcccactctgtgagttgtctgtttactctgctgatgatttcttttgctgtgcagaagctttttagtttaataaggtcccatctatttgtttttgttgcatttgctttggggttcttggtcgtgaactctttgccgaagccaatgtctagaagattttttccagtgttatcttctagaatttttatggcttcaggtttagatttaagtctttgatctaaccagttaatttttaatcttattagctctttactaattaagcatgccatttaaaaattaatgaatatgagtatttagatttttcaatattcttgtgcaactgataagaaagacttattgacataccttatagaaagaaggaatttattgttttcttaagaaaccatcatttttctaactgtcatttagtacaatgtgttatattttgaatcattgatgtagagatgaagacatgcaaagtttggctagtttgatgagtatgaagcaggctgacattggcaatttagatgacttcgaagaagataatgaagatgatgatgagaacagagtgaaccaagaagaaaaggcagctaaaattacaggttggttttattagcattaaactaaaagtttatcttttgttgcagagttcaaaaactcattctcatttcccaggaaaaaacaattctacttattgggtttctttttttttctttaagcctttctacaataaaatataccatttagttctctgacaactttccatgctgtttataatagattttagcagtttgagatcaagtacaaggatggtcaaaataacaaaaaacattcttgaattataatacaaagcaacctaaatctggtcatacttattttgtcaatgtgtgaatgaaacctctgtaagtaaagatctgcctgtaaaggataataggac

SEQ ID NO: 94561 - DNA, 1558 bp, Homo sapiens
acagcacagatggtagtagaggagataccaattacatattaaggagctagagttgatgatggtatgactcagccctctgagattaaattctacttactagggctatgaatggagataagtaggtatcccaccttttattagaaggttccttaaaataaatatgggactctggtcagagagtaggaccattaatttgctcctggtttttacctggcatccacccaccagtacctaggcatctcgtgaacaaaatcataggattgttatgggctcaattaaaaaaaaaaaaaaaagattagccaggcttggtggcatgcgcctgtagtcccagctacttggaggttgacatgagaggatcgccttagccaaaaaaaattttgtttaaataaaaattaattaaaatggccacctattttggaggtcagttaaaaggatgagaatatctggaaaactgcctctgttatgtagtcactaaggttgggaataggaggaaagcagagaggtagggcaattctgatccctttagccaataagtttataaggtatcatagctaccttatttttaaaggagtttgaaaccctaggatgagagactgacgtcatcaggaatatatctttgcagtcttagaactcaaatatgtcaactcagagaatagtaacagtagcagaaaacacagactataaattcagcttgctttctctgtcactcttaaatgctaatgctgctttatttgtacttatgacactaaacataatctagcttccctgacttctgaggctctgggagaattctactgatgctgagaacccatctgacagggcttggatgggaacgagggctctaaaaaagaagtcagaagccttccagtatttaggggaggagccagaaggcaattaatattcaaagtacctatatgagttcactaaggatttatcctaggaattcaaggttagtttaaccacattaataaaggaaaaaaattatatagtcaattcaacagatgcagaaaggaacatttgacaaaattcaatgccaagtttcttagcaaagtttcaatagaagagaatttatttattttgataaaggacattcatgaacagctacagctaacatcatatttaatggtgaaacattgaatacttttcccctaagattgggaacaaggcaaggatgtttgctcttaccattcaacattatatttgaagttctaccaaactcacaggatataagatcaatatagaaaaatctactgtatttttatatatgaacaacaaacatttggaaaatgaaatttaaaaaatttcatttacagtagaggtaaataaaaaacagactaagaaataaatttgacataagatgtgaaaaacctctgactaaaaagtataatacattactgaaagtaattaaagaagaccttaataaatggagagataacctgtgttcatagattagaagatacagtattgttaagatatcatttttcctcaaatcaatctgtaaatccaactcaatgccagtcataatcctagcaggtgttttttaaaaataaagaaattc

SEQ ID NO: 94562 - DNA, 1050 bp, Homo sapiens
cgacattatacctaaaattctgtggaacaatattaatgttttgaaggtaaagactaactctaatacttcttctatattccctgcggtgctcaaatataacatgtttaataaatgattgatttcttctctcattaagattacttttaggaacataagataattaaaacgtcttagctatataaagaaaagtgcaaatacttgagcactgtgtaaacattttttgacctattaattgcacatataggaatataggactaataaataatactaagatacatgataaaatgtggataataatacttctttggttattgatgagaattagctgattgtggatgcaaagcctttcctactgcttcataattaactgctattatttctttttatattttatattttcatagttattcatattttatgtttacaaagttattcctgtggggcaaataaataatactaatatacatgataaaatgtgaataataattcttttttgattatttatgagaattaactgataatggatgcaaagcctttcccactgcttagtaattgttagctgctgttgttaatatttctttttatatgttcaaagttattaatatttttaaagttaaaaataaatcatttgtaaattttgaaaaatgcccaactagtaaagaatgaaaaaaaaatcagtcatgagactggtaatcacttaacagtgatcctacactccattatatttttcctaaaaattacaaaattacagtgactgcaagaggcaggtaaattatctaatttatgaattaattctacctactgagaaattagctaggttaccttgagtcagagtacgatttaaaactattggcaaaacaagatggaagaagaaactttgtaagtctgactatttagctcctactgttcaaattgggattaaaaagttcaattggtattaattgcgtttactttctgttttctatggtttactttgactatctcaagcaattttggttatgcaaaatatatttactcatttagaaaagggaagttgataagcttatcaac

SEQ ID NO: 94563 - DNA, 1427 bp, Homo sapiens
tttgaagatggaggaagggggtcacaagttaaggagtggcttgtagacttctagacaaggttggcttctagaagctggaaaagggagggaagcaaattcttccctataggctccagaaaggaatgcagcctatcgaacttcctaattttagcccagcaagtcttctgatccccacaacagttggataataattttttttgttgctttaagcaaaaaaaacctctttacttaatagaaaatgcaatatctgggaagtgcaataaaatgtggtatgcctgtaggtatttgttaagtctgtttccatgttaatttgtgtctctatagatcgtaaattccacaaggacaataccatgtttgtttttgtgtccgaagaataggtcttggcacagactgataaataaatatttgttcaatacatgaatagttgcaggcagccatattataaatgcatattaaatgatttagttcaaataaaatttaccatgtgcccttaggtttacaatgttaaagaacagtacttttaatgtcaaatttacaactgtgttctacttccaatcgttttatttctttcctactgaataatctggatctatttgctgtatcgttatacctaagctattcctaggttgtaactttggaaatatcaggaattaccccgtagtatcctaaaaggttcttatttgagtagtctaattttcacccaatgagtgataatttcacatattcagagttgttcaaaatatagatgactcatgtaaaaaattgtatcttaaatttgtttctctgtcctttttagttctcttttattgtttttattataagatttttctaaagcatatactctaaagttgccttaaaagaacagatcctattaaaaaaaaaacagtagtagaaaatagtaactgttgcttttttcttgttttagtgccgatttttaaaatgcaacatgaatacatacttattatgtatataatccatgcatttatattcttaaaactttttgtttaaatttagaatataaaacaaatgacaaatattttctgtagtatcagagtatatatattttgttctgtttttaatatatgtgtttaaagcacagctctattttgtaaatgtgaaatgtgaaaaccagtgtcaacttctcgggttattatctcgttttgtgtttattaacatagtttttatgttactagtatacattttaacaataaaatgctttctattttaaaatatgagtacagcataacattcagttaagcatatctgttatgggttcatcaaaataacatccaccgaatgtattctgttgattaaccaaacatctcctctttgtctttttgggtaacagcatgctcctacttctctttaattaaatgaccttaccttatatttgtcttgactggcttctgtttacagaaattgtaaac

SEQ ID NO: 94564 - DNA, 1425 bp, Homo sapiens
ttagcaaagtcatgtcaggatccttgatagacagtggttttaaaacattttctaagataatacttggtcatacaacatgctacttcttcagtgtgtttatatattataaatatattgtttttagaatatttgcttatcataagcccatttcagttattcctgtttgggagtgaagaatgttctttctaaaagtctatgtcaacactttttttattggctcaaattaaattgacatggaagtttctttagtacagttcattatctgacataattttcaattaatactcaaatgtttgttttgttttgtttgaaaatgttggtatgctacaaaatacttgaatggcattctgtcattggtaaaatgctatatactattatttgcaggtattattcgtgtgaacttttaccatttgaaatatttcacgaatgttcaatacttacacttaaccataatagggaactaacccatatgtttattttcagagcttatcaacaaacttaactttttggatgaagcagaaaaggacttggccaccgtgaattcaaatccatttgatgatcctgatgctgcagaattaaatccatttggagatcctgactcagaaggtagcaagtttttctgtaattttaaagtctttgtatagtcaagttgacttgaactgtaagggcaggaaaatattttcttcagagactaacacacaaaaaattattgtttataatgatattattattgtgttcaataccacttggagttgatcagcaattctgggtcacttctatggaatggcttttaaagaaaaaagaaagccttacgtaaacatttacatggggctttacaagtctcattcgtttggtctaccaagtaaggtcagaatgtgggatatactgattttgggatggtggaggtagcttctctatatggatcattttccctgacactcagtctgttgagcccttctgccccaactctatgtctctctagccgagattctctagcagagaattagtagtgagagtgagttatgcatgtgaaaacatggagcagagagtaggttaagaaccgctgctattatatatatatatacagcatacttgtgaggtataaaaccagggattttttttcctgagtcacttttcttattaagtagttttgaactcataaagcctggctaagggctgttacagaagtgagacttctgtttaattgaactctgtatgcttaacataaatgcaagaatgattaactactgtttacatctttttttgactgtgtctgagaaatcttcatgaattttaaagaattttgctactgcctgtcatggtgaaaatgaggttttagcttcaggattcactctgttatagcaatataatttcataattctttctctgtctcctcttcctttaccttctcccttcttaccagac

SEQ ID NO: 94565 - DNA, 1266 bp, Homo sapiens
tatgcccagccttaaattttatttttgaattgaggtcatgctctgtcacccaggctggagtgcagtggtacaatcatggctcactgcagccttgaactcttgggttccagccatccttccactgcaacgtccctgggaactggcactacaggtgtgcaccaccataaccagcccatttcatgttcttttaaaaacagaaatttattatgtatcggtttgtaatggcaagctggtagactacaataaaagaatataattttgcacatctaagaaaacattttcaaaattggcatatcataatgttaatactgttagatactgcagaggatctcaagaaacagtaatgatccaaaaatgccatttttgggagtaccattcctggagaaattgacagagattttagatatcacatcttctgaacattaagactacttagcccctctaaaatatattattgttttattattgctttgctctttctcagccccatagagcttattaattcaataatgcatatatttgagaacactaaacaatattagaaaatatcatatggtattcatgtgatttaattcatctgctattattttatagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgagtaagtacatttcattttgctgtcatcacaagttagtctctatgttacctaaagagatccttttgtaatgtacctttagatgggtacaaatcattaatgtacactttataagtcagtatctaactcgtccactatctgagtgtttatagtcttaaaccttattctcccaccctcttccaggtatgtgtgtgtgtaccctaaactaacaagtgaggaagatatattcctagaatctctggttggaattccaattgtgtcttctcacagaaactatattataaatggtatttaggtttttggtttttttttccatcaaactctgtagacattaaacttcagttatcttataggtctgttggggaggagaacaaaataatcatttgtggtattgatttgataagaagacttgtttagataccaaacagtgaaat

SEQ ID NO: 94566 - DNA, 1390 bp, Homo sapiens
cgaaggacaaagaaacaaacagaatgatccctggagtttgccccagaccaagaataatttgtgttcccaccagccagaaagaaaagacttcctaacacatgggacattcagtagaggcctcagagaggtattgcatcagttgtggggccaaattggccctaaactgaaagctgttctaggcctacctaacaaagcttaaaggcaaggctcaaaagaatcaaacttatctcaagtaatttaactgcatcacacatgaagctcaaaacagttttaatcaataccaaaaactccagcacacaaaacatgaaattcatactgtatgacagccaatcaaacatttatcaggcatgtaaagaaacaagaaaatctgacctgacccataatgaggagaaaacataatcattagtatagatgcagaaatgggacagatgatggaattaaaagatcaacctggtaaaataacttttataaatatattccagatatccaagaaggtagaagaagacagcatagatgatattagaaaattgaaattgaatttatagagatgagatttttcatctcatacaaagtcaggtgaaaaatagactggatgaggttaaccccttgttaaatactgcaaaaggaaatactagttaacctaaagacatagcaatagaatccatccagattaaaagagagaaagaagaaaataacaaaggatcagtgaactgtggaacaacttcagtggcctaacgtgtgtaaagaagtgaagagaaggtaagaggacagaaaaagtatttgaagaagtaaacaccaaaagttttagaaataaaaaaatttaaaaatataaacaaacctacaggtcaaagaagccaaatgaaactcaagcacaagaaaaatgaagaaagtcatagcaaagcttgttaacaaaaacaactcaagccagaagacaatgaggtgatattcttaaaggactgaaggaaaagtataacaacaaaaacctgtcaacataattttctattcccagcactccaaaaaagcaaaatgatactacttgaaaatttggatttacacgaaggaaaaaagcacatgaaatgacaaatatattagtatatataaaatacttgtcttatttttaaaaatctctctggtagataattgtttaaggcttcaataatgtattctgggttttataacatatagaagtaaaacgttatgatggttgtgtaaaggctgagtagcagaatgaaaggatactgttttaagcttcttatacataatgttacttgaagacacttttttcagagttgacaattgtttatatagaaaagcataaggaatctttaaaatgggtactaaaactaaaaagtaaatttagcaaggttacaggctacaatattaatatata

SEQ ID NO: 94567 - DNA, 1735 bp, Homo sapiens
tagatcacaagatcaggagtctgacaccagcctggccaacatggtgaaaccccgtctttactaaaaatacaaaaatttgctgggcatggaggcacgcacctgtaatcccagctactcgggaggctgaggcaggagaatcacttgacccgggaggcggaggttgcagtgagctgagatcacgccattgcactccagcctgggcgacaaaaaaaaaaaaaaaagtctctatatttaaaattaatatatatttcaagtaacctatgactcaagaagaaattataacagaatataaactgtaaattcactgaaaagttttagttttactacttgacatgttgacaaagaagatattacagtcaacttgaactcctgtaatcatttctatgagggctttatgttttacttaaactttttgtttggcactgttttttgatataagtcccaacttgaaaggcttgaagagcaagcctttcgtgtttgaacttggagaagagtctcaaaagcaatcatagcacaattgagttaatggagcaactggatattgtaaaataccttaatattccttttactgtctgtatccatgacatttaagcaagagttttggacatacttttattgttaatagatattctttaactggcttatatacagagagtcagactactgtgggacatgtaaacgcttcaatacctagattaaaagttgtaatctaaggattaatatatatattatatattggctccattagcgctattatcattaaaggtgtgttagcatcctcttcgcagacttgcatatagcgaggccgtttcactaggttttaagtttatggcttaggaaacttttaattttttttttaaacttccaataattagcattcagcagagtgctgcagaaagaagacttttaaagctggataaacctctctaataatgatcttattgaaaagcaaagccagtaattgaaaatacattgtgactaaattaataattctttgggaatgtaaacttataaagtatgtgactttaactggtaagttttgtagtattactgtatagtaaaatatgtttctagtgctaaattccagtttgggaccattcttatacctaaaatgccttgtgaattcaagagaattttttatgcgcatttacatcataattgtttatctgcatttacatcacaatttccaaattcttagagattaatagtgtgacgtaaccatttggataaagatactgaagctatttttccaccaccaccacgtgttattgaaacgaaattgtttagtgtttttctgtgtaactcttcttaaatgcctttttagattatactgtagctaggtgggtgttttttggtttttagttttttgtgaagaccattcacatataacttcttgtggtaaatcttcacaaggaagcaaaacagaaaaggttcatttaattgattagcataaataacaggttttcttttttattttaatcaaaaaacaatttattctttaatgttttcacagcttcagttattaagtagaggttgtcatttggcttgactttaatgaactaaatatatatgtaatgtgcacttatgattttcatacagatgtgaaaaaatttgatcatgtgttattcttattatatatttctttaaaacttgctaatacttttaattctacgtagcaaaactttaccttatacagcagatgttatcctcattgcagcccatgctattctcacaa

SEQ ID NO: 94568 - DNA, 1048 bp, Homo sapiens
atgatgtgtatgatccaagactgggtggaggtgggagacctggggtttaggcaggaaagcatagggattttaaaggatggtgagtaatactagagagtaaatacattgaaaaagatttgggattcaatacttcgaagtattttgacatcattttgtgtgttcttgagaaccattagagactttaagccgtgctttaaggagaacgatgctatgacatgggttggttaccgaggggggatttggaagaagaaagacctattaggaagattttgcagtggtgaaaggagatagattacaaaaaccttacaaaatatgagcaaaactgcctgcaaaattaactagtaagagatgatacatgaaggaagaattcaaaggtgattctgacattaaaaatctaaacagttgggacaatagctgtatcatttgcaaacacaatgaaaatgagcaggttgtaaagaaagatcaccattatggttttgaacacattgagtttgaattttgtatgatagaaaggacagccaactggaaatgtcaacttgagatagtttgaactataaatatttgggaatcatctgcatggaagtaatagttggaatcctgggaatgaatcagctcaaagtgtggtggaaaactatttagagcaatgcctagaggaatatgtggctgtatccgtggaagaagggcagacagcaaaagagaaggaaactatagttagagggatagagcagaaaaaatagaactgacatttcttattaaaatttaagaaaatttgcaagttatttgactaggttttctgaaagaaagctattaccattgttaggaagaataactaggtagctttattaccgttcacatgtaatctgctatgttaaacagaaataatgcattaaaattcattatatttgcaagtgtagttttaccttttatggacagatttttgtgtctttcttcctttggaaagcaataaattacaaagtcagttagagcttcttttttcacccaccttatagaaatagatacattgccaagcattacaagtaccatattt

SEQ ID NO: 94569 - DNA, 2049 bp, Homo sapiens
gcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccaggtaagtgagttagaatgctgaatactatatttagtaattagttattctctgtttttgtttctttttgcattcatagatgctacaaatgattaaaggtgaagtgtaatttctattataaaaactcctgaggcatgtagtaatgtgtgcctaagtccccactatttgggaggctgaggaaagaggattgctttggcctaggagtttgaaaccagcctgggtaacatagcgagtccctgtctcaagaaaagaaaaacctgaaatatacctgctgtatatttaaggtttatgatataatattttaagcctaaaaatcccaatttcaacactgaaggatattgtgtaataaggctatgagaaaaaaattgaaggataaagaatgtcaacttttcaaataaaaatattacttataaaaacaatattctactataaaataaatcaaagatgtttcaatattccatttaataagaacatcattctaaaaatgtataatgccaaattaaatatttcccatttaaaacattttccttaggtattttagttggtttatttagtcccatcattacttgtggttaaaaatccctgcagcatccaaatttctcctcatgaagggaatactgtacggttttaacctttctcttactgatgatattaataatttactgtttttacttgtatctctggtaccatcagttataagatatactaatattttatgtaccacaacaaaaaagaacaacattgtcaataaagttatgatacctggttttcctatcactcagaatttttatagctattgaaagagctcttttagacttatttaggcatagattatttgatcagataacactcgtgtatatataaggaggaaattttaggcaaaataaattgattaaggtattcctaaaagtttttcacatttagaatccagctcttctgaatcactttttgatttagagttgttggtattccttttttttttttctgcacagttatcctctgtgccatcaaaagcattgttacagtaaatggttctcaaagccagatttgggggcctctgaagttctccaagtccctttcagagagcccccaaagttaaagctattttcataataatactagggcattgtttgcctttatcactctcattctctcacaagagtatgatggcattttctggaagttacatgatttgtgatatctcaacagattgaatacaaaagtagatataggaattcagctgctttcttttatattgagatt

SEQ ID NO: 94570 - DNA, 1109 bp, Homo sapiens
ctgatctctgttgatggacagtatctgttgttctccaaaattacattgtaaaattacagattaatccaggagaatactttttcaattctaatattttcaattgttttgttataaggatagtgagcaatggggaagactagttttacttttttttaatgaaatataatagctttgaattttctataaacattctcaaggatttaaaggattatcgccacagatatttaatatttatcaacattcaaatttggaagacatgttgttatcaattctataagactaaaaataaaactctgaactttaaaaaatgtctttgtcagattatactgtgtttatgagcaaatactgagaatatatagaatatatattagcctcatacctaatgagaatatgttctaataaaattataattaaatttaatccagttttagacagtaaagatgtatttccctcatgtcaagatttatatatttgttccacagtttctagtcaacattaatattctctataggtaatctcatgaagctacaatcttattcataatctctattatttcagcagattgtctaacctttcattagtttacaaatgtagattacccgttttttttttggcttctaattctgtatctttgcttttaagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatgtgaggagcattggttaaaaaagaccataagttgttcattgtaatcatggggaggagggaagtaatttgcttgtatttctgctatgttatttttctacggactgtacattgtgaatacttggtgcacttactgaactgataaagataaattcatacttgtaggaccatttgatcattattcctacagagcagtgttagtgatgaggaaaagtaagatctgggaatataatttccacatatacatgaataatctgttttttgttaatttatattttataactgtagttgtactctaagattgtattttgtcaatggaagttaat

SEQ ID NO: 94571 - DNA, 1040 bp, Homo sapiens
aattaactatagaaaagaaagccctctaattaatttcttaacatcttactctattttgtgaaatgtttagcaagtttattttcctctctcttcattaagaaatatgcacgactattttagtgctattttaaactattctgcctgtgagatattaatgacgtagagttttgatactgtataagaatcttacaatgccttaatgagagtgaaattgaaatgtggctttcctttttgtcacaaagtagatattcccatacttgactgattgcttatatgtgtgttagcccttggtcatacattgtgcacattagaatttaaagagtcacttgcatgttgccttctgaaaggattgtcttggtcaccttttctggaagcccttaatgaaactaaatagtttgcttggagtttggacctaaccatcagggtgtttcatgcagtcttgtcagttgatgttcatgaattgacttgaacaaagatcaaagtgtttctccaaaccaagaatctgtgagacagctccttcagttgtgccacaagagctaatcaagccatcagttctttatgcactctacgtgtctttagaatttagtaccaaatgatttgtcagtacaaattgatattctgattttttgcttttctccttcctggctctctttccctatttcctccaaaatgagggaaaatacagtgtctttttacaactagattttgttaagaagcttagattataattttgaaatggaatatttaaagtttacaaatacaaacaagccaagaacaagttaaaagttttaaatcagtgatattcatataccacaatactaaatatacagccaagcttttcagttgaacaaattaacttagagtctgattcttttatttttcttgtcacttcactgttttgataatagaactttgtcttgaagtatttcagttgcatcagagtactgtatttgttttccatgcttagattaaaaggaagttatctgaaaatacctcttagaggggggagttttataatttgaggaaagggaatagttaga

SEQ ID NO: 94572 - DNA, 1014 bp, Homo sapiens
atgagtaaataagtacaaacaaacaatttacatggaaattgataaagttcctaattagtatttagagttggttttattaaggattgactactttaaattgcactcttggtaagctctcagaaaaatttgcagatgggagtattatggggggtagaggaggtgatagcttgcaagaaaaaaattaggttgccatttcatattcagaaaactagaatcatttatttcatcttaactcagtaaaaatgacccttcattttagtttgaatcaccaaattccagctatgtaagaagttattattcactcagtgaaatacacttaaacttagttgcctgaggcatattaaataatggtttttgttagtactcttaacttttcttaagtttggaagatgaaagtttagtaaaagttccattttcctcatttgatcatataatttgatactttgggaatcatatagtttagtggttaagagcaagggctctggagtgaaacagacctgagctgaacacctggctctgacatcaggtctagctgtggaatgttgtgactctaaacttaagtattcttactggtaaaaataaagatgtgaaaattaaatattatgcacataaagcacatagcacataaatgctcaggagatagcagcagccatcatcaaactcaccattatcaatcctgtaatttcttttattcctagcatattttttaagtttagaaacactgatagtggtccagatgtggtggctcatgcctgtaatccctacactttgggaggccaaggtgcgtggatcactggagcccatgagtttgagaccagcctgggcaacatgacgaaaccccatctctccaaaattacaaaaattagccaggcatggtggcacacacctgtggtcccagctactcggggtggtggcagggctgaggtaggagaatcacctgagcctggggaggtcacggttgcggttagctatgattgcaccattgcactccagcccaggtaacagagtgagatc

SEQ ID NO: 94573 - DNA, 1032 bp, Homo sapiens
ctaagacaaatactgttaagagaattctagcgcatttttcaataatcctcaagcttctgcctatatagatgaactaaatgtatgttatttgtaagaatcatcacacctgaaaatggtaatgtgattgaatataaatgtttaagataacttgcatgtgttttgtgccattatgcatcttaccttgtgtaacattttagtcaaaaatgccacattataagactattattagactgtttatattattcccacccacatgtttccctgctttcctcacagtgattagtatttctgtagctttagggcacttccagtcctgtataacttttcacccacctgcggactatggggactgccctgctgactgaaaggatttccttcccctgacacagagatgctttgaagtcccaaaacaatgactttcattgcttttcccctatattgtcagtttctataaattggtgatgaaagtgtgtggcagcaccagaggacttttggtctctatctttgaacaaaaggaagcctggatcgggtctgattttttgcgttcaatttagctttctgcagtggatttaatgcagaatgaagctggcctaagaataatacaatagattgaaaaggctaactgaattagtgggtttagaggaatacatttgtaaagtggcagaagtccctagtcataaaaaggtttcttaagatgggatttgctggctaatcgcactgatattttagcatgttgccaggcctaaaaaaatttagctgtgtttgtttattttggtaaagacttgagtattagactattggatagttatataacagtagaactctatttttctttaaaaaaatagaataaaagccaaaactgttgctatcataactatatggctaggatattataagcatgatattaatgataaattcattagataactttaaaaaaataaaatagtgttattttcattattatggtttatctgtatagataaaattggttttgctttccaaaacactcttatatagtagtctttaaagtta

SEQ ID NO: 94574 - DNA, 1055 bp, Homo sapiens
aagaagcattcaccagattatcccagattttaaagttaccattagcatttattctattattttatttttttctgttatattttgtattgagatggaagaatatccattttgcataaattttttaaaaatacagtgacttttaaaatcaaactatcctgagaaatttagttttatgatttcttaaaatattttaactttaaatttgtcaactgccataatcaatttaataataagttggtataaattgaggtcacatatgagtacaaattacttaccagttcaaaaggtatgtaagttacacatatagttagacatatttattaatcatgagaattctaaaatatgctcataattaacataattctttattttatttcctgtttaaggagtagtgaaatataattctttatagcttctaagagattcacatgctaggaagggaagggattttacagaagaagtttgttcacatttatttctctgaataaataatgttataagtgcttatgataggagtggtggtggtaagaataatcacttaatcagttcttcaatatttcttagctaattagatctcttagccccaaaaatgtcaaaaggtaaacaggtaatccaaagggagccataattaatcagtttttatgactataccataaataaccctgactttgatgatttaaatttgtaatatgattgtaaaaattaaaggtaaactggcacacatatataaaaaatatatttttttaaacatggatggttcaaaaagtaaattttcaaattaaaatccaaacttggctaaatggaagattaaccaaatcaatatatgagttttcttagatcctatgtagcaaggtttgaaaccacctgtcaggttagtatttacaactgtaataattactaatacatcaacagaatggcatattaaagtacaggagccagctggagggaaaattggagatattgtgaacttccctttttatcatttttaaagtattttaaataatgtaatcattttgaaaaaaaatgtatctctttaattttgtatttccatagaa

SEQ ID NO: 94575 - DNA, 1022 bp, Homo sapiens
acccacacataagttaaaagcgtattgatgatattcttgaaaattattttttctaaattaaagaaattcagcagggtttttagtacatctctattgacttagttcagtgcatgagattggtggattatgattaattttaatagctacattaaaaaatacatctaacattcttaattagaataatctccaaagccagttaaatgttttagaagacaaacagtttaattagctaacctcagaggttcccctcccccatatgtgcagtggtcttaggcttggtgtgagcctttcaagcattcttaaacaattggatgaaaagggattttaggcagattagactaggggatcctttatttgttgttcctaatcatgagatatgccacatctacaaagttttacaaagaaatgaaaatttaaataaattttactttgactatctagttagcatgaattacaagctaaaacatccagtgataagactacttaataaatgtattcttttaattgtagataggagcaaaagtacatgctggggtggactagcaagtgatatggcagattaacattctaaaagggtcaatgctttttcccagaaagcatgcttttgttgtacactcctgtggtgccactaaatttttggaaattaattcagaaagttgaaatagaattgtcagatttcagtcttgtttttttcatttttttaatttctttcttgttcttgtctgctttatgccctctctaatgaaaaaaatgaaaagtttagtgtatctgttttttatttttctattacaaaacgctgaggaacttaggaatttgcaacttttagtgatatataaatcactgctttttttttaatttgtaaggagcaaaagatatctttttgtacctagaggtttttttttctttttttttttcttatttggctttctgccttttagttttccgtttgcctaaaaataataaatgttatttgtagttttaaattttttaaattataactggattgcaagattattaaagta

SEQ ID NO: 94576 - DNA, 1032 bp, Homo sapiens
tattctgaaatgactggcagcatttataaacaattgaaaataatctactttaggttctgactctctttggactttatgattcaggcaaaaggaaaagtcagagctgtgatgaacatattaaaggtatgcattaagattcacacacagtcctttcctataaagagtgaaaaaaactttttgactcaaactggaatgatactatgtagggctgaatgtgcaggaaagtttcccacaatgcattgtgcaaacctagggctaacaaataccctgctgcttgaaacccccccaaaagacaaaggcacaatgaaatagaaagcttaccaccggtagctttcaaaacgacaaactaggcaaactatacatctccaccactccaattttgtcagaatgctaatgagcttgctctgatctttactcggcttcccgtgttttctacatcttcaaggaccacatggcgctagcaaaataaagacaactaaatgagaatttcgaatgctttttgtgttaggacctggtgcttttcagtggacgcactcgttgaatattctcaacttaaaagagtacaacagggggttgggtatgaactttttaacaggaggaaatttgaacaaaagtaaattagtgagatgaggaaaatatgagaaaaatttctgattaatttccactccataatatcaatgacaccttcagccccactcatactcttctaacaagagatgctgataaaagatgaatgattctgtgttgttcacagtgaatgtttagtggttttttaatagcagcattctacataaaaggcaccaggaagtactccgcattagcagttgagatcactagttaataggatgatgtcttttagcttttgtcacaagattattagaaaggatgggtttctgttctcatcattgcatagtttggagtgcctgttgagtacaagtgctaaaatacaggtttctcagtattgtttcacatgtaaagcaaaaagccttttaatgcaacacctttttcctttttaccaggtgattttgttat

SEQ ID NO: 94577 - DNA, 1049 bp, Homo sapiens
gtagattaggtagatattttgctaagctctgaaatacgtaatttgatttgatggcgacaagtatgggaaatgaaaatgaagtactgtgtcaacaggtgtattgtgaggactaaacagattttagacagggttttgatctgtcacccaggctggattgctttgatgcagtcatagctcgctgcagcctccatctgttgggctcgggcaatcctcccgcctcaggctctgagtggctggtactgcaggtgcacaccaccacacccagctaactaacttttttgatttttagtagagacaaagccttgctatattcaggctggtcttgaactcctgagcttaaatgatcctgtcacttcggccatccaaagtgctaggattataggcgtgaggctctggccctttttaaatgggctgtagctttggagagaagggaaaggacattacaacacaaggacataaagctaactgcttgagattgacgcataagatttatgccagaatctgaggtgaactattggggtaccatgatattcttcactctatggggtattttaaaatttatatcatgataaaaggggcaactgaacatatcctggggattaagttgagaagaaatatgaaagtaacttaatccttgggaattttagagattctgggagtcacacattagattttctctagacttctaactgaacaaaatggcaattagcacaaggattttggaatacacttaacagaacatgtgtaaccttggaaaggggaatgtctaatggagggtttgcaattgagtagctgctttaagaaaagaaaaatgggtaatgcgtagttgatgggtttgggtgcattgaggggatttaaaaaggccgaatgatgttaggatgcattttggttgattggtgcagtaaaatgaatacataaagacattagaaatatactcaatgaaactaacaacttcagacttgcactgagttgcccaacatatttacttctgtggatagtcctttctaatgcttgcataggcagtcagaaaaactctgacactctgctgg

SEQ ID NO: 94578 - DNA, 1025 bp, Homo sapiens
ggagaattttaagtatctcctgtgtacaatcagttataatctaaaatgttcagttgtcactctgctcacatgttttctgaacatcatgatgttcattaaattttttttttcatagatagctgtgggtatttttttgtagcctggtaatttacagtgtatttagtaatttataagtagtctaccctattagggatgatgagttccaaaatgtcatatatatctctagtttacttttggggaggaaaataagaaaatagcaagttgttaaaaatggaaactttcacacaatctctggacttccctgatcttcctgctagtcttatgagtctcataatgattttttaattttttttaatcatgaccatatgtctctcagcactgtgagttccttattgaaacataatagcaagtcagcctctagggagaatttaaaaggtaggacattttgtttactgtacttagtgttaatatgatctatcggtatgttcacggagagtaaaatatgcatgccgaataataccaccttaagattgacttttcttttttcaggacttagactttaaccttcttataagcagtttaatatatagtattagaataagtaaaatgttttctatgtttaaaaaattatgtgctaaactactatttggcttgttttaacatcgtatagtaaaaggtaactcttcccgaattataggaaggaacacagaagaagaagaagctatgatgcaggaatggtttatgttagttaataagaaaaatgccttaataaggagaatgaatcagctctctcttctgtaagtactcatcattatgcttgttttgcctacaacattgataaatcttaggcctcttgttattgccttctttgggatttaatatttattcggtattttccctttccttagcgattacatgttttataaaaaaataaaaaatagtatatgacagttttcatcttataagaatttttaaatggaacagtagacactgaaaaagtgtttattatacagaaagccaaggaa

SEQ ID NO: 94579 - DNA, 1032 bp, Homo sapiens
tttataatttctgccatgcctgaacttgataaaagagttatgaagaagcacaaaactttacaaatcctgaattgtggtctctgtattaaatttgcactgctggtactttcatgtttcttgtattcttttcatatggagttttggaaaaaagagattataaattatgaaaaatattttagaaaatagccttatacttggcatttactacaagaagcaatgaagaaagtgagtaattatcctcagattaaaatatacctatgtaacattcagaattgaaggaggaaaataatagcactagtaaatattcgactgaggaaggttttaggtttgtgtatcattcatttggagtggcttaaacttaaagagaaaagtcagttatgagtcctaaaatcaatgtaacctaaaggttcttttaagtttttaatgatttagtaattagcatattgatgaacttttgcaacttgcccagggaaaaagaacatgatttagaacgacggtatgagctgctgaaccgggaattgagggcaatgctagccattgaaggtaagaaatgctatggtggggtgaggtatgtgacgtgtcagttgtcaaagagatttaaagaatataatacacttctggtcttactagatctggtgtactagggaccttccggaattgcaaataaatgccgtggaggcagaaagcagtatccatataaacttaaggaccctaattcagatagataatcattatgtttgctattaatagtagcacaaaattgtcttaacttttgattcagtaagcttatatgtccataaaatggaaaataaaaggagttgattgatttaattacattttacttaagtgtgatttaaagttgtttccactcgggaggtttggaaaagatttatcattttgattttttacatccagactctaaattttactttaattgatgtcaacattgaaatatgttcctgttcagtctactacagttcttaagattccaacttgtattaagtgaatatctgggcaaagattggcataaaa

SEQ ID NO: 94580 - DNA, 2349 bp, Homo sapiens
gttattgtgaagcatatggcgcccagtgtgagatacatccaactgctaaaatagagcgaagaggaaattagcgaagaatgggctgtttggggtgagagtgggggtgggggaggaggataggttctcaggcagattctctagccttttcagaatgattttatcgcccatcactgtttcccgcctcctcatttacccacttcccccactaccaacccctgggccaacctcttctgggcctctagctcccctcccccactttggctggattcaggtgcgcacctcaggctagccaccagttcacacctggttctaagcaggttccaacactgctgcagccatctccattcacaggacctgtttaggaagtagacttttagcgaggaagccttcaccacaacagccaaactccccagaaaacactagctagtggctctataatgtggtttgctgagaaatataaggaaactggaaaaggcgggaaggggagggcggggggccgggtgttcggaggccctgccggtgggtaactagcctcccgtcttctgcagactggcagaagaccgaggcccagaagcgacgcgaacagcttctgctagatgagctggtggccctggtgaacaagcgcgatgcgctcgtcagggacctggacgcgcaggagaagcagtgagtgggcagtggggtcgggtcgaggctgggccacctgccgaggggccgagaagtgtgcggaaagttcaatccagaggtcgcgggagggccggggcagcctcccactggcctggtgctccccattcccgctggggatccaaatactgggcgacgggggagtgctgctctgccctccacgaagaaaaataattttgtttcctgtttgtcctgtttgtctgacatccagggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattttgtttggctggattgtactactttacctctactttaccaccaccacccttttcctccctcctttccaaataatatacagaactccaaaatagcttcatttaaggatttttttgtgagttaacaatttccttgaaatcctgtgaaatagatttgcacagacaccttgtgagtgattggtattggaggtgttcaagaaactgttcgaaaaagaacaaaaacacttccctcgttattttctctcattttttgatgagaggaaaatttgaaacattattcttgttgttgttggtaatagcataatgacagtgggaggggtacaaggggataagaaaaatgtcatgatttttttccggtcctgccacatgtaacacttactctgttacctaaattttatagttagatcatatccaatctacttattaaactgtgttctatttaccagtggagtttttctgcagtggttgcgtttcactgtaaggataatggagttcctctcctctgctttcctcagaggatggtcctttaacatagccagaaacaagccctgtggtttgaaggtgagctgtgaggatgggactaattgatatgcaccagtttacaaagacagtcttatcatccgagaatacaccatctttttctctggataattatttcttacatcatgcttgattcctacattttgttgggtctcaacattggctcacgaatgctgttaatatttattctgtattgataaaaagtctgtcttgccactacaagtaaatcccccatttaatattttcttctttagcatagcactgtcattttttgtgaaaatggttatgtttatttattacaatactgagtcatatataaattttcaataaaagcagaaactttcttaccttaaacacggctgctactttcttgcaatgaaaacttgacattggcttgaatggaagtttgtctatccgtaagacttttcatgtggaaaatggtcctctggaacttagggcaggatactgggctgcatttgaagctgaataagtttacaccatcccagagggggccctactgacacacgaatgcgaattgaaaagtaattagtcatattcttaagcagtataaactatcatgtcttttgtaaagggtcatctctgctaaagatttgaggaaatttgtgattccacaccaatgaaaaaccaatatttatatcttgaattttccacgtcattactttgaattgttagagttttgaagtcgtattagggagagtcgtgtcttctgata

SEQ ID NO: 94581 - DNA, 1017 bp, Homo sapiens
tctccttcaaaacaactatttatgcatgaatacaatatttgaataatacaagctcagtcttgactacttcctccaggcgtatttttcaaaccaggaaattaccagcattctttttaactggtggcacacttgagtaagattcaagatgtttagagctctttaaaaaacttgtgtctttcagaaaacctgcatgacatataatgcttgaagactaaaaaggatgttgatttggtcctctcccaccttgcccatctagttattattaaagatttttacaaacttgttttatttactccattgattttctttagttttacctggttttcttggcagatagttgaagttaaggaaaaaagaaggatgaataacccacatttgactatcttcctcccgctcccctgttaatgcatgaccacttgcaaagccccctccttaatcacacagatcttggggaatccacaagagttttgacattttgttcacaaaccagtccagttatctactaatggacattggccattttcttctcattgatgtacccaatacttgctaattattgctgctgtttcttcagatgatacagggcactccttgaccacccatgtctgcttttgctggatacagattctgctttgtctgtataccaccacattcaccattcctgcttactttctgctgcacaccacttcctgcagccacttctccattctttttttttttttttttttttgagatggagtctcactctgtcacctaggctggagtgcagtggcatgatcttgactcactgcaaccttcgcctcctgggttccagagattctcctgcctcagcttcccaagtagctgggattacaggtgcattccaccatgcccagctaatttttgtatttttagtagagatggggttttgccatgaaggccaggctggtctcgaactcttggtctcaagtgatccgcctgcctcagcctcccaaagtgctgggattacaggtgtgagccactgcgcctggcctgctt

SEQ ID NO: 94582 - DNA, 1109 bp, Homo sapiens
ctactctgcctactactctgttgtcctcaggaagccaaaggagtagagagaagaggagatatacaccattatcgcttttgcccatgaaaatggtaggccacctaccattctcatttttgtctattaattttgacattgaaatacattctagatttttaaaagtgagtctttttgaaataatagagaatcagtttgaacacatttgaaatatgtatttcagtgtacactcagaatattttaaatagattataattaaaatccaaaattttaatatatcccaaacttaatagtttataagtcttttataagtcaaacaaagttaaactttataagttgaagataacaaagtttagatggttgatgtagtatggtggtatcatggtggtgatggtaggggtttttgttttgttttaaatgctgagaactttattaaatttgtggaattactgagtaaacactaggtggtgcagttgtgcaaggaccatataatgaagtatgcattttttgaaaaaaggtgtcaggatgaaattaaaattatagtttgaagaaactctttggaaataagaattatcaaaatactaaaatagaatgaatgaatcttgctttgctattacttggtctgggatttaaatggggacctatcttgtgatttacactagaagtctcaagctattggtatattgtttgtattgcattttaagctcagctaaccataccaccctccccagagtacaaataaagtacataaaatataaaagaaaatacgacaacaaaaaactgatccaatttggttttctgtaaaatttaaatattaaattgctctctgactacaattaaagaggcttaccttctactatttcaaattattctaaaatgccctaggatttgagtaattttctgtaatattatatctcatcgagtaattgttgatcagttaaaacttgaaaagtagctttccttttggcctatgtgtcttcttttattcactgaaaaaacccttgcattcctatgtatattcaagtcattaaattattaaagaatcagcttctgcaatgaaaaataattattattgttttatttatatgttgaaataaagtaaaaaaaaatta

SEQ ID NO: 94583 - DNA, 1056 bp, Homo sapiens
gaggaaaggacctgcctgatggagcccggcaattggcgggagagatagcgtgtgtaactctagggaggggagaatcaccccttagcgacatcacccccacgcgcgtgactgagactgcatcctcccatgagggtaaacgtgggaggtaaagagaccttccgctgcgtaaagctggatcgacccggaaacaaaatcttttaaaaaacgattgacactctggaggggcgggggaattgataagttgggacgaccggacagcttctcaggttgctaagcgacgaggcgggagcgcacgcacaccctggctgctttgtagcacctgaggaaactgtggcggcggcggcggcgtcctggagacccaagagaccaagcgagcgtgtcgctccctctcgggtccgaggacctagcctaggaaccttctgcccggggtagtgtctggtgatgaggcgagagttttgctgggacgcctactccaaagcggccgggagtcgcgcttcttccccactcccgagacaggtgagccctggcccgagggcaaggggttttcttttaaccttaggatccggaatgcggttggtgcgccgtcccgctttgcttttatccgctgtgcggatgcctgcaagctcgccggtcccttttctgagcggagtatgagggctgtgggaatgcagctattttggagggggtggtgccctggagtaggtgcacccccgaccccaaatggagctcttccagagttatatcaaaaatatttattgagcatttactttgtaggaggtgagcctctcccttccaggaggtcacagtatacggttctaatttgctctaagccctccgtgaatgttgagttttgtccattcccttttggaagaaacaggatgcgccttaaaccatcttgagtcttaaagttatgccaaacaggcatttctaaggaaagactggcgactgaaggggagacactggttgtttagtcagtcagtctcagctggtaaaacaacttaagaggttctctttaaaattaatgctgccaagagaattgctgtgctttttgaaagc

SEQ ID NO: 94584 - DNA, 1086 bp, Homo sapiens
aagaaaacagaatgttatcacttaatctagaaaattgttcctttactaaaatagacatttttctcagctttaaaactatatgtatttcagcttcaggtcattgaaagtttttatgattgaaattaatctggaaaggaagattcagctcttcccactagacactatgttattatgcctctagtattagagacctacaaatagtatatttctaaatgaagcaatggttttcagtgttgttgttctttattataactgtgctaaagtcagtcatttttgaagttttttttttttagattcaaggggtttaaaattcaagtgttgagtttttattagaattatctattaattaaaatctggatttttatttactttagaatcagactttaaaacgatatacctctaaatataagttcaaacaaggttgttgcttactgaaagatcagttccagtttaaatctcttatttgcattattttcaaacagaataagacctggaagtttgttgaaggtctccctattaatgatttctcacgtgagaagatggatcttactgcaaaggaactgacagaagaaaaagaaagtgcttttgaatttctttcctctgcctgactagacaatgatgttactaaatgcttcaaagctgaagaatctaaatgtcgtctttgactcaagtaccaaataataataatgctatacttaaattacttgtgaaaaacaacacattttaaagattacgtgcttcttggtacaggtttgtgaatgacagtttatcgtcatgctgttagtgtgcattctaaataaatatatattcaaatgaaagtgactcagactctgtttctagctaatatttagtgtctattcaggaagcaaacttgcggacaggcgcagtgactgacacctgtaatcccagcactttgggaagcttgagatgggtggatcacctgaggtccggagtttgagaccagcctgggcaaatagtgacaccccatctctactaaaaatacaaaaattagccaggcgtggtggcacaggtctgaaatcccagctacttgggaggatgaggtaggagaataggttgtcccggggg

SEQ ID NO: 94585 - DNA, 1126 bp, Homo sapiens
gaccggtcggccagccagagcgtggaattggtagcgcctcctagtcccaggatgtttatggctggtgaaaatggttgcactgcccccgctggccggcctcgcccgcctccccgacccctgcttgggcgggagccgctgttaaccggggttttcgggggaggcgtttggggcctggacggcggcgcggggagggggcagctaggggcgcggcctgccagtgcctcctgcagtacagccctggagggcgtggggacttgggggcggtgaaatagccgctgtaggtccgcctctttcattgaagaaatttaagttcgtgtggttttaccttttccgggagtctccagctggccctcatttgtgtccggagctcaggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaaggtaagaaatgctgctgcttatatcccgagttgcttcaggcaaatttgggtactgacagtggagaggttggtgggtggtttggaagtggaaatgttcatttgagataacatttgcgaaacccttttcgttgaattgtcatctgagctgccttgagctgctgggttgacgttccagacgcgtataatttatgctcctgtaccctgctgggtttagttttgcctccctgaaatcaggttagtagtaccgtcgctttcctggatagtggctgtaagtgataaaacaggatttttggctgctaattaatccttgttctcttttcctggtctgtgtcaaggtacctgtgcgtgcacgcagacgggaagggctggggaagcgggaggactgagaaaagccgggtgggttttgccgggactgttggggaagctttagtgttctccgcttctacttcgtttgtgtgtacgtggtttgcgtctcagattcactta

SEQ ID NO: 94586 - DNA, 1036 bp, Homo sapiens
catttctaagaatcttaatcataccattatttccacaggaattaaactgaaggtattttctttagtacctacctttcatctagttctaaaactgggatgcctgccatgctttccacaaactctccatttattgaaacaaagtggcatttattttcccagctgacgggggtgggcaaagggaaggcatttcttcacatccttgtactcttctatagtgaggtagggggtatagcttcataaaaagttccctttccctgaagcttcatttcctgaagcttgtttattatcactgaaaaaatgatcattaataatctttccattcaggtctgctggtagttcaatttatgccttttctttaaattcatccatacttgttttgagtaggctgcttgtttaaagttcacaatataccacttaaaaaaaagttgccttttaaagtctgttaattttttacagctttattttagacagatagtttaagaaccaaagacatacctctgtaatgataaaggaaagaaaacaagctttccttttaagaaaccaaagagcacaaaataagactgtttcattatacataatcaccacaggatattaggcactctgacagggttaggcaagattcttggtgtgaggtgaagcacaggcactttatttgtacagtgctgctgattctaattttgaaggtaggtattataaaagtctttacttgtcaccttatttctggccccaacacagcagcctatagttttaaaagttctgtttctccctggtctttgttcgtatacacatcgaaagtaacttaaaaacaaggatccaagggggccatacttcatatgttatctaaatgttaatatgagaactcaaaagtaggcagattatatgaatacatattcttacctctgctacaaataaaaacaccccaaacccttcatcatacttttataaaaatacagatattaaactgtagccttttatataccatttctgaaaagtatttagttgcataaatagatgccaggatctttttttttaagta

SEQ ID NO: 94587 - DNA, 1421 bp, Homo sapiens
actattttagtcagcactcccatactctagtgctaaccaatcaaaaacattttagtttagcctgttattttctctgtatattaattcatgctgtttcaagataaatctgattttcttgggctgaatttatcatgaaactgactctaacagccattggtttattcattttccaaatatttattattgaagtacagcattaaatggcctacttattcatagcaggaatcctgctaagtaaagtatttggacacttgggcactaagaaatctgaattttagataataggactctgactcggtgagcactgttactttaattatctgaatagaaagtttgagatttaaaaaataattttctctccattatttaggttggtcacagcagatgtagctttttacactggaaatcttcaagccttaaaaggccttaaagatttggacctaaatatggccgaaatttgggagcagaagaggtgatgtcatcctggaaaactgggtagttcatctgaccatgggatgtgtttgttatgaagaaaatctggatgcctgtgattcgagaattgaacctgaaacccaaagtgaactggggtgggggaagggaaaaaggaaagtatcaagtgttgggaaactggattcagtgggatctacaaggaatgtcatttttgtgcatcctacagtgaggagtaactgatcaggtgtctataacatttttcattctctctggaaacagactcaggtttctttggaccaaatccaaaagaacacatagctgtaacacagctgtagttgactagaatgctctgtatactttatattaaaaaatgctttgcatttcttccagtgcaatgaaattcatatggtgtcccaccttatttaatgatggtacaatttaaaatcttagtcaacttctgtagaaagttttctctatgaaagtaaagctgtttgaaaaattattatttttttacagatctttctataaaaaataaacatcttttgattgcttggatttaggaattcaatttttgtttcagtgaccaatgtcaagttgcaggctttgtgtgttgcatatttaatatttctactaccaccgtatgtcaactgggtaaagccttccagagctctctaaatacctgaaagacttaagcctttttttaagtaattaatacttaaaaaaaaagatcctggcatctatttatgcaactaaatacttttcagaaatggtatataaaaggctacagtttaatatctgtatttttataaaagtatgatgaagggtttggggtgtttttatttgtagcagaggtaagaatatgtattcatataatctgcctacttttgagttctcatattaacatttagataacatatgaagtatggcccccttggatccttgtttttaagttactttcgatgtgtatacga

SEQ ID NO: 94588 - DNA, 1998 bp, Homo sapiens
atcaattcattagttatgatggaggacctactatgttggtaatcagaaacactggataggctttttgtcagtgtttctgaattggctaatgaatgcaatacctgtcttactgaagcgactcccttacttaataagaatgccatacagagagtattatgcctgttgtacagaatttaaggagccactcattctcagtgttgtgcaagctgatcctgcaattgcacagagtaagagcctctttaaattttgcattctagacacctctcttgtcttgtgttagtcaagaacctgctgtactagtaggtaaaatgcatactttaacatagttaccaaggtcattatattctcagagatcctttgtgccattaagtaatttgatttttatatgccaaatccttttgatttttcttgttttgatttcctattgggccatttttcttttcttgtagaaccgtattgctgttaataagaattatccttgaatattgccagtgtgtggataacatcccatctgttactactgacatgcttactcgtctgtcagatttattgaaggtatgtatgacttcactccattatggaaaaatttttcgaggaattaatacattagggtgtgactaatcttaactcaaagacatttcaaggtcaaattaactttaagacattagttttataacatttgattgtggttgaatcacaacatgttattggaaacaggctgcctgcttccttcttactccacagttagtgatcctcattcacccatagagttgttaatgacattggagacaggagatgatttgttcgttaggtgctgaacatgactgaggccacttaggtcaaaaaacctggactggcttcaaatgtgcatggaaggaattcactgaactttacaaaattcatctcactaaggttagagatttttcttgcatcattctttcagaaccattgatataaaatgaaaatgtgatgattttattcagccatttcatattgagatattttaaactaccagtacggaggaaatgctttattatttttttcaaacctctaatctgttaattatgttctgacttgagttgtcatgttttagccaagacagatttttataacttttgaaaataggacttcccaacaagaatgactgaaaccgaatttgttttgtacatgcaaattaaagattaatttctgcgaactgatttttagaatttttcaacttttttcttatcagtaaatattatcatttagaatctccccttctcatttctttttcattaaataaatagatactaattgcttctactagataattcatttggccattgaatgagaggaaaggggaatgtatttttataatagcacattgccaggatataaagaacagtttttagtaaattttggggtttttttctccttcttttgttagtacttcaattcaagaagttgccagttagttcttggagctggtgcactgcaagttgttggactaaaaacgataactacaaaaaatttgggtatggattcttgcgtttaattcacttgctgaagtgttaacagtgatgtcactgttctcatcatgtttttttatacctcatgttttcatggctctaaccaaagtggcattactctaaaaataaatgctacttactcttttatgtatactcatcactgaaaaaaactaaccatggggaaaaggttacgatgcatttcccctccaagtataagttacttggaagttacaccactctagaaaatattaagatataatgtgtataaagtatttgggggtgaaagctatctgaatgtcataagagaatcagttgtcttgttattgtgatactgataatactcacaacttgagtcctttgtgaaagcagcatgttcattacattattcagtatcaaattattagacaaaatgaaatatgttgccttctgccatagggctcttcgtttatgaaataaactggttctttataagtgatgttttttatttgat

SEQ ID NO: 94589 - DNA, 2359 bp, Homo sapiens
tcctagcactttgggaggctgaggtgggaggattgcttgaggccagggatatttgagaccaccctgggcattgtagcaagactctgtagtcccagctacttgggaggctgaggtagggggtttgcttgaggctaggagtttgaggtttcagtaagctctgaatgtgccactgcactccagcctgggtgacagagcaagaccctgtctcaaaacaaataataatatagataatagttgtattatctgagcatgtttaagtaatgtttcactataaaaactataagatatttggtacatcatagaatttttcttcaaatgtgaattttacagctttttcatcctttttattgataggtcacctgtggagaatactatgtttacaactttccctgactaaatcttattttgttattttcagggtcagtgaagatatgaaattaactgactcagagctaggaaagctggcaaataatatccaggaattattatatagtgcctcagatatatgccatgatcgagctgtcaaatttctcatgtcaagagcaaaggtagctattttcataaagctttatatattttatacgtaataattttgaagatctggaattatgtctttgcttcctgtgttccccataatgcatattatatttttaacatttaataaagtcagtgttaccactgatgtggtctactagggagatgttgagatatgaagtaatctaaaataaataggagttattaaagcattattttcagataaatgattaaatgacattttgaaatatatgttaataactaatttgaaattaatgttgttttacatatatagtaagtctatatatgtatacctaaatatatgtagttaaacaagtttataataaaactccaacattgtgaaaattttatagtatgacctaaattcatttgaactactatattagttataaagggatcagaatcaaatttggacctcttaagcatttcatgctcaatttctgggtctgaagtattgggaaatattattaaaataaaaaatatatagattataataatcgttaaactaacttggtttcataactcaatttggtgttacactaactctcatgatttttgtattaaaatttaggatggttttcttgagaagctaaattccatggaattcataacactttctagattaatggaaacattcattttagacaccgaacagatctgtggaagaaaaagcacgtcattacttggagcacttcagagccaagctattaagtttgtaaataggtttcatgaagagagaaaaaccaagctcaggtatcatcaccatgtccattctgttgtttgattttttcatttttctttgtgaaacacagttatgtttaaaagaggaaacctaattggccagtgaaaatgcctgataaaggtttttttaattaaaggcagattgtggaattaaaatcacatttcttggcttttcaaagtggagttagaatgtttacttctattaaagtacttatcaggaagatcctcagtaagttgacttttgttcccactcaaagttaagtaaattgtttcatcattctttttgattaggctgagatataaaaagggaactattttctaagtattggtcctgcttattaaagtgttcagcactttttaagtcttatgttctcactcagctcttcttccttttcttttaaaccaaggaagatggtattgaaatgttaaagtttaccttcttttctccttactgtggactagcctcctcttagacaatgagcgctggaagcaagcagatgttcctgcagaatttcaggatcttgttgattctctgtcagatgggaagattgctttacctgaaaaaaaatcaggaggtatgtgtattcattcacacattctctttcaattttatattgtttatttattttgtattaatgcttaatatttctttagttgacaatgcctatttcaaagctagaaccaatatttccagcttagtaaatacttgacaggaaaactatggtaatttataataattatttcaaatatttattgcgtgttataaccatatgccagacactggaccatgttctttacatgcattactccagttcattctcacaacgatctgtgatacaggtactattgtttctttgtgtaacagtgaggaggcttgaggcttagaagggttaaggaatttttatacaaatgatgagttgggatttgaaaccagctttatataatttcatagctatgttcttagctactataccgtattgtttacatacatgaattgagtaagcgctagttagcttctactttgtgtcctatattgagacagaattgagacagagataacagc

SEQ ID NO: 94590 - DNA, 1039 bp, Homo sapiens
taaactttatgttaatggaataatatatttgctcttttgtctctgatttctttcgttcagcattacagttgtgatatctatccaggttgttacatgtagcagtgattttattttttgtgtacaaataatccattttatgatacaccacaatgtatgtatgtattttacttttgataagatttgggttattttcattttggattgtcacgaacattcttctagatacctttgttgcacatgttacaagcattgctgttgaatatatacctggaaacaaagtatgtgaatggtcaatttagctaatgcctaacaatttctcaaagtggttgtactcatttatgctcccctcagaagtgtggagcagtttgtgtcactccacatcttccttcactcttaatattgccagtcttttacatgttagccattctgttgggtatgttgcaagtgtagtaattttatttccctgatgattgttaggagagcaccttttcatacattcattggcttctgggatgtccttttctatgaagtgcctattcaaggcctttacccatttttctgttggtttgtcttgatctgtgaaggttgtttatattatgtcagcacaaaccttttgccagttgtccatattgcagatatcttctcccactttctgtattgacttttcactcttattgggttttttggtgaacaaaagttcttaatataattctatgattcattactttcctttatgatttatgcttctttgtgtcctgtttaagaaatctttctctaccttaaagacttgaagatgttttctggttactgtctagaaactttgttactgtctttttcacattaagacctacaatccatctagaattgatttttatgtttagtatgagggttaagatttttttcccatatggatatgtttttgaccttgcaccatttattgaaaaggctgtctttcctactgctctataatgtcactcttgacataaatcaaatattcagataggcgtatctgtttctggactctatttcgttcattttt

SEQ ID NO: 94591 - DNA, 1891 bp, Homo sapiens
ttttggagacccgaagttagagtctgcttccctagaaccatgtagattccaaaaaaactaaccaagcgttttgagaaagggagaaacagttgtaagactgcaactgtgaatgttaaaataggcaagcagtcctttatttcttaattgtccataaagacattagtttacataaatttactcttcatttgcctagctttcaatatttactgagcacctcctatttgccaggcactattctaggcattaggattacagtgtcatggaatggagctgacattctaatagaaggagacctagaataaacaaagataattgtacataatgataaatgggtttttttgttttttgtttttatttttttacaaaaactggataatgggatagagttgctgggtggagattcagggaaggcctctgaggaagtgaccactggagccagaacctcagtgatgagaaggaaatatgtgcaaagatcaaggtgaaaagcattccggatagaggaaacagcagaggcactgaggtgggaacaatcctggaatgagggaagagtagaaagagaactagaatgtctggagagtagtgaataagtgagagaagatacgagaaaaggagaaagagaggtaggggctaggcatggtaagtaacacagattccttttcttttagacaggcatatcaatgtatatgattctctgatgggcaagttatgtttagtgtaacctttttaagaggtcagagaaatatgcaacatattttagggagatttccattttaaaaattagttaaaatataggaagtttatttctaagctttagtgaacccatttctcctggccagttctttttcacatcacttttcctatgtaataaaagatcggtagaaattctgatatacatgactttgactcatttatgattatagatgtccaaaattacatgcacagaattctcttttgggaacttcaggtaagagacattttacgtcccttaaaagtgtgtcctattttcttgtaggcaacattaaatatcattcacagtgttgttctctcagttcttgacaaaaaccaaaggactagagaattggaagagatttcacaacagaagaatgctgcaaaagataattcactggacacagaggtggcttatttaatccatgaaggcatgtttataagtgatgcattcggtgagggtgagctaacacctatagcagttgacactacctctcaaagaaatgcatctccaaatagtgagccctgcagcagtgattctgtatccgagccagaatgtactactgattcttcatccagcaaagagcacacatcatcatctgctattccaggaggtgtggatattatgtgagtatagtggctactgccaaattgacaagattttgagtcatcttattaatggattcagtaagattgattattcagtttattgaaaaaccatgtaaattttagaatttaacaaaaatatattaattttatgaaacgtatctctataaaaatgtatgagaagtaaggaggtgagcattggaagtaattgaaaattatagagttttaagattgcaaaagaactttaaagaccattttattaaatgccctcatttcagtgataaggtaattgatgcccagagagcttagatgacttgcttacagtgactagtggcagaacatatactggaacccaggtcagtttttgctttggtcatttttctttcttctgtgtcacctttgtgatttatatgttgtgaagatctgtttgatttataacttttggtttttcaaagacatgaatttccaaatggatcacatcttctcttaaaccttattttaaaaacttcttattttgaaataatttcaaatttacagaaaagttaccagaatagaacaa

SEQ ID NO: 94592 - DNA, 1038 bp, Homo sapiens
caaaaggtcaaatggttttaactaattttttaaaaattgtgttatatctcatctttcttagtaaatatagttgccagtattaaggatttgtttttcaagtaaatgtagtgtggatatagtttaaatgttttttaaattttaatgtaatataaaatttaaatgttttaaaactgcccctcaaaatagagcttaaaacatttttttccctgagatataaacatattttccattggactctttcacttaagttttgaaattctttggaccaactaggttatctaggcttctttagctcattgcttttacacagctatttgaaagtatggcagaaatccctttgtatgtgaaagtacttcatccttacatttttcagtcttgtgtttcaatgactttcagtttaatgacttaagcgatgttgcacagtaactcaaactgattataagaaagattgaattgagtccatctgtacatacagtccttcagatatttatttgcacccagaacagggcctagcgcagggtaggcacaaatgtttgttgaataaatgaatgactagggagctaccaccattgatattcagtaaatagttaataaggaaaggacttagaatgtcaatattttgtctgtggaaaacaatcataaatgtacccagtaaccaggttttctagaacacatttatttggaggctaaaggtacacctttgaccttgaacaacatgggtttggacttgtgggtccatttatacacagattttttttcagtaaatatattggaaaagtttttggagatttgtgaaagttgaaaaaacttaccacatagcctagaaatatatatgccatgaatgcataaaatatatgtaggtactagtctattttatcatttactaccataaaatatacacagcactatttaaaaagttaaaatttatccaaacttgcacacagactgtatatggccccactcatgcagtattaaatcataactgcagaaaactaactgtggtacatattgtaccactgtaataatttcataaccacc

SEQ ID NO: 94593 - DNA, 1051 bp, Homo sapiens
aaacttatactcaaacatacacaacagtaaaggaaattatatgaaaagaattataggaagctagatgaattgtttatctaagttgtcaatgcaaagcaaagtttgttttatctgtatcctgtattattttgtaacaaaccctgaacattttgtttcattcataaatatttcattaggtatctttgaaagataaggattttttaaaaatataactctaatgtcatttatattttcaaatatagctagtcagtgttcagattttcctgttagtctcaaaattctttcttatggtgtgtttattgtaatcagggtccaaataatatctatatattgcaattggttgatatgtctcaagtgttttttgatccatagttatccattctaattttctttcaaaatactaatcgaagaaactgggttgtcttatagtgcttcccatagtttggattttgtaaactatgtttccatgtttagcatgttattttttcacctatattctctgtaattgatagttagttttaaaagcttgattagctttaaattttactttttaacaagagcacctaatagacagtggtgtgtatttcagtcaagaagcatgaaaagtctctcttttgatgattagcagccatttaataattgctgtctagatttatcattaattgtgggctacaaattatgatactctaattctatcccactttctttacttattcactggaatatttctatgaattgatgtttccctataacaattatttggtcaccctttgaaggacaattcttacaagattagacaggataaatgctagattcttttcctttatttagctgttttcaaaataacgaattggaaatctagcatcctccaaagataactgatgaatttttaaagatattataaatacatggatttatatgcaaagtgttttaagttctttctttttaatttttatcaatgttcaaattgaattatcatttgtaggaacctcctcaagttcattcttgagtctttttgacatgatttcctaagtagttattgacagttttc

SEQ ID NO: 94594 - DNA, 1090 bp, Homo sapiens
gggactacaggtgcccgccaccacacctggctaattttttgtatttttagtagagacagggtttcaccgtgttagccaggatggcctcgatctcctgacctcgtgatccgcccgccttggcctcccaaagtgctgggattacaggtgtgagccaccgtgcccggccgggatataaatatttttaaccattacatgtgaaatgaaattttgctatctattaccaataaaaatgataatcattgaaacaatatatatcatttatatactaatttaactaaaagtattgctgaggctaatggcattcaaatgcttaagcagatgtagtacataagtctcgtgagcccaagaatgcattcgaatgttgatatcttgcaggttttgatacagaaaatctttagttaccttgaaacttagggctgtggtgtcgttatttgctcttactgtaaagctttgtgtagaaactcttagttttcataattgtcgttaacactctattcctactacttcataccatgattactaccaccgccattctacaacagaggacatatattgaatacttgagtattctgtaccagatactgtgctaagtatattgacatcgcccactccccaaaaaactgtgagatagggaatgttacccacactttacagataggaaaactgaggtcatatagcaagttaagtaacagtacagtagagattcaacttgggtctcactgggcttgagagctatgctttttaatatatttgtttgaggatcttatggggcctcaaatagatcactctgaacatcaatactaatttgattgtacaaactgtgggcaattgagctataggtttgctcagcagccaggaactaccatattaatggattttggcgtaaaaattactgcagctagcttgttttctacttgtaagcctttttttgttttgttttgaaagaaaagatgcaaaacactcagtttattatagattccagtttattatgatttcattgatcagtggccactgtgagattccatttaagggatctttattattggatgtatcaaaaggtatttaacatgttatttgaccttaaatctcc

SEQ ID NO: 94595 - DNA, 2107 bp, Homo sapiens
tttattttattatggccctgttaaacagtccacagattggcagcagcatataaatcacattctgggtagcactgtcctaaagttatctattctccatttactattctgggaattgagtccatgttaccttgcaatttaccctagtatatttgtgcccattttgcttttttagtgaataaatgaacagccatattgaagatgaaagagcaaaagggcataaactcaagatttaaactgtggaaaaatttcttgtttgtaacctatttagatattgtaagattattgaaggagcattattgaagatatgaatgatactctgtgtttccttagggaaacagatttgatgaccaaatagtctcttctaatcttatgagacctaaatgttgaaagttcattaaccctttgaaactatgaattatcccaagacattcagagataatgcccgaagtctgagctgtgggttaaaaaatctcaaagtaaaaaaatgggtgaataatggaaagataatatagccaaaaaaggcatatgcagttagaaaggaagaaaaggcaaaacaagttttagaagtccatatttgaaatttagaaagcattttaaatatatattaccataagaattaatcttggtaatgctactaaaaaaatatatatgagctaattgtttaaggtatttgtcgaacttttaagaggaaaattcattggaaataaactgaattttacaaattgataaaagaatcacttttgaaatgtaaaataagcagcctgaaaaaaatccaaatgaattttagtaccttatctataatttgtgactgaaccatcagtctatcttggattattcagcattttgaggcagaatggtataatagaaacagcttcagtttttcagtcagagatataccaacattttagttttgctacttagtaactacatgactgtgtttcctcatctgtaaaatgataataatactacctatatttcaagattgttaaaattagaaaaattagatgtgtataaaatacctgtgcctaatccataggaggaggtcaataaatggaaggtgtaatcatctatttagtcagataaatgatgtgcaatgatattgggggctaaggagatcattctctttctctcagatcttagaacatctgaaactggaattgtaatttgagatgtctgtggggtactcttttagaaagcagttggtgtttggaaggtgataatgacaggaacagaggaggaaagtaaatgaccttgtactcttttgtcttacatttatatctttggggtgtaccctttatcttccttccattttgttgtgcccaatttcaaggatctcacaatcaaacaattcacacaatggaatttaaagtatatgtagaaatcttttatcattgtcataaagtatttggataatcaaggaaggtatgctcatagtacttcatattttttttccttctcttttaagctgagccattatctggatattgtggaagtaaacattgctcaccagatctctctacgttcagaagcattttttcatgcaatgacctctcaacacgagttgcaggactacctcaggaaaacttcccaggctgtaaaaatgcttcgagataaaattgcacagattgataaagtaatgtgtgaaggatcactccacattttaagactggcacttaccagaaataattgtgttaaagtatacaataagctgaagttaatggccactgtacaccagactcagcctacagtacaggtgttattatctacttctgaatttgttggagcattggacttaatagcaacaacacaagaggttctacagcaggaacttcagggcattcacagtttccggtatgttcattaagtaagccactagaaataatgttagaaatttttaaaggataaaattgagcatgtaatgttaaaagtgtgaatatattcaaagttaaatggatattttttcttccagattgatcatttgtttaataatgttattctgatattgtagtattagcaaaacaaaaaccataaggaataatattttcagagacatttggatggagaagcaaaattaaaatttctaggagatgagataaatgcaaggcca

SEQ ID NO: 94596 - DNA, 1055 bp, Homo sapiens
tcatggaaaacaatttttccatagaccaaggggtttgcggggagatagttttgggatgaacctttattatgcactttatttctactgttattacattgtaaaatataatgaaataattatacaattcatcataatggagagtcagtgggagccctgagcttattttccgggaactagatggtcccatctgggggagatgggagacagtgacagatcatcaggcattagattcttataaggagggcacaacctagatctctgacatgtgcagttcacattagggtttgtgctcctatgagaacctagtgccaccactgatctgacagaaggtggagctcagacggtaatgtgattgatggggactggctgtaaatacagatgaagctttgcttgtgcccactgctcacctcctgctgtgcaacctggttcctaacaggccatggcccaggggttggggaccactgagatagcataaagccttttatgtctgattaaaaagatttgagatgtattttgctgttttattgctgctatataattgattacaattacctgaaacattgttttgttcagcgctttgcctactactaggcatgtaataggtgcttgatagataatttgttgaaggaataaactttagttatttggatgtgacccagtacaatactgaatctgtcaaaatgtattttacggagttaaaatgaaaacaagttttaaaaataatatttcccttcttttttaaatagataaatccaggacagatctggagcaagtacctaaggtaacaaagcttaaacatgagaaaattgccttataatatttgatctttaattttgccttacaagcagatttcatttggcttttttttttttttgaccctttggctactttgtctcttgtggggctgtgttgcatcacttttcttctttctttctcacttttctttttttctttccttccttctgtcttttctgtctttctttctttttctttctgcttttctgttctttctcttaacttagacagaatcttgccccgtctcgcaggctggagtg

SEQ ID NO: 94597 - DNA, 1316 bp, Homo sapiens
acctaactctttagtttccctacaagcagtggttcaatatttgctaattcaatattcacaataactttatagaacaaatacactactaataatgagaatagagtaaaattttccttcttgtatggttaatgccacagcaacatttatgtcacctaattataagccaaaggatattttatctaggagatcctgccatgatataatagaaaagaggcctacctctaaaaaacagtggggtattaaaggatagaaaatacataatagaaagcagcatagttctgatgttgaaaaaaaaagatagagtaattgtacattaaggaaaggagttcatgaaagactttctttactattcactccaccctgcaatcgtagttctcaaattttgcatatcttttatctcgtgcatatttttcaaagccttagtaattgatgctgccagctgaaggttattcaatcagattgatttttattaaatcatttactgtggaagattagttggtttgcgtaagatggaatctgtgcatttttagttttctagtgtgtactttcaaacatagaaccaattttacagcatttacagagttctcttgtttactttttgcaggtgattcacatagtttatatgttgccccatctctagttacagatcaacatagatggactgtatatcattccaaagtaaatctcccagcagcattaaacgatcctagattagcaaaaagagaatctgacttcttcacaaaaacatggggattggactttgtggacactgaagtcataccttcattctacctcccacagatcagcaaggaacattttacagtatatcaacaggaaatctctcaggtaatatctaatcttggctagttacagtcaggtcaaaagtaatagaaatatttttagtatgctttattatagatttttgaccagtaatgtttgatgaacctatagtattcttttcgttcatacaaattgtactgtcctgggttgcatttaattctttgcttaaatatattttaatacatttctcttacagtagtgatttttcagaattacacattccaaataatgctaagattcaacatgaaacctaccctgcttaccaaggagaaaatgattctgttaggcctataaagtccagatgatttgtgaggtttgagaaattggcagaatattactgtttctgtgtctgattcactgcatacaattctatagagcaccctagctctagcagatagttataatatctccagacataattataacttaatatattactttaaaccctgtctgagagcaagaactgagtatagtgc

SEQ ID NO: 94598 - DNA, 1050 bp, Homo sapiens
ctcacgcctgtaatcccagcactttgggaggccaaggcgggtggatcacctgaggtcaggagttcaagactagcctgaccaatatggcgaaaccctgtctctactaaaattacagaaattagctgggcgtggtggcatgcgcctgtagtcccagatactcaggaggctgaggcaggagaatggcttgaaactgggaggcggaggttgcagtgaagccgcgattgcaccactgcactctagcctgctgacagtgagactgtctcaaaaaaaaaaagtttataataatagttgttgcaattatttattgaatgtctactatgtaccaagtattatgctatgaactcacataagttatttcatttaaatcttatgacattcctatgaggaagatactgctgctgtcccattttacaaattaggaaacagacttaggaaggtaagacagttgtcacacaactaataaatgacagtgatctaactgattgtatggccaatactcttaactagtatatcgttttacaaggaaggtggagatctagaatcaaatttcagaaagtcaagtaatgttaatacaaacaaggaaatatattttggatttatatttttagattatttgaaatgtatgtgaaccttttgaggtattgtgttagtggcttgtgtgtcttacacactttctgtgatattcattcatttgctcattcgttcattgaatagtcatgcagtttattgaatgcttagactttgtattgggtgtggtataggaaagtgaatgaaacaaatataagtaagtaagtttacagtatagtgggagagataggaaacaagcaggtaaataatcacataatttattttagtctagagtagtttcccacctttttaaaatgactgagtatccaagccattttcttaatagactatctcatactcttaatttgtctcattgtttcctcatatatggtggtttaaaccttactatcctacttccttctatttactgtaaactcaaaggtaggtctagagcaagggtgctgaaccttgagttcacagact

SEQ ID NO: 94599 - DNA, 1025 bp, Homo sapiens
aaacagacttaatttactgcaaatttggactactattgttttgaattgttatttttgcatatgtttttgaaattgtaaatagaatatagtcatatcttttttatccagaagtgatttttttttttcctggcagcttcaactaccaagaaaggagaagtaagctaagtgtttaactttatggataacacttatgttatatatgtatgtataacacttatgttatgtatgtatgtatgtatgttgtgaatgtccagaaaaattccaagcttataatgaatctttttttcccctatgagctccactttagactatttaatgtttttaacaagcttaatttgttgatgaaagaaggtaattgacagttgagatcacttttgctatttatcatccataccttatggataagttactcaagttattctttctgagcctcagttttctcatctataaaataggggtagtgataatccatgtattacaaggctattgtaagaattattaaatgaggtaatatgtattaagatgcagtgtcaactataatatactgtagaagagttattcgcttcagaagaatcaaattaggaaggaatatagaggttgtcaaaggcaggaatgtagatagtaaggcggagaatagtgatggctgacagcctctctagggaggagagaagcactaaatacaaatattgataacaaactagtaaaataactagtatatcactataatctgaaactccttaatataggggcaaactgacttccttctgtagcacctgagagtatcaccgttatagcacagtaaaataactgattattataatggtgaaattaacttattaagaaaagattaccttgttttcaaatatgctatttgagaagacttgaaaatatatatattttacttcagagttaaaatttttggaagtgacttattcaaaaagttttagtgtttttaagagtatgctgtcgttatttggattaattcccttttggggaataatccttttgtcttcatttactatgcc

SEQ ID NO: 94600 - DNA, 1047 bp, Homo sapiens
gcctcggtgcgacgtggagggctggaggcggcggcgatgcactaggcctcgctcagggcggctgccccgggacccgcaggtaggtgtgccccgcggccccccgcgcgtctcagcccactctcaccccgacctacagcggagagagggaccgagaccccaccccctcggctctcctccccagccccaaacggaccgagtttcggtcacagctgaccggcactgaagcttccatgctcctctccgccacttccttttttttttttttttttccttttcactctccctccgggatcggggctggcagctgtgttccctgcctcctgtcagcgaccgcaaacgccgctcttgcccctctcttatctttccgggatcccagctctggaacttccatcacccccttagacgctgcccccaaactttccttttctttttccagccaggcccttagtcctattggattctactggaatcgttaaaacatttgtttgtttttctctccggggaaggctaacccaaagagttactcagtattttgcattttggcaatgtagcttgaaataatttgtgcaataattttcttcagttctgcctccttccatctctgcatagacagaaagggcaggccctctctgccgtttctgctctcccgtcgttgacttgggaactttggcttgccaattataattagccgtttggtctgttcatgtgttgagttcaagatggtatttttagcattttgactgacaggcgtttcaaaaaaaaatttttttcttctaaccagctttattttttggtctttattgaggctctttcgaagaattaaattgtttggactgtttttgtttttaattggctgtatttctgatttgtcaaatcaagggcggtcttaatactaaacgcctttaagtaataccgtgataaattacttgtagtataccgagaaatattactgcgataacctaaactgcagattttgatgtacattcacttttataaatccgaaggggagttctaattggaaaaagcaccttcagagcctaaatgatt

SEQ ID NO: 94601 - DNA, 1025 bp, Homo sapiens
accaggtgtatagggacaagagaatgaacggttcacacaggctgtctgctatctacagccaggagctcccaaagtagtatgggctcaggtggcagctgcggaggggtagtgggaggaatcccctactgcgagtcttcccaagttgttttgcacaggggttggggaagagagaacaagcagttttttggagattggtctctctccccaactcccatctccctctttttctctgtctccctctcctctctcataaacacacccaccaaagaaatcctccaaattctggaataagtatagcttctcaaggtgactaggttgaaagaaacagtgttcacttgagtgtgtaaattctaacatgtttcttagtgtcatttctatattagtcatactgcatgaatgcaaatgttgattctatttttcattgattttattcaaagaactcaactgtgacaggaatccctgaatcaagtatactatgcaaagttggtatcttgttgcaaaggtaatacaactgtgaagtgatacttgttatgatgaaattaaagtcaaagatatgactcttgggatgtaaccttttgcagagaagcattaaaagaatgttattctgctttggtatatgctataggacttttaaagtttgagagttaacaatcaagagtttctttgcagctgcttttatggtttcattattgctactgatttcaaatatagccgtatttatttaccaaagtgttttaattcctctttaaatacaaaaggaccattgaaaatgttgtctgggtggaatttcacaaatacaaggaattcttcagacaaggcatgggtccaagccttaatccagtctggcctcagataccagtccttaaatgttcctttatcaaagtaggtaacaatgggcagttattcactgtaaataaactagggactgagtgaggggagttagaaaatatcaagataagcagtttgcccttcggagaggactcagttgtactgaagccagcatttcctatcattttgtaacatac

SEQ ID NO: 94602 - DNA, 1153 bp, Homo sapiens
ctttcttaaactaaacagcactccctctgatcttttctgttgccatctgtatatcttaaaccatatttacctcattaaaaatattagacttattgattagccagatgttttaatcataagttgtctttaccataaggctaaaaagaaatatgttaatgtttgatattttatccttgattttcaaacttaacatttttcataactactgtcagtttcttgaatatttagtgaaaatcctaggaaacctcatttcttgagtaaggagtacttaaaaccaaaacacttatgtaaaaatccaaaacagagtggtgaatatgtttttcaactcttgtctcctctaggtggaaattgaaaccaatcagttacaagatggctcgttaattgacctctgtggtgcaacattgttatggcgtactgcagaaggcctttcccacactcctaccgtgaagcatttagaagctttaagacaggaaatcaatgcagcacgacctcagtgccctgtagggttcaacacactagcatttcctagtatgaagaggaaagacgttgtagatgaaaaacaaccatgggtatatctaaactgcggccatgtacatggctatcataactggggaaacaaagaagaacgtgatggaaaagatcgtgaatgtcctatgtgtaggtctgttggtccctatgttcctctgtggcttggatgtgaagctggattttatgtggacgccggccctccaacccatgcgtttagcccgtgtgggcatgtgtgttcagaaaagacaactgcctattggtcccagatcccacttcctcatggtactcatacttttcatgcagcctgtcccttttgtgcacatcagttggctggtgaacaaggctacatcagacttatttttcaaggacctctagactaacagaccattgtcttgcaggactacattataaatttataagctaagtgagttgggttttcgaacctgttgtccacgtcacagtttttctgctctggtcatttgcattaagatgaagaattttttaaaacatttataataaatagtagcaatttctgagcaaaaatctgggaaactcaagcaaaggaatttctgaaagtatcagtcttctgaattctgagttttgaaaatatattttgaggagaaaa

SEQ ID NO: 94603 - DNA, 1098 bp, Homo sapiens
aaaggaattttaaataattataatgtgttaatagataattaattgggaattgattctgcaaggcaaagtcaaacatttgttttataattgtgcagttcttgcaagagatcacctatactttttttcccccatcaggtataatgggtctctcccaaatggcgatagaggaaggaggaaaagtaggtttgctttgtttaaaagacctaaggcaaatggggtgaagcccagcactgtgcatattgcttgtactcctcaggctgcaaaggtaaaaaaaaaaaaaaaaagctacataaattaacttggagaatttgaaagacttttatgtgttgtttgtattctctagcattccccttacatttctatttcagaaattgccttttgtttggattggagaagagactttggagacatggtatttgaagagctgccatatggaaggggaattggacttttaaaaaaaaaatgacaaaccaggatcagtgggtggaaattagaaggaaacactctgtttccttattaaaagaggtgggatgggggacagggctttatctagtacttagaattatgcagctgtctgccctgagaagtgggaagttcccactctgttactagaggggtctccctggactggatgaagaatgtgatgtataatatgtgtattcaggtattagaagcacatttggatgaggtaatttttaaactaagggtctttacttaagattctttgtattggttgtattcatttttggtttataacttcatatatttgagcatagtaccttgcacaaagtagacctcaataattattaagttgaatcaaagctatgaaggcaatatccaactgcatctacaatataacttctcaaccccctagcctatttcatgcttctagcccccttgtattcttctaacaaaatttccagaagctggaccaccatttcaggatacttgggcttttcctagagtgacagacaaggagggggaatttcacatctttatattttctgtgaattcatctgcctccaattttataacactgactttgtgttacaaagaatttaatattgtaatgagcaaataagaaaaattagaaagagt

SEQ ID NO: 94604 - DNA, 1048 bp, Homo sapiens
gggcaacagagcaagactccgtctcgaaaaaaatgagaaaaaagaaaattgctaattttattttccccctactgtttccctccttttgcctaaaaagcaactctagatattgcggtatgtttgagagtcaggttgttaaagtgagaatgcgttgtttcagttgagatagtaagagaaactggggaaatcatatggagttactgagcttgactggatgttaggaatcctagaatccggtgcttgttcagcactgctagctgtgtgaccttgggcaagtcactgaaccatcctgggccttagtttccttgtctgtaaaaatgacagataagatcatctaaggccctttgagacttaaaattcttttctcagaaacaaagctttaaaagatcataaatttagcatagtaactacagtattagaacttcaaatcacatagattttaatggtatcaatgacaaacagctcttaactaccaaaaacttttccagattaaattcttctagcaggaaatttgagagtcatttgaagaatagtttaatatttagcttagggttttaaaccgccagtcttagcctatgggttcctcagttaatcattagcaacagtaattgtctctgtgtctggtacttggtgtcttaaaatgcagataatttttcttctcaaccctctagaagtgaagctggacaaggtttcatgctgttgctgcttagaaaagagctttgaactacaggaacgcaatgtgggactaaagagcaagatccagaagtgggatgagtcatgcaactcagaggacagtagtgaaggggcagtgaggaatcgacagagggtctgggggcaatacaaagcctaaaatagctaaaataattattagctaaggggctgtactttggacttacagcaaggctagcaacattaccaagggctttctccaatacaaagtattttattttttataaagggtcaatgtagtttctatatatggcagtcattgagtaaactctcttctcagctttaaaacattcttccttgccagccacaattacaggcc

SEQ ID NO: 94605 - DNA, 1037 bp, Homo sapiens
ctgacacctactgaggtaggtgctggggcatgcccggccatcagggtgaaagtcctggctccctagttggcctacttttacattgccctaatagggcattggagctcctcactatggtttatgagctggaagtcaaggctcctcacttagctttcgttggtgtgggtggtggtggggcaaaactgttttctgggtttggctggagtggagcagttactgtcaaaagttttctgtcttgccaggctgtccctttcttgtttctttggctagagagagcaagcttttgttgtggctctttttgtctgtgccagttggcatttccaggttgctgccttctttagctccaagtctgggatatattaggcaaaaagaaaacccagagaatttacaccaccgtgtcattccatgggtcctgaggtcccttacttagtctgccttctctccacttttcacagtcttctcatgttttgtatataatgtccagggtctttagttatacttagcagaaataaaagggaaaagtatgtctgctctatgcttctgtaagtggaagtcttcaaatttgcatttttgattcctttaaacagttttgtaaaatatataatcattattgggcaaaatgtcccataaaatgtatataccttgtgatggtttgcataatattgtgttcaagaggactgctgaaaaataacatctttatttaaactgaaacgaattgttcacattattaatgaaaacttttcccctctaggaaataatgcaaaaggtgtcccaaggctcctgaccagtgaacaaagatttgagaaagacagccaagctcatgttttctcctgatcaagaaaatcatccatctaaagcaccagtaaaatatggtgaactcattgtcttagggtaaggtttctccatttgatgacacacacagtttaataatatatgctaactttggcatctaggctaaaagtacttttttttttggaatttatatcttacctgcttccaaaaagaatttaaagctacaggtaatgttaccaaatcaa

SEQ ID NO: 94606 - DNA, 2082 bp, Homo sapiens
atattaatagaggagatccttgctgagaatttaaatctgcatgaaattcatagatgtgtgtagaaatttaaatttatcatacactccgcagtaaatgccaataaaggtggatggcataattaggacaaagataacagtagaagcaaaataagaattttttaaaaaccttatggatgtcacattagtctgactcagtctgtaactctagttagaaatgtaaaattttagggatttttgggctactgtaagaaaagaatctgctttgggggtgggatgtgaggagaaagaaatgtttgtggcaattaagatgtatatagtatatttaagaagtacatttgcaattctaatcacttagttcaaaaggagaaaaatatatcatgtgtaactttatttacttttaatactattattattattacatgattgaaaatagaaaatcttgaaaaattctagagggtaaaagtgttatttctaattccattagctccttttaagataggaacatttcatattagtctcctagcacagaatctgaaccataataggcactccataaatgtttactgaactaacctgaattttagaaatatcagggtgcaaagcagaattatttttctaggctttaaaactataccactgctccttacccctgtacacaccttcgaatctcagttttgatacaaataggttctcagttttgggtgtgaagaaaactggttgatatttttttttaatctactaaatgttggccagagctgaaattgcctgaaagggaacttgatttagcagaattccttcttttcagaaagaaggacttagactaaattatatgaacgggaggagcctgtttttatctgagatggttgattggaaaaagaatagataaactaaggtggagagttgatttgaaaaaaggaaaaaagatagtcctgtctagtggtcagtcctaacagtgtggttaaaggggagctaaatttcaactttcaggggtcagctgagacaaccacctagattttccaagttagttccaatttcaagtacaataatcctttgacaacatagaaaagaattatagttagcaaaattgcaattgtcacagtcaaggtcttgttggtaatagagggttggggaaaaagttaaaacagcattaaatgaatatatttttaacataacaaaagttcccagaagacatccacttcaaattcaagccatattcatcaatgttaaaaaccttactcttctccctgatagtgtgaggaaaaataaaataaacttaaaataaaaaacaagaaaacctcactcaacattgtttgaaaaacataactgtgatgttatgatctactaaagcatggtatcccaacaaatttcatacagaatcatgcctgtctgaaactttacattttttgtagagacaaggactcactctgttgcccaggctggcctcaaactcctgtgctcaagcagtcctcctgcctgggcctcccaaagttctgggattacaggtgtgagccaccttgctcggcctcaaataaactcttaatggcttggaatttaacaggtcttgtgctttcattctcctttattttgttgttgttgtttaataaatatcagcacaagtgttatttaacaacctggacttttacaaattaataggcgttaagggaatcttttctttggtcttggtagtctatccatctttctaagagtataaagagatttttctttactatacagatgtaaagaggagttaataattgtcatactttttgttttttgattcagcacttcctaacagtcactgagcttacaaagccatggttcatgatttccacaaacttactttttatttatctcctaaccaaactccagggaacctactgacttaccctttcctgagaacacaatatactttttaccccttgtcttttttatctttatgcgattgtttcttccacctaaactggtttttttttttcacttatcaaagtccggtctgtctctcaaggtccaaattgaatacctctgctatgaagcttcctcttgttcctcttcctcctaagtaataacacttttctttgaagt

SEQ ID NO: 94607 - DNA, 1028 bp, Homo sapiens
ctgtgactttatgtggatcatcaatacaagcaattgtagactatattctattatacatattctagaatcagcaatgtatttatttgtttggtgtttacgtaagtcttagtgtgttttataaataataggagggtttgtttaaagtgggcttttgaagatacagtgtgactttaaaagaatggtcttagaaaacttataaatagcctaaatatgtactgaagaacatttcataatcacaaaaaaagaaataatatatctcatgaattattaagaatttgttttttaaataaagtcctctttttgaaaaggtattaagaagaggaattagacaaaacttgtttgaatatggttgtaattgcagtttactgagttatatataaaaaagcccaattagtttaaacaaatacagtatctgggtttatggtattctgagcctcgtattttttcattgaatgtcaggggtatattaaaatgcctccctttatgtttctatacaaaagattgttctgacagtaagtttaagtgattttcacaacttattgctgtctaaaaatttcccttgacttcacattttgttctgaatatgttggtttctttcctccacccacacaatgttgaaggcaagggaagcaagagttgcaaagtaatacagtgaatttgagaaccctggctttttttcaaaacaaaataaacctttattataagattgctttttattgataccaaaaaagggtggcactttggcaaatggtcagtaagtgtatgaatagcctaattgatttagctggaatgaataagaagctttgctatttgtccttgtagatagttggctcagtaaacattgtgatggtgatagaccaaattttccatggtgaaaggtaaaacagaacagcaacaaaaaactcatcaaacttatagatccaaatatcagcaattttgtgtctgtgtcaaggtcttcaaagaaggagcaatgtgttaattaggatctcatttgaatttctatagtgaaaaaataatcattttaactt

SEQ ID NO: 94608 - DNA, 1951 bp, Homo sapiens
catctattcattactctgccaatagctctctttatcatcctttgccagctttagtcatgcctattgctcttcaacagcgttttctatgtttgtctgccatttttatacttataaagtagacttggaatgaattaaggttataaagtagtaacctgtggatggcaagtacaatacttttcctatttgtgccatacttaatctttttaaactttccttgcctatttctggtgtgtgccttggtggagatctctcatcagacactaagagataactacatgacctgtaggatgcaatacttttttaactcaataatgtaggaaacagtaggaaacagtttgagtttaaactcaaactcattgagttaatcctgcatccatccagaacctacatacctaaactagcaaagtttgatagtaaaattaacagcctagtggaatttcaaaaactattttcagctcttgatgtttgttgtcttttctaaaaatgtcaaacaattggggacctcatcattactgtaatactaaccatatatgaccttaggggaaaactgtacttctgttgagcatctctttgacagtcaagaggaaaagataaaaagataagtaatgtggtaaagaaggttataacttcttccttccacaagaatgaattatgaagtgactggccctgatatttttctagtaactcattgtagtgctcaacatatcatttggcttaatctttagaaggcacagtttaattttattttttaacaataagtgaaaacaattgaaagtgctttgttggtttttcaaaactttaatgttgaattcctggttcttggcagatactatccgtagtatttcatgttcctctgggtttatttcagatttaatgaactgcatgtactggaagcactaaaagctgattggctttaatttagactacagttagcatgatggatttttctttgaattgttctcactgtcattctttaaatttaccatcaaaggatcaaaacatccaaattacaaaactaagtttatcattcatgagaaaatgtgttaaatacgtatcttttgtaaagtagcggctgcttctaattagaaaccggtcctatagacataccttatgtatcaaaaagctttttaaatatacttactgctttactgttactttcatttaaaataggatgattcagtttctgaactagccctgtctgttctccaaaggaactaggatgaattttgaggaggggctcttaaactttgagcagatctgtaacttcattgagagcagacatttttaaaaattcatcactgacatttattcaacaaaaagaagatcagattttgctaaagccttttggttgtgtctcttttagaaataacgtgttgatttagttgcatatagttcagctcttaaggaccagtctttaaggctttagccagaatttgtctcctaaagctgactttaaaatggcttccaaaaggatttgctgagtttcagaactgagtaggctgctaatgattcagtaggccccctcattttcctcctactccttaaattgaaggctccttcataccatctaggtaccctgagtcatcatggataaactctaaagaagaattgtcatatggaaaaactctacatgaagtaagaatgtcagaaagcagtctgagtcagagatcattcattgctcacaatgataaaatctataggttgtgggcttcattttaaatcttttaacatacttccatgtatgtccttattataggattataaatcctataatgcccataaaaccatctgaggtgtttattcccagttaatttctaattggtttggtttttattatctattacatgaaaaggattttgtattttttattgaataaatagagaggagaggcaatatgatacaggataaaaaccactatatcagaagttaggggacctggagttctggttta

SEQ ID NO: 94609 - DNA, 1090 bp, Homo sapiens
aaaacaaaacaaaaaaaactagcgtaactagatcagggtgagcgtgagtacataaaatcagcatcagcatgggaaaggaaggttagagaagactaaattgtgtagggctggttatccatctttaaaggaaaaatattttatacacttatctaaaataagtcttatactttagagtagtcaccatggaagctatacacttaacaatactagcattactcaatatttttagaaaaaaaaattttttttgtcgtctaagccagtttaagagccacacgtgaaaatagctcattactttgtatttgctccttgtttttaaggaaaaaaggggtgattggccacgtgatatttcatgttatttatcagatatgactcacagaggatcttgacagaaagaaaatgggaagtaacttgaggctatttctaaaaatcagatccagtctgagaaggcagttattgtttgtaaaagtcagatccacccatagactaaaaaggaattttaataatgttgtggataattgtagcatcatttggaataagggtatataacctctgagagtgactagtatggaaggcaccatactaatttggatattttaaggtctcacaaaatgcgcacacacacacacacatacaagatcatatacaattcttaatactaagtatcaaaacagtaatttcaggtaaatttcatttatattctgcattcaagactaaagggatggtatttaaaacacagtgaaattgtttaagtcttgtcgctatggcatacacttggggaaggaactaaaagactaacacatgttagtgttaagagatgaatctggttcttaagtcttcttatattcatgcttcatttctcagattagtagttgttttgagaacattctgatttaccataagaactgtttttattaaaaaaggcataggaaaaattggatctcatctaaatgtttaaatgcccccaaaaacctcaataaatatggattgtaaaaatctactctcaggacaatatacatgtaggattactaattttgaacaattactatactagttcattctttagaggtacagtttttccaacctgagaaac

SEQ ID NO: 94610 - DNA, 2970 bp, Homo sapiens
tggcgggcgcggagggcagcggcggaacggcgggctgtctgctcgcgctccccgcgcacaacacttcaccctctcgcctcgggtctcgggggccgctctgggatcccggccaccagcaattgtccggtaagtgtgaccgcggggcgccgcgggatggatggcggcggggccgccgaggggcgcggggagggcgggcgcgcaacttcctcggcggcttccccggcggccagcagccggctctccccgcccgcctgcgcgcccccgctgcggcggggagcggagtttgcggcgcctgcatcccgcgccctggctcgaggaagcgcctttgtcaggaaccggccctacgcggcctccccctccgcccgggagcggggcgcgcggcggccaactccgagccccgcgcctggctggccgcgcgctccggctgcgagaggggagctctgcgggtggcggggaggagagggaaatgggagaaacaaaaggggcggtgggtttcccttttgtttgtgcggatctgataacttcttttcctcccttacataacgcagacttcaagttagtcattctttttattgttatgattgttgtcatcatctctgcgcgtctttcacatttcctttcatctttggatctcagagcattttaaacacgctaattaatttcacccccgggtcccctaggaaacaagttaatacgcccgtttccctaagtgggtaaactgaggtcgtgaaaagctctcaaattgatggatacgcttgatcttctaccgcgcctcgtgtctgagtatatgaaagcgtttatgaggaagaacccgttctccaaagccccgtggaaaagttaaagatgctcattttacttacaggttaactgaagtccaaaagatgtctaggtaattgttacgtagttcaaaccataattcttcttacatagtgtttgaatcttaaaacctctaaagacttagtgaaaaatgctccgagtagggaaattaatgtaaatcataaactcacgtcaccatctacttttatttttgtacgtgcaggtctgttagaggcaagagagcaagaaggggacagagggcagaggttttttaaaaatgtacatttaacagattttaatcactacacacaaggaaatgtgccttggttttaacagcaccaacaatattcctgtcgtttagtcatcaaacagtatatcaacaaatgttattgagaactttattcataaggtgctggttgtgctaaaaactgaagctttatatataagaaaaggtcatctgtttcggttcacaggctctttactttttcttactctgcaaaatgttactttgttttcattgcacatgatcttttgtttcagaaatggcattgtcctttactgtgtcgaatatgtattactcttacacttaaggataaatgaatttattattaagttttcataatagggtgaatttaaaatattttaattgtggtaaaggttcactttattcagttctgtttcagtttacgatgcgttttctttatagccaacaaaatattttctgagtgataagatttacatgtctcaaaacattgttcttagtgtacaaatacagcatatgaattccttgttttttttatttataccaacaacctcttctggggaaaagtctttaactctgaggaccttatttattttgtgagtttttatttcttcggtaccatactggaaagcaccaaaaatttaaaccaagcatcacttctactagctctttcctcaggtaaataataatcagaactgtagtaatagtgaatagtttcacttactctaaattctcttaaatttaattttgtactatatagttgtccttacattttagattttggtggttgcatcagaaaatgaaagtgagatgttcgttattttattttttttcccaaagccttctaacctgttccctttctatagtatgttaaaagagatcttgagtttaaaataaataattggaaagtagaacagttatatgtatggaaagttgcatgtagtgaagtggttatagtgtctcatgtagtgaatgtacaggttttaaagaggaaactatcacctagctttttattagcatggtagaagtgctgtaatgtaatagtagtagtatttatttgcttctaaaaagtaagctggaaatttgcctcagtggaatttgtagggggagggaatccattctttccttaagattggcatttaaatgttcttacagttggttatgttgaactttttctgtggtattttcaagccagatttaccaggaacatttgtacttcaaggaagctactaacactgtcttggctcagtcactggaatccacaggcagaagttagtgttgactggcaaagtctggctttgcaggtttcataatttctttgagaccccttaaaggaaatgactgaaaagtacggggtaggaagttagtctagtactgccaaatgccactgaggcaagtttcaaaggggaagccaaaggatgtttccatttgatttaagttcagcctcttctgggttgtcagaatgtcacttttgtattttaagagttctatcatttcagaatatgatgtattatggttttctagtaggtcaggtggtaaggactgtagatagtcattatgcttcgtggacaactaatgtttttaggcagaagcttctatagctgataaagattttaagccaaagacttagaattgaaaactaatatatacatacacattttaccataatacatcaatgtagacctatcctagtatttattaggttagaaaggctttttggattattttattatacagatatatttaactgtaaatattaaaatttcataatgactaatatatgatggcactgaggtggctttaggagctcctttggggtgggggcgggaaacatgttattccaaaagttacatttatgtctttgaggacagtaaagcagatttaaaagccag

SEQ ID NO: 94611 - DNA, 1758 bp, Homo sapiens
aggatgggttttgttcgggggtgatgagattatctaagagacggtgaagaggcatcatctgcagacactgtgtgcatgtggaaggctgctggattccaccacatctgtgtgggttcttcctccagccccccaaaaaagagcccatggaaagccaatctgtgtacttctatttttagaaactagatgatggccatttaaacaactctttgagctctccagttcaagcggacgtgtacttcccacgactggtaaatgattttgctctgtgtctctgcctgtaccttcctcctttctcattgctttttaaaattttattcatttgtttattgcattttccagtgggtcaggccttcagggtctgaggtcttggcttttccctaacaggctgtaaaattcatttttcttctcccacccttttcagatagttccattttgtgggcacattaaaggtggcatgagaccaggcaagaaggtgttagtgatgggcatcgtagacctcaacccagagaggtaaggcagagtctttgtcaggacagaactatcaggctgtggctgagccctgcccacttctgttgtggtttagcactcctcttcctctccttgtggacagtgttgctagttgccagtgccaagaaagtaccatgttcccatgaaacgaatatgtatgaatcccagccatcatttctccagacagctatttatatcagagattataaatataggcccacattttctctttgacccttagggaggccagaggatttttttttttttttttaatggttttgaaacatggtgccaggagcaagaactatcaagatgaataagaacccaacttaacattatttcccctggtcaatttctgtggctgtttttgagaattccgaagtggaattctctaattttagtcattttcaacaccaaagttttcaccagagcttgctttaggtaacaaaataagctggtttgacttacttctccataatctaacctctcttgaagagtagtggcctcttaaaaatggacaaacccagaggaggaagaagaaatataagcacttgggtcattttgaaatgtttttatatccaacccttaatcagtgggatgattttcttttcagctttgcaatcagcttgacctgtggggactcagaagaccctcctgccgatgtggcaatcgaactcaaagctgtgttcacagatcggcagctactcagaaattcttgtatatctggggagaggggtgaagaacagtcagcaatcccttactttccattcattccagaccagccattcagggtgagtacctcgagtgcctcggctccagccactggcaggctgataatgttcgacttacctagtgtgtgccaagaacacttgaagcagccagaatttctgcatgtccaggaaatttgtcacccaatggtgaaaaaaaaagatcaaaagagctctgtttgctgatataaattaacacttgccatagtatcttcttagttctattcaggtcatacatttaaatagacccatatttacatgtccaaattgttaagaataagtaacttttctatgtagtacccaacatatagtagatacctacccccaaatatctgattgattaatcaatactaagtacccacttattaaatattaatattaataaggttgagagctaataagtagctcttttatttgtatgacattttaaagaatatgatgatgatcatttcattttctcttgttccctttgctaatgaggcca

SEQ ID NO: 94612 - DNA, 1034 bp, Homo sapiens
aatgcctttggaagcttcagagtagaagatgcttcctactgtgttggctctgaggagatagtaggattagataggatccagattaggaaatgatccagttagtttatctgaaaggttaactcccaggactccaggtctttgaatccagccagtagagtgaatgcttccaattaagctgtaggtgttaccctgcacttacggaactgatcaaacaggtgactccaacaggaggttgcagtactgtaaacgtcaccgcaaggcaagggatgcttaaagtcctgggttctggactttaaaagctacattggccctggagggagggacccttggcattgctttgatcaggtagtgagggaagacagggttctggggtgggggtgtatttatatataatttaggttttgtttgtacagcatactgtgtcttgtaatgacacatccttgtcctgctttccttttttgagttttttttttttttttacacaacatgcagaggcactgaagtgaccatgtcattttcaagtgtcaagaatgtagacagtgtttcagtaccaaagtctaaaataaactaaaattatgaattttttataggtgatacatttggattcttctcaactttgaaactgtttagcacagttccattgtattatataagaagacactgtatccaacaagactggctgtacattgaaaagctttatgtaccagccaacttatttaaccatattcagcctgttccgtgggggctgttctgtggttccaggtattttcaagcctgtgattaacttctcatggcttgtcacttaaaagtccctaaatttgagagacttaaagggcaccttgaaatacatttgtggagttttgatccaacttatggtggaagagccccataggaagactgttttgagtggccaaccattcccacccactgcataattcagcagaaactagaggagcagggcgtgtactgattggaattgacacgcttattctgtctacctatcagctaactcattagcagccaagcccttaggc

SEQ ID NO: 94613 - DNA, 1033 bp, Homo sapiens
gtggcagagaagtctggggtggatagaatagggtgaacaagtagaagagtagtacaaattgtgatcagagttagagggtgagaggggcagtgttttagggtccttacagaaattctaatgacttaggctttttactgtgggagatggtaagtcattgcaggatttttgagtaaaggtgtaagataatttatgttgtaaaaggatctgtctagctgttatatagaaaatagactataggagtggaatgtaagaatagaagcagagtcaggagagaattgtgctggtagagttaagaagagatggtagtggcatgaaccaagatggtagcagtagagatgagaagtggtaggacagtttcttgaattggaatctgcaataattccctcatttttaaactcagaaagcttacagaggcactcccttctgaaaattcaaggcccttgcaacctatgtttccagcttactgcctgtacccttcatatatcctgtgttctaaccatattttattatgtgtcttactgttccttgataggggccccatgctttatctttaatgactaccatttcctctgtcaattaaatccttcctatttcaaattttctcctttttgaagttttttttttttcaccattccttctcttcccaatcaagtgtgatctttttcttagaatcttggtagccacattttacttcagtgatgtttatattctatcttgcattatttttgctgttctcttgtattattctccttaattagctgtaagtttctttaaggttgtgactccttttactcagttctaccacagttttgtatgtaatagatgctcagtaaatagtgggtgtatacatatttaaattttttaaaatagtcttattgcagaggcatacaggagcatcatagaaaatagacaagcaaaaaaaaacaaatcacttttttttttttttgagacagagtctcactgtgtcacccaggctggagtacagtggagtgatcatggctcactgcagcacagacctcctgggctcaggcag

SEQ ID NO: 94614 - DNA, 1756 bp, Homo sapiens
acacttgaaagtttctctccaggagattttagaactaatatgaatgttgttcatcaaaacaagcagttagagagctgcaatggtgaaaagcctccttgtctggagattctaacaaatgggtttgcagtgttggaaactgtaaatcctcagggaacagatgatctggacaatgtagctgattcaaagggacggaagcctcttagcactcatagcactgagtataatttagactctgtacctagtcctgctgaggaatttgcagattttgccacattttccaaaaaggaaaggatacaattagaagaaatagaatgtgcagttttaaatgatagagaagcactaaccattcgggaaaacaataaaattaatagagtcaatgaactgaattctgtaaaagaagtggctttgggtagaagcttggataacaaaggagacactgatggagaggatcaggtttgtgtttcagaaataagcatagtgactaacagaggtttcagtgttgaaaaacaaggccttccaacactgcaacaggatgaatttttacagtcaggtgttcagtcaaaggcttggagtttggtagactcagctgataattcagaagccattaggagagaacaatgtaaaactgaagaaaaacttgacttacttacttctaaatgtgctcacctatgcatggattctgttaaaacttctgatgatgaagttggttctcccaaagaagaaagtagaaagtttactaatttccaaagcccaaacattgaccccacagaagaaaatgatttggatgattctttaagtgtaaaaaatggtgatagtagtaatgactttgtgacttgcaatgatatcaatgaagatgattttggtgattttggtgactttggctctgccagtggctcaactccaccttttgttactggtactcaagattcaatgagtgatgccacttttgaagagtcttcagagcactttccacattttagtgaaccaggtgatgactttggagaatttggggatataaatgctgtttcttgccaagaggagacaatattaacaaagtcagacctaaaacagacttctgataatttatcagaagaatgtcaattggcaagaaaatctagtggaacaggcactgaacctgttgcaaaacttaaaaatgggcaagaaggtgagattggacattttgattctgtgccaaatattcaggatgactgcaatggttttcaagactctgatgattttgcagacttcagttcagctggtcctagccaagttgtagattggaatgcttttgaggatgaacaaaaagatagttgttcttgggctgcttttggagaccagcaggctactgaatctcatcatcgaaaggaagcctggcagtcacataggacagatgaaaatattgatactccaggaacccccaaaacgcacagtgtaccttcagcaacttccaaaggagcagttgctagtggccatttacaggaatcagccacttcagttcaggtatttactaattttctctattttgtatgatgtattaattgttgtggaggcttctaatttcagcttttcaaaaaatattttttcaactgagtacttgttaaaggagtctcgttatgatgtataatgcctgtctgatttgtgggttggttacatttttcacaaccctttgggaaactacaaatagtcctatagtaaagcgcagtaagatttttctttatctcaatgagtttcgttaatatttacagatactcatcaa

SEQ ID NO: 94615 - DNA, 1041 bp, Homo sapiens
gtttcacaatgttggtcaggctggtctcgaactcctgaccttgtgatctgcctgcctcggcctcccaaagtgctggaattacaggcatgagccaccgcgcccagctgagaagcaaagtattcttaatgcctaatgtgtggtttatacattttgtgtttcataatgcaatcaagatttaagtcataatgcctgtaagccaaccaccaatatccaaaatttaaactctacaaggagtaactatagcaggtttcatttatataagagactcttaaaaatagatactcttaaaaactaggtacttttttttcccccaactcaataggatgaccttgggaaggatgcagaatgcttagattatttaatttcttgttatatcataatatggtagaaattgataaattgagataagtattttcatagtgatttagaatgctaaatcatggtagagaaacattcttagtgagctttgattctagttttgccattcatttatttcattccctggcaagccccctgtgtctgtatgtatcatttgtataataacagtagtaatgataaaagctgccacctctgacaccctcggtgccaaatatttaatcctctgaattatcatccacctcgtgaggtagatagaccctgatatctccagattataaatgcagaaactgggcagaaatggtggtagacgcctataatcccagttacttgggaggctaaggcagcagaatcgcttgaacctgagaggccaaggttgcagtgagccgagatcgcaccactgcactccagcctcggtgacagagtaagactccatctcaaaaaaataaaaaataaaaaataaaataaataaatgcagaaactggagtcttggcccctggatctatagccctctattgaagtgttattataccagtcatttacttactggaattaactagtagtaagttaaatttggccttatttattacccaaaacaagatagtggtgagaaactcattacaggatgcccttaccaccaaactggtcttatggaaattgatacac

SEQ ID NO: 94616 - DNA, 1028 bp, Homo sapiens
acttccctgaagcacttgctggaaacaagcactttgccaataaaaacgagagaggccttacctgaaagtgggtaagtaggagactgtttttagatagcatgtgtttttgttatttttagtagttctaatttataagtttatcttaaaacattaaggttcaggccaggcgcagtggatcacctgaggtcaggagtttgagaccagcctagccaacatggtgaaaccctgtctctactaaaaatacagaaaattagcagggtatggtggcacatgcctgtaatcccagctacttgggattgaggttgaggcacaagaatcgctggaacccagaagacggaggttgcagtgagccaagatcactgcactccagcctcagtgacagaacaaggctctatctccaaaaaaaaaaaaattaaggctcaaaaacattgtgtcaaaacctaaactccctgcctttttacttttgagctatttctttttatatttctaaatcaataatcagttgatgttatatattattttttgacttcttagaatgaaaactgaaaatttagattttacctctgctattctcctcccctcatcttccccatatatcagtttttggttaatttcttatttggcattttcattattataatcacgtatgtattgttgactcaagccactgttttctttatagtacaacttcttcctggacttctctttttcattaatgtttccctaccctttaagagcttgttcatacacttgtgatccaacaccttatcattctgctcccatctagaatggtttcagtctgggcttacacatacattgcctcgggacttcccttcacttagatcccattttggtggagcatatcctccaatagccttctgagaaaaaaggtagatgggaggcaaatttttactctactctcacattcaatttatagtttaagatctgtttgttgctgatattctgaaatttcacagtgaaatacctttttttctttgagacagtctcgctctgttgcccaggctgga

SEQ ID NO: 94617 - DNA, 1023 bp, Homo sapiens
ctacagtagagaagacaagcacatctaccaggtaaataaatagtgtcaattatacccacattttgaattctgagataaaacgacccaaaggaaaaagcatgtcagttgacagcatttcaatatattatatcacaacttgctttataaaagtcagtcgatgcccaagtccagaaaatattatcaaattatgtttaattatgaactttattagaacaggattatttcataagagattggccaaggctgacagatgtggttttcttcccccaccccctgcccccccacctcactttgtagagactaattctgattaagtattgtgatcataaagccattatagaaacactctccctttctcttcataattactgagaagatcatctttgagaacccagttttgtaatcctggagtcacctaggctgatctttttacttgcaggctaagatggttcttggaattttcattgacatgcacctctgatttgggaggtaaagccttactttaccaggctttctagaagccccttcagaggcatggcctattgaagagcaattaccatctccctgtgttggaactaaaggcacggaatgtcactcgggccatgtgtttgcgattcagagaatctttagtttcatatgattaggctagtacaatccattgctttgagttattgttaaccataagactaagccagtttctaacaggaagatactattctgaaccaggaaatcactagtgcaaaagcaaatactggttgattgacacgccagctctgctgtctcaaatctgtgatgcatcagcattttaaagtggaactatttacctattagttgcctactttaaaagaagtgttatagctctttctcctgaataaatacatcccaatcacatgttaaattcaggtttatattttaaatagattcttctatagaaagacatccatttaaaaaagccttttttattgtgaataataaatgtttctctctcttaactttagcttgaattatcatattgtcttttaa

SEQ ID NO: 94618 - DNA, 1048 bp, Homo sapiens
ttgaataaagtaaactgcaaaaaataaagctcagcaaaatcttcttggctattgccaataagcagaagataaagtgaaaaggcattttgatagactatagggtaagaaggagttaaacagtggtcaaggtagaagaaatttgacatggaccaaacaatatccagtactctttactaagtgcctttgagtgtctcagggaatttatatgtgctcttctcttttggaacacaagttgtgaaagtgacttctcactttgagttttttaaagaagtgcaagttcttagttttaaaatagttccatcttcttgcctaactttcctaatatggaggaaaattacttcctattctaaatcactactaattagtgacagctagttagtagccatagacctgtaactgaagtttatgcaggtcaaagaaattttattcttttttaggcctttttattgagataaaaatttataattcattcaggtgttcaattcactggtttttagtatattcacaaggttgtgcaaccatcatcactatctaattccaaaacatttttatcaccccaaaaagaaaccctgtacccattagcagtcactccttatccctctcgttccccaggccctggcaactactaatctgctttctgtctctacagatttgtcttttctggttatttcatatagatggaattctatagtctgcagccttttgtgtctcggttttgcttagcattctgttctcaagttcattcatgttgtagtatgtatccgtatttgttttttggctgcataatatttcattggaaatagcacattttgcttttccattaatcagttgataattgggttgttttcactttttgactattatgagtagtgttgctgctgtgaacacttgtgtatacgtttttgtgtggacagatgtttccaactctgttaggagtggaatttctgggtcttataggaactctaacttctttggggaactgccaaacttttccaaagtgatggcaccattttacattcccaccagtaatatacattccaagttctcc

SEQ ID NO: 94619 - DNA, 1022 bp, Homo sapiens
gaatgatgcagatatccagttccccatcaaacgtccacataatagttttgccactatttaagtgcaattaaaaatgtagattttcatcagaaaaaaatgttggattgctattccattcttctaagaacctagtactgaatgcagtatttggttcatctgctatatgcctgatgctttttcccttttgaaaaactttagtcctaaaagtcgttggatttttcattcattctataaaatctttttatttcagtctggattcaaagtggtaacagaaaagtcctaggaataaaaaagcctgtagctatccttcctttcttgctttacctcctggcttcctgcaccccatccaaggaaaaaggaaacatttaggtcaaagaaataccttgtgtcacatctaagaataccagctatcctttaccataaaagagaattattaggctttttataatgaacaacttgaaatgatttttggtctaaagcgaataatatgtataactactcctttaatatatttaatatcccagaaaaagtttgaattgcaatcatgtgcccaatttgaggctcatttggcattttctgtggctcacctgctgagtagacctgggtcaccaggcattttcttgtctgtgttaggcaccaaactgctaatttcccatatcgggggccagtgcagcaaaatctacttcatctacaggacccataggatttgagatttccctcacccagagttccgtcctgcctgtgtacgtgcataataacaccagcaaccagccctagtgctgctgcttttggacctgctgtctgtatcccaacaggctgagactgggtcttctgagctgagagctttctctcctggaattccccactggggataaagagagcctgaggttaaaatgacttagtctttccctgggcacactttgtttcaggctgaggtagttttagcgggtggaggggcagggaaaaacccagttaggtggagtgttactaaggcttcagatttatatttctgtttagtaaca

SEQ ID NO: 94620 - DNA, 1037 bp, Homo sapiens
tagaaaaatgtaaataatcgggggtaaacatttttgaagatttattctttttgtgttgctggggtgtatacatttatgtctttgtgaaatacactggtggtgtccttcttacaaaacttttgaaataaaaaaaaaactcaaatcttcactgtctgtgaaatccccttcagtcttttcagattgcattgactgtcctcttgatttttcatattacatgtcaaattacttttgctatcataaataagctccaaagtcccccatttaatttttttttaattttgtgtatgatgggtttcagatctggcttttgttaacattttggggcttttttaatcttttcaatctggcgtattgctgtttgaccttttgcaaggtacttaattgctcttttgttatagggtatggatcattgtcagaacttgattggaggggtttaaagagattgtgtctgtttaaaatcagtatgattcagagaaggaccaaattatatgaatgtcttacaatggaatttacttgttactgatttttttgttctattgtaccactattttttgaggattttgcacagtgtaaaatgacataatcatagattgctatggtttaggctgtatatacagtgaaaactatgggttttaaatgtttggggaaattcctatggaaaaaagagagacatgtagaagaacctctaacaaggttaatgtgcatgcccaaggtcttttgaaatttcagtgtgtaaatttccttttagcttatacaaaaataaaataatttaaaagaaatttagcctggtgtctttgtactttggtatgtgaggaaaaatgtaatgagtttgaatgagaagttttgttgaatattaacatatttcaatccagagaaaatctttggtagggcttctactttgttgaagccaggaagaattagaatctggcctataagaattggatcagcacttttagtagctgagctgtttgtttttatatagaacatgagatcagtaaagaaattcccatgattcattataatgtgtcttcatcaga

SEQ ID NO: 94621 - DNA, 1029 bp, Homo sapiens
cttgtagttcatctttctttatagaatgagagaagcccagcactcaacatctttcttgtctgggtcctgggttcacaccacactcgccctcaggatgtgctgctttgccagcacgcaccagcagcctgcctccacgtgtccttgcttgcacctgccccttctgcttgtggaaattctgcccatcattccaaggccaaactcaaatgcctgtccatgaaacctctgcatgcctggagtcaaaaccagccttttcctcttctgggctttcccagagctccatgcctccgcaaatgcacttagcaagtcctgccgcgtcttcggattagctgtgcagtttgttgtctctgtactccctgtatccttaagagcagcaaccctgtgttgtttatctttgacagaggttggcaaactgcagcttacaggccagatcctgtccactgcctgcttttgtaagaaaagcattgctggaacctggccacgctcgtgtatctgtgtgttgccctgtctgctgtcttactacgatggcagagttgagtagttgcaaaaagaccacatggccctcaaagtctgaactatttgctatttggccctttacagaaaaagtttgccaaatcctgatctttgcaactctcccaatactgagaacagcgtctgaccatagatgggataggctcagggctacatagactggggacacacacccctggaaagatgaatacggtacaggcgtcaggggagtcctaagggtgcagaatgctggaggtggggtttcgagggccagacggggcagagtagtctggaaagttacacaagagtggacatattcagagagcttaagacttgggaggggccatagagctagatcttcccaccaaaggggcctttttgacagatgtgcaaactgaggcccagagagggaaaaggattattgtctggggcaaaatagtttatagcatcagagttcagtttggctctgctaccagatctcccaagcttgaatcctggcacctacaatcttgggcaagttcc

SEQ ID NO: 94622 - DNA, 1066 bp, Homo sapiens
tcagcttatttgtgacagtttgctcacattaagcaaagtccagcaagagagagcagcaggggggccccgaaggagtgcgtgctgttggtcttcctgaaccgtcctggtctcaggaaccacccttctctcctggttctcctcctgcttcttggacccttctggacctcctttttctcacatctgtgccccagctctctttaaaacattgtcttttccagggtttggcccatgactgcacttcactgagcctccattcctgctgcctcttgctttcccaaggtgatctaatccactcaggactctcaaaactggtctccagcccctgcctctctcctgagctccagacttcagtatctaccaagatttgctccctcactctcagcgcgtctaaagagctctcgtttcccctgggggctgattcttctgtgggctcgttgtcttcagcactctgctccacgcttggctcagttgcccacccttgcaccctgttccgcagtcccagccatgtcattccctctgccaccacctctccatcctcaccatagcgtccccagctcggaccctttctctctccttgcctctgaccgccgtacctgtttcctgactagtcttcctgctgtgatcgtctctctaccatccctgatgctggagttgacattctaaaatgccagtgggtcacgtggttgttgcacgtcctccaggtgtacccactgattataccatctggaccctgcccctgctgtcttccagtggggagtgggggagaccctgtgcaacctccttggccactgggctgtcttggatggagtcatgggatctggcctcacctggcctaggcagttttttattttggtgtggttgggccaccacaccactggcaagggaaaagggatggatgtgtgagacctgggaagtgaaggttcagctcaatcagcagtggaatgtgaggtggggtgtgaagtgctggggaggtgttaggggctgaattgtttcccccaaaaaggtaggtttcagtacctcagaatgtgactttaatttggaagtggggtctttatagaggtaatta

SEQ ID NO: 94623 - DNA, 1107 bp, Homo sapiens
acatgtgcagaatgtatggtaggaatgtattctcttgtaggaatgtaaatctgtattaaaagggggtccaagccaggcccccaggtcttctcattgtatgcacagtccgcattcatttttactcttctctaatatgggtctatttgaaatatgcaaaaggtatgaggaatgttttaatacctccaaatttttaagaaaagcatcaaagggttgatattttttaaagtttttttagtagcactttctctggatgacagaaggagcaaccacatgggcacccttgttcataccaaagggtgagcagtggccagagcctcctctgcacctctcgagtgtctttaccaattgagctttttatcgccatagccccttggagtgccccagctgccctgaggtcaatcaaggaaaatttcttaatgaaataagctccaaagagccaaagtatcaacttacagatcgtttttaaagcttaaatttatgaaccacctttgtggtaaacaatgaattatgaataccgcagggcagccttcttaaatgacaaatgtaaaaaaaaaaaaaaaaaagactctacttcgtgcagcaattgctactctatacgaattgtcttaatttgaaaaccttgctgttacaaattggacctttatacattttctgaaaacaatgaaaagagtatatttaaccttttctggctgtaaatggttaccttcctgtaactgccccgcacctggaggcatggagttgtgtgcatcctgcttatgtacaattgttttcagtgtttctaagaatgagtctgaatggttcttgaaaattagccaggatcaaatgctattgcagacaaagccaataaaaagttggacttcttttggggataacaagttttggaagagaaatgcaggccatatgtgcgcatgaccgagattttgaaaaaagatgtacatagtgacatgtttggtgcatggtttttgaggagggcttttgtcaaaaaggaggtataacctttcccccacagacctgagagctgtgccttttctatgcaatattacagacgttacatcggaacccagatggctgtattcacatgtaggtttgggctgtaatctaaacaat

SEQ ID NO: 94624 - DNA, 2241 bp, Homo sapiens
gagatagctattttgataggatttgctcacatagttcctgcaaacttcagatgtacaagttgcacttgtacttttatagagttgtaatgttttatatgtgtatggtgcaagagaaaattggatcaaatcaatctgcagttgatgtccccaaatgcaaacacaggcacacacatgcacacacccataaacacacacacagtgctttaagaaagggccaggtgatatcacacccaaatttcacaagcactgaccccctggcaccaacacccgccagtactgtgacttccaaagccagagccacatgtgctcatcaaacttgcattaagcagttggcgggagatggctgtggagctgggggtttaagtgatggttctcttttgctccctcttttgagggtaaagctactgtctttcttaagagtgtatttatgccaagtttgcgcttttaattgtttttattttgttttttaatgaaaacccagatctttcctttttggcataatttttatgatgacctgaaattttacatccgaacaaaattttacatccgaaaagcaaccaacttcttcatggaactcagccctgttgcaatgcttagggcccttaaagaagaaaatctccccagaaggcatccatcatgttgcttaattgtcttctgcagcttcctttccctagagctttccctgtgttgctaagagctgaaaatggcatcttcgtgatcaccacagtgagcttggctcgcctcggccggcccgggatgcactcttacaacatgtgtgactcttgaacctggagttcatcacattacgtcacagcttcccatctggttgctttcctgagtcagctacttcacacttgtcaaggctgttttaccccaaaactcagacaggactttctatgcatgttttccctcctccccccaattcccccccccatcaccttatctcccaggacacacttgagaagtagctttttattcctagtggtgtacatttaattttaaaaaggttgcaatgtatcatgcttgttgccgaaactgtttatggccttcttgtttcagttttttcttttcttccaatggtactttagctgttgagtgcaggttacaacctatattgttatgcagatggcttctttaggaataacttttatatttatttaaaaatttttaaattatgggatgttttgttgttgttgttgtctttgttgttggtcatttgtcaatattcagtcaccaattctgctcacttcttgccatggataaaattgggtctttctggctaattaaaaaagacaactttataaaatggcactttaagcaagccatagttagttttatttttgtaatgcacatggcaaagcaaagacgtttgtgatgaaggaactgctcatctaagcaaaagatttgagtatgatatgataaaggctttctacattctaatttactttttccccccacttgaatgtgttttaaaggctaattatcagctcagtagagcagtgagaaactgatcaaattgcacttgttctcctacaagcaacctccacgcagacacctcgtactgctacaggtgtgtcatttcctttaataggaccagggaccatgtaactgaggtgagggttgtagtagatgcttccagtgtcagtatgcctgttaattttaagagcttccctttcttgcagagaacaagtctgcccagattccatgctttctataactggaggacctggcaaacctgccgcatgctgcacacatctacctacgtacacatatacaatagtattgatgattctgaacaataacagggtaaaacagttggtttgccattgttaaaaactgatttacagtaacttacaacaactgtacttttgttggattagcaaatcatgtgtttaaacaaatcccatatgttgggcaacagttcaaataagcacggagaagtgttgcccaaacttggttctctgactcttatgtatttgtaaggctgggcttcaaaatcaaaacaaaaaccccaaaaacagcaggcaaatgctttttaactctgacaccgttgccataaatccctgatactcaaagtctaacaagaaagacatggaaaattagcagcccattttcagaaagatcaaaatgatctagggttctaattgcttttgcatcctattcttacaaagtgatgtcccaacagggaacagtaggagctggagtgggatctccaagtcccagtttgagtgtgggatgtgc

SEQ ID NO: 94625 - DNA, 1051 bp, Homo sapiens
aaatcatggtttccatggtaattcttaacttgtctgtgtcgtacacatttctcaagaaatacactcaccagactacctagtgataaaaattgctccacaggcatacaaaggtggattttctaactctctcttattgtaaaaggtcttccttcctcccacccctaattaatccacgtgtacttgtaaataaccctgggcaggaaactgaggtccaagtcctgccctctaaatcagtctctttttttatgggagaaatcagctttcatgtgattaatgccatttcctctctctcccctctgcagatatatgttgggtaaaggaggaaaacggaagtttgatgagcatgaagatgggctggaaggcaaaatcgtgtctccctgtgacggtccatccaaggtgtcttacaccttacagcgccagactatcttcaacatttcccttatgaaactctataaccacaggcccctgacagagcccagcttgcaaaagaccgttttaattaacaacatgttgaggcggatccaggaggaactcaaacaggaaggcagcctgaggcccatgttcaccccctcctcccagcccaccaccgagcccagcgacagctaccgagaggccccgccggccttcagccacctggcgtccccgtcctcccacccctgcgacctcggaagcactacgcccctggaggcctgcctcaccccggcctcactgctcgaggacgacgatgacacgttttgcacctcccaggccatgcagcccacggctcccaccaaactgtcacctccagccctcttgccagaaaaggacagtttctcctctgccttggacgagatcgaggagctctgtcccacatctacctccacagaggcggccacggctgcgactgacagtgtgaaagggacctccagcgaggctggcacccagaaactcgacggtcctcaagagagccgcgcagatgactcaaaactgatggactctctgcctgggaattttgaaataacgacgtccacgggtttcctgacagacttgaccctggatgacatcctgtttg

SEQ ID NO: 94626 - DNA, 1025 bp, Homo sapiens
ggagcgctccctcccgcggccccggtccgggccccgcgctctcggacccccggcgcctgcgggctgagccgctggggggcagggccggggtcaggagggggtcgggagctcggagagccgagcggcgggcgggggcgcctggagctgtcgcctctacagctgggatgtgtgtgcgcgttgtggcggttgtgttgttgtgaacgtgcgagactttttttaaggctcggattgctggcgcgaaggctgcttcacttttgagttccgtggccgggtttgcatccaacttactgtagtgcgtttttgtgaatttcccggtgttttttttaataatgttgaaaaccttcctctccaccctcttttctttcgtccatgcccaaatgaattgatttgggatctacatgtatattaaacttaacgtctcgttggtttttaagttagaaatctacaagtcatcttcgtggtaaccgcctatgactgaaagggagggggctgaggggagccagctgtcccaagccctagactttgtaccagtaagagagggggtgtcgtcacagggccactacatggacagaaaatcgtattttgttttgttttcttggctataagttacctttagcagaagtggtagtaatagattgcgatgggagtcgagttttaggtttagtttctaagtttcacgaaaatatcaggtatagtttgcattggaataactttttgcttgcaagccgagtcgtttcaggaggtagaaagtaagttttcacagacactgaatggggaggacagtcagcagagtgagacagccagcctcagaccacagcagtttttatttgaatcgaattgggcagcctcagttgggcttagggtagagagtacatgttttcaagctttgttcatgaaatacgctttttgatttcccaatgtatgttaagaaatatccataatgtgtgtaaagaggctagaagttgtagtcaccaggattcctgaggccctaagtgttcacagtagctttttgtagttagagacta

SEQ ID NO: 94627 - DNA, 1088 bp, Homo sapiens
catttttctttttttgtagaaatgagggtctagctatgttgcccaggctggtcttgaactcctggcctcaagtgtcctaccacctcagcctcccaaagtgctgggattagcggcatgtccactgacacaacctgatttgcatttttctttttactgatgaagttgagtgcctattcctgtgttcattggacattttagtttcctcacccatttttctattggatttatctgtcttttaaaagattgattcagaggagttctttgttaattctgaatactaatcttttgttgattctatttctatgaatcacgtatatcatttgacaatctttagcttgcctttaacttgtttgtagtgtattttatgtaagagatgtttaattttagtgtaatcaaagctattgatatttttctttatggtttgttcattgagtgttttgtttcttcaatagtcagaatccctgcaggaaacagaattctactgagatgattcaactaaagagacactagtgaagggacattttacagagatgtgacaaaagttgaggcacagaagacaaataactgtaggaagctgttactatccttaagcctaaaggggaaaggggaagaaatggtgttgctagaacctggtgggagttggcatcctggagaaggggccacctggcagaagctgtagttgtggagggatgtgtactcgcaggtgagggcccaaagcaggaaggagcagggaagaagtaccccagcttctccaccttctgacccattggtctccttctggtaccttctttgtctgaatccagttggaagctagtgagcaaaggaacttgggtgaggtggtccctagatgtcaacatttcaaggcatggagccaagcagaggcaagtggagaatgaatctcagatgaactacagtcagcacattttccttatcctaaagccataaacatattttcatatattctctcccaaaagtttaaaattttgttttacctatttagtctacctgaaatatatttttttgtaaatattaggcacctaatttatttttcatacaggtaatcaggtggccctgagctatttatttat

SEQ ID NO: 94628 - DNA, 1052 bp, Homo sapiens
aaaaaaaaaaaagaaaacaatcactctgactgctgtgttgagaacagacagtagaggaacaaaggtggaagtaaggaagtgtacttcagaaactatttcagtattcaaggtccaagaggtgatgatgactgggactggggtagtagcatagcactagagttgtgagaatttcctgacagattagatgtaagaaatcaatgatgggtccaaggctttgcagctgaggacttggacaaatagtgttgccattaactgagttggaaaaaaaacgcagggggatggctttggggggaagttgaggagtgcatattgataagacatctatatggagatgttgaataggcagttgaagatttgagactggacttcagaggagaggaatacaggcaggagatacaaatttggaagttgacaatatttatatggtatgtaaagccgtaaaactagatgagatctccaagggaggagcatattgaagaagcccaaggattgagccccagttacccttgagagttttaaaggccaaggagagggagaagaacttactaagagagactgagaggcgtggccagtgaaagaggaagaaaaatcaggagtgtagggtcctggaagccaagtgaacagagtgtttcctagaggagggagtggtcacctgatcaactgtgtaggtcaggtcaggtaaggtgtgagaactgatcattgaatttagcaatgtggagacaactgggacctccacacatcagagggaaagaattttagccattaaatgaacgtatggctcattacaagaacataattatgttttaaaagatttgttttaaaaagctacttttcacttcctcaaaaaggtaagcatagaattacaatatgatccagcaattccacttctaggtatataccccaaagaattgaaagcagaaactcagataatcatatgccagtgttcacagcagcattattcacaatagccaaaaggtggaaacaacctaaatgtccatcaacagagactggataaacaacatgtggtatgtacatacaatagaatattagcc

SEQ ID NO: 94629 - DNA, 1034 bp, Homo sapiens
tttccaccgtgatagagttactggcactggtcctccctcctatttcaagtaacaagaaaactggacacaatgtatgaaagaactgtttccaacactggacaacaggcagtgcagacagggatctctaagagaggggaacagagtcagtcttgggatcaccacaggtttctgagtgcaggcactatgcatccaccatgtagcagagctgagggaggagagagattggaggtcagtgaagctgaaaagactgggacttgtgaggcaaagtgccagagaggagggagctatgcagaaaaagaacttcacacatctgcataggatcccttgagtttgttgccagatactcagctatgcatgcctacagttaaactccccatggccagatgtgttggtggttcccagatcaccctctgtttgatgactttctaggaggacccacagggctcaggatgtactcctggctaagatttgctacagtgaaaggctacaaagcaaaaaaacaacaaagggaaaagatgcatgagatgaagtttggaggaagccaggcacaacaagcttcgaagagtcctcttctggtggagccacacaggatgcacctaatttccttagcaatgagttgtgacaacacatgtgaaatgttgtctaccaggaaagctcattagagactcagtgccaggatttttattaggggtagtcacattctgcctgccacataccaaaattccagactttcacaaagaaatcaggtgttcagcacaaaccatattgtttacacaaataatttaggcactgtgagccactcttaacagggtgttcagaatgatcctaaaatccaagttcccaggtgttagctaggggccaaccttgtaagcagggctttcaaaaggcagcatttgcatctgctatgttaactttttaatacgctttgggcagagaactgtaagagatcccagaggacatttgacaatttctggagacatttctgttgtcgtaactgggaggtccacagacatacattggatagaagccaggaa

SEQ ID NO: 94630 - DNA, 1082 bp, Homo sapiens
ctaactacagagtttagcatcaaataattttatgacagaccacatttggcatgcctagttattcagggaattttcaaagaaccatagagggactttttagtcacacatcctctctgttcttagtcatctactccttttatggtagtcattagccagtatctctcaacctcttctacaatgtttaacagttagtgtacactctctgtagcactggttttttttgagctctgtgtacttaataatgagacagtcagcatatacttgtgaaaacataaactaaatgttggtatattctccgcatggtttctttttatagaaccacagttgttaacacacattaactacttcaaaatcactaattaaaacattttctcatctgtattttgggagtattatcttttctcccctccagttgtaccacttaagtatcattggttacattcagaattaagggacaagagaaatgaaagacagtgtgatttagaagttttcctttaatgcataggaaaacagacgttttcatattctaggtaatcagaagtaccttctacatttaactacttgaccctaatgacctggtcaaattccagtgttgcacaattgcattgtaccttccctaatacccagtgaatttaattgtttggctacaaactattccccttaactttttagaaccattttgtaggctgtgctcttataaagatatatcaaaagccgcacttgtcaccttttctaaaaatgcaagtcattttcaccccctctccttctaatccttctactttctccccatatttataaacacatttcccaaaaaatattcaatcttctttttcatggatccaaaagacattggacatatggcttgaacacaacactggggtaataattaattaaggtaagaaagcaaggattttggaaagtgtgggttgatgagtcagataatggtaggatttttctcctgatctctggtaaggtattacaaagttctctcctaattgtcttgcaggcccctgacagcatatcctgaattaaacttgttctgttttcccagcttacccttctaaattctctatttcctgtca

SEQ ID NO: 94631 - DNA, 1054 bp, Homo sapiens
catgatgatgcagctcgcatcactgcattttttatttctcacttgcccaaaattgagagagtataacatagtcattaagaggatgggccctggctcagaccacctgggtttcaatcatgtcaacatcactcacaatatgtgtaactttggttatgttacttaatctcacttttcctccaatttttcatctatcaagtcagcatgaaaatagtagctacctcatctgtttgttgtgaggaccaagtaagttaatacaggtaaaacactcaatactgtcagaaattattattgttgtagtaatggtgtatgctgatgcataagtgtgatttgatgttaggctacaacttatatcacaaggtcaggcttttactggagcttaggctgtggcccagtatattatcttgcctttcaaatcaagggccagatgaaagagctgctgacaaagctcagatgttttactgcaaaaagctgtgggcggggaggcttatttatgactttaaaaaaattgagcctgcccaaagtggggggtctctttcaaaactcagaaaaaaacaaatacaccaatcaagacacaaaatcatggtctttggactaagataaattgtaaatacattgggatgtagtagattcttagttaattaaagctttttagattgtttctaccaaaacctgtggtgctctgtgtgttaaaggcagactcttttggtgatgtgatatgataaattcaccagattttaggtctcatgattttttgcaaagagagagagagagagacatttatttcaaaagagcatccctattgaaaagggacaattaaatgaagtctaatgatgtgttaatcatcattaaagttaaaggatggtggccaggtgcggtggcttatgcctgtaatcccagcactttgggaggccgaggcaggtggatcacttgaggtcagcagttccagaccagcctggccaacatggtaaaaccccgtctctactaaaaatacaaaaattagccaggtgtggtggtgtgcacctgtagtcccagctgcttggaaggctgaggcatg

SEQ ID NO: 94632 - DNA, 1065 bp, Homo sapiens
ccaccttgtgaggtattgtctcccattttacaaatgaggaaacagacttctgagagtttacagcttgtccaagggcatacagctagtagtcattagagccatcctgctccagtattccctccaccatgcaaccagcactttgatagcatctagcttcctgtcttccctgtcattctcatatttacacagaaaatcaccgtctaaaaatcttcctcagtggccattccatgttactcacaataagaacatatgtaccgtcaaagggtagcttcttgattgactttgaagtcaataattgaataaaagaggagccttgttatttcttacttagaaccatgctgaatgaaccttagggaccatttggttcaaatatgtgtatatatctaaatctagagtaaagcccttcataaggaaagtgaaactccagttaattgcaaagactagggcccacttcctcaaactcagaccattgtgttctttctgttaaagtacacctccttcaacagaggtacagttcttgtctcaagagctaatttgacttgagattctagcagatattcctgagtatctactctgtgcaaagccctgtgtggaaccagctctggaggacttttggatctagtgggagagacttaatccaggagaaaatgcacctagtgctaagtcttcagccatttaaaagactaagaatgtcatagataatccaaatttggtcttggtcatctggaaacatttatgaagaagccctttcttatatgttcttatatgacctcctatttgtagaaaaatagcaactgtggccactttggaacttttggaataatgccacccatccctgagaagctgaagtataagattaaaagcaaatcaaactgtgattgttagcaccaagtttctctttaggtcttgcccctaaaagttttaacttagaaaatcccatattactcatatcttattataaaagctctgctaataactttgaactccttaaaatacattttcaaagagctgatggtgagcaagccacatgtttcatggccttccctcagcactgatcagccgaca

SEQ ID NO: 94633 - DNA, 1712 bp, Homo sapiens
tagcagtatccctacctctcaccttaggaatacaaaatgagatgcagtatggaatacttaaatcttaacttttgaatgctagatgcaggtatcagtgtaaacttattacaccattatatgatgagggaaaaaaataggcatttttaatgactaggaaaaagttcttgacaaagaaaagttctgttttgtttagtcagttactgaaatggaactgagtcttttttttttttttttttttttttttgagttggagtttcactcttgttgcccaggctggagtgcaatggccctatctcggatcactgcaacctccatctcccgggttcaagcgattctcctgccacagcctcccaagtagctgggattacaggcatgcaccaccacgcctggctaattttatatttttagtagggacggggtttctccatgttggtcaggctggtctcaaactcctgacctcaggtgatccacccgctttttattaggtgtgtctttgaagctaaagtgattcagtgcttacagtcacctatcagcgttcatgtagtgagttcttggaaccctttgtgctcctggagaggcagtttatgtagcaaatgtatagtaagcaagtgtactatgacttttctaactatcacaccattgagcacatgatgctttgatgtactggagtgcaacaagcagtttcgccatggggtgtcaagtgggaactcgggcccttggtcaacccagttataaatgtctattcttcacatgtcctcctattttctttgtgtgcgtttataattgctttcagtgatcctgtcaatttgacaaacagaaaaggttagaaaagtaaagtcgaaatagccagttttagaattttaagtaaaagttggataggggcaaatattaagaataagggttcctgtcaattcagtttctcttactattcctcttactgattgccttgactgacaagttgactgctttactttatgtgaggttttattcttttaaagatagagttcatgaactttgtactggctccaaacgtgtgaagctctgctctaatcattgctttgttcagtcgataaaattcctgctcatttgaagcattcctaactgagactattaatgctcctgcctgccgcctttttgctatcattgtttcacatcatcattgattcgtgtattcaggtgtctttcaccacataaaggaatgaagctgatgacagccattttcaagtataatctgaaactacttccacatttttctacaaaggtgtttggcatctggattagcacttatgttggggaggaaccctgggatagatagctctttaggtttcttgacgtgtttaggatatgtggctaatgttacttgctggcaccaaccctgaaaaagttgaactggtgtcatactttttatgctcctgttatgtctaactataaaatgaaggaagtgctcatggcacttcccccttatttagtgagttctcctccgcagctctcagaggagatggccagggtccggctgaatgcgcagtccatgtttctgttcttttctagttcctgtaatgtaatgttgcataaaactttcactcgttgtcttctttttttcttatgtcctcttaaaaattgaaaagtagtattttctattatcatcaccatttctcatacactgagaataaggaccatcttggctaagtgtttgacctaggattatatgtaat

SEQ ID NO: 94634 - DNA, 1021 bp, Homo sapiens
cccaggctggagtgcaatggcacaatctcagctcactgcaacctccacctcccaggttcaagcgattctcctgcctcagcctcctgagtagctgggattacaggcacccaccaccacacccggctaatgtttttgtatttttagtagagatagggtttcaccatgttggccagatgatctcgaactcttgaccttcaggtgatccacctgcctcagcctcccaaagtgctaggattacaggcgtgaaccaccacgcctgaccaatttttaactttttcttgtagagatggagtctcaccaggttgtttaagcttttcttgaactcctggcctcaagcaatcctcttgcctcagcctcccggagtgctgggattacaggtgtgagccacagtgctgggctgaagcttctttattgttggaattaatgcctatgttaaatttagaacattggcaaattttcatgaattaaaaaaatagtctataaaaatgatcagaattgtgtttctggggttggggctaccagggcattaatgagtgatttgaaagctctagctctttttacaacactagcaggacacattggaatcacctatgtccaggccacaacccagaggtgaggccctgggttattgtaatgtgtagccacactgtgctctatgatgctgtctctcataccgtattcccccatacccaagctttctatcataaaacttttcagacatgtagaaaacctaacagaataagtcaacaaacacccatattctctctacccagattcagtagttattaaccttttgctgtattggctttatgagtctgtccctctttctctgtatgagtacttttttcctgtaccatgtgaaagtaagtttcagacatcatgagtccttaccattaaatacttcagaatatatgttctgagaataaggacattttctacataaccacaatgccattatcatccctaggaaaattggtaataacttggaatgcttttcaaaaattcagttcattaaagacat

SEQ ID NO: 94635 - DNA, 2028 bp, Homo sapiens
ctgggcaacacagcaaaaccccgtctctacaaaaaatacaaaaatcagctgaatgtggtggcacatgattgtagtcccagctactgagccctggaggtggaggctgcagtgagctgtgattacgccactgcatgcactccagcttgggcaacagagaccctgtttttttttctttttctttttctttttttcttttttttttttttttggagacagagtctctttctgtcgcccaggctggagtgcagtggtgcagacttggctcattgcaacctctgccttccagattcaagcaattcttctgcctcagcctcctgagtagctgggattacaggtgtgcggcaccacgcccggctaatttttgtatttttagtagagacacagtttcaccatgttggccaggctggtcttgaactcctgacctcaagtgatccacccctcttggcctcccaaagtgctgggattacaggcatgagccactgtgcttggtaagaccctgtttcaaaaaaaaaaaaaagaaatttagctattgaatgaattgagttgatcccctttcatttaaacttgcataatagaatgtacatacctctattaaagtgtaatacatatcacacatttgctgttatctgtggttttccctcctgttaaacaaagctctttgagggtaagaatagtatttcatttataatttaatctccagtgcccagtaccttttatttaaagaagcttaattaatgcatgtgaaattaattaaataatgctactctcatgtttatagtagttgagtgacattataagtgatacttatacaaatataagtaatactattatttgtattattgaattgaattttcactttctcaatttttgcaaatagagaataaatgagaggaattacagtataatttactcttcattatggaactattttttattttcaaggttaaacagaaaatagtctgaaaagtatgcctgtcatatccttctttgatacctgacatgtccagtttttaatcataaaatctgactcccacactttctgtcattaagttggatgttgttaataattaatatgaattatatgaattagatttggaatgtcccaaaaatgatgatatgatgttattatctgttacagattaataataataatgtatcagcctaatcctgtgaaatttaaaatggcatcatttccttagggaccacatccttattctctttccattcaagagtgaaactttctcttgagcagtcttaataaataattagctattgaaatagctgcactaaatagtgtggcaggaatcataaaggaagcatatgtaattagtaaataaaacacactctaaactttaccatacgcttaatatggttactcaattggggaatatatttttcaaaataagcaaagttcatggggcctaccgcctgcctcatttatagaatcattctattttacttgtcaataaaatccagtctaattactgagccctctgaagttataaaaagccagaattatctttcattagagatccttggtaataaaatctgaatactaatctactcagaattgttacagtgttccatcacattgttaaaacttttcaaacacatatatgaaatatctattacaatgtgggcaattttgtgtatataaatcttcgtttaaccaaatcatcagttacccagttcagttgaatatattacattttcattggctaaaataattaatttagaaaacttgcccttttttgttttgatacatttaaagcagctaatctacagtgaaactttaaaaaataataatttataagcacttagaacctatgcttaagtgtttggttgcaagatcgaaagtctatttttcacttgacacattttagcgtgccatttattctataggtcacacctctttctttctttcagcttttttttttgtgaggacatttgggtatttattagtgttttacagacatatacaatttccgcaggttttttttttaaacaatgtttgttgtgtacaattat

SEQ ID NO: 94636 - DNA, 1039 bp, Homo sapiens
agagcagtgatagccaccaatgtgatctgatagattctatcacctgcaaaaagtgtaaaagggacgatgggtacgttttcttctaattcaaagttaaacttttattcaataaaggcaaggcagaaaggtatttttaattttaatgcgtggcgatagggcagcgataaagcagagaaagacagattgtctagtggcattgcttagtgtttttatttgaaaatagttttatgggttccctattgaaaaaatatcaagtccgtatcaaaggttatgaagtctttgaacctgttgggggaaagcaaggtaagatggaaatccagcttgacacttcatctttagctcacctctgttacagggaggcattacaacacagagttttaaatttctcagtcactggacacaatggagcatgttaaggatatgagagaaatatggattatttctcttttgatatccatcttttgtgtacttcattgcttgttcagcaatgtcatactacagaattttgtaaaattttgatttggtttcttggttgtccatagctcagaagtacaaatacctgtctatatatgctttatgaggatgttgccatatgcatctttcatattttgtttgaaataaaagtaaaaattatgagaaatagttgctcagagttggcttctgaggttgctttttagaattcagctgttttaaaatggtattactctttttgagtcaagttctgggctagttgtccacaagattcaaatgaggccaaaccaaacatgttttgaaacattaaagtacaggaaaggcctcttaatagttcattctctccttctctttcagagtaaccagaataagttgttactaaatttaattttaaagaatagactgttcctgtaccgaaatctgccaagttgctacagaaatatttctttttaaagagcagaaatgtgtttatgatcagcccaaagtagtaaagatgaaaagtgacttaaatgtaaatgctgtcttaaagaaatgcttgtcataagccccaaaaccttccagagtgttt

SEQ ID NO: 94637 - DNA, 1023 bp, Homo sapiens
tggtttcatgtctttgctattgtgaatagtagcctgtagatgtggttaagaatctcaagatggggagattatcctggatatttagatgggccctaaaaatgcaatcacacatgtccttataagataaaagtggaggggcattacacagacagaagagaaggcagtgtgaccacagagtttctgcttgcggtgtcaagccagccagtgactatatagggcttttgcaacagagatacggtgtgaatagtagctacaatgaacatacaagtacgtgtgcccttttggtagaacaatttattttccttggagtatatttcctcagtaataggattcctaagttgaatggtagccttaacaacagaatttgtgtgtgtgtgtggttctagaagctgggaagtccaagatcaaggcaccagcagattctgtgtctcatttgtcctcacatggtggaaggggcaaagggtttctctctggcctcttttataagggtattaatcccatgcacgacggttctaccctgtgacctaatcacctctcaaaggccacgcttcctaatactatcaccttagggattaagatttcaacataagaatgggcattgggtggaagacattcagtccatagcattaagtttcttgccctccatattctctttcctacaggttggaactccaatatggtgctggtagccagctgtgaccaagaagaggacaaccggagcaacaatcttagacacaaggatggaagctgtaaggcaggggaggagttccagggtccctggagaacttcatggagctgaggacgtccttcctgttttgtagtgttgcatgagagaggaataacattctatattatttggctgggcgcggtggctcatgcctgtaatcccagcactttgggaggccgaggtgggcggatcaactgaggtcaggagttcaagactagcctggccaacatggcaaaaccccgtctctactaaaaaatacaaaaattagccgagcgtggtagagcatgcctgtaatc

SEQ ID NO: 94638 - DNA, 1050 bp, Homo sapiens
ggtttgtttatttgtttatttatttatttgagacagggtctcgctttgtcgcccaggctggagtgcagtggcgtgatcccggctcactgcaacctctgcctcccaggataaagcaattctcctgcctcagcctccaaagtagctgggattatggatgtacaccaccatgcctggcaaatttttatatttttagtagagagggggtttcaccatgttgcccagtctagtctcaaactcctgagctcaaagcgatcacctgcctcagcctcccaaagtgctaggattacaggtgcaagccaccacacctggccccctgaaggtttaaactcttcatcctccaagtttttgcctgcagctatcatttgtgcatagtctgcctaatgatatctctagttttctagtatgaaacagagggactgtattgggttgaataatgtcccacaactcccaaaaaattcaagtggcacccagaacctcagaatatgaccttatttgcaaatagagcctttgtaattaattaagatcaggtcatactggattagggtgggccctaaatccaatgactggtgtccttataagagaaatgagagagaaaatgagacacacacacaaacacacacaggaaagaaagtaacacagcaatggagggggagattggagagatgcatctacaaaccaaggaatgctaaggatttctgggaacccagaggccaggaagaggcaaggaagggaacatgtcctgccagcacctcacttttggacttctagcttcttgaactgtgagagaataaatttctgttgttttaagcccctggtttgtgatgatttgtcatggcagccctaggaaacgaacacagggactcttggttgactctttaaaataattctttattatgaatattttcatggatttttttttaagagatgtagtttctctatgttgcccaggctggactacttacaggtgtgatcatcatgcactacagcagcccctgttgctaggactacaggcatgtggtggcactgtgcccagaaagttttagcatatca

SEQ ID NO: 94639 - DNA, 1058 bp, Homo sapiens
atctgtccctgcctggctttcttcagcatggttttctctttctttctctcaagctggctgcccactaaggccagaatatggccttggggcactcctagttctccccttacaaccttgtaaccaatggaagccacttttcctctcctggctgatggctttagaggtaacatctcagcgagggactctggcttagcctgaaccacgcttgtaccccaggggccagggtggtgaagtctgagtagaatttggagggggtggtgccgggaagaccagggcagtctgaggcacacgttatgatgtcatatcatttgctagttgttgcaggtgttagttaacttcagggcctcaattacccttctgaatgcctcaaaataggggactctctcctatgcttgttttggtgcccagtaagcaggccctcaataaatgtttgctgactggttgattaaccattagacaaacaggcctgcccaggacggctaatccctcaaaataaacacttgtgaaactcagagttgatcccgaatcctggggatctttcaggctctttgtaaatctagtattatccagggaacggcagacctctggaggctgagctgcctttaagaataaaaacctctcctctccctcccctcccactcctcccaggacagagaagggcgacttttgcagggagggcaccttccaaggatctttgctcatttccctccccaccagggatccctaccttaaaggttgggataacaattgcctatgatggggatggagcaacagcactcgcccagcagagatgatactaaacgtgcatcttagaagacagtcaatgggttatcgtacgtcatttaacctgtccgtttgagggtggtcatttatgtgcctttcagctttttgtcatctctcttgtctcccacttggacatcccagggttgcccagcagcgcctctgtgtttcagagccagactccctcccatccttcctctggactttttctcctgagagccagtctgcagcttcaaaagcgggtggttatactcactcctcagtctgtgagcatttat

SEQ ID NO: 94640 - DNA, 1053 bp, Homo sapiens
gtcatgttctcgttatccttgggaggtggtggtgtggtgtgcacagggaccgggctccgaagtgcagcaaaatgggttggaatcccagctctcacccttgccagctgggtgaccttgggcaagtcacatgtccttccccattggcttccactggcttgttgtggaggttcatgctgtagccgtatgggcggtgcctggtaattcgtagccaatcagcagcccctaggaagctaattttactggtctcctattattattacttcctattgaggtcattgacctcaggttttgccaacagccttcccctcccgcaaaggcaactggcgccccctctcaactctttccaggtcagcagcagcaaatagctaaaatttgctgtgaaatcttggcttgcagggcccgtattgattttgttctcgaagcctttcaagtagccgctgccctgtgatctccctgcaaagccccttacaaaacccagcagcttccccagacagctactggagacacatatgcttctagaaagaaacccggacccctgggccactagaaccagtcctgtctttatctcaaagccccaaggtctcagagctcagtgtgtttatcaggtcatttagcagctacccaggtaatggttgaggagcatgggcaggaggctcctgcctcatcaccttcctctcaacagatattgatctcgttccactatgtgcaagggaaccacacacaatgctcccaggacctttgacgtcccagtgctgcttgttggctagggtagtggtaaacaaaggaaaggcaaccttagctgagtccctgcctccattcttgccaaaatttaaaccaggtcaatttttccggcctagtgcaccctttaactttgttgctgaactgtttgctagtcctggtggctcagcaaggactagggaaggcaggtggcctggctgagaccctgcagctcagttcctgccacggactcagcactagccaggtgtgtggccttcagacaactcactcacctctcagtgctgttttcacacatcattttctaagttttgtgga

SEQ ID NO: 94641 - DNA, 2684 bp, Homo sapiens
catgatcatcctgccgctggtggtctgcagcctggtgtcgggcgccgcctcgctcgatgccagctgcctcgggcgtctgggcggcatcgctgtcgcctactttggcctcaccacactgagtgcctcggcgctcgccgtggccttggcgttcatcatcaagccaggatccggtgcgcagacccttcagtccagcgacctggggctggaggactcggggcctcctcctgtccccaaagagacggtggactctttcctcgacctggccaggtaacactctccacctctcccagggcccagtgggagacgccagttctcggatgccctccagttcatacacccatatgcttatacactcctaagagttaattcttagctggctgctggtggcgtttaacgttttaaaaatatcaaaatgacgtctggagtttttgcgtgctgaccacacctttgcaaacagctggggcgcaccgcacaatcgaaagagcagggccgcatctttgagcaagaaccagtccccaccgttaggtgggcgtttgttagggaagagccagccgccccgcctgttctttactccttatactctcgcgctgctctccccggtaaaaatgttccgaccacgccccagtggcttcgcctcattttctcccacatggtgcctaaaagcttctgggagcattggttaagttttgcctcttgggtcatccggcttgcaatctatggccttctctgttacagtccttggctgcgaaggaagctggcaattttctgcagttatcagtggacccacggataatagggctggggttagttgagtgagacatattgcccagaaatatgcctctcctgagggcttggggcttgggacaggttgctgtccaccccagtaaagaccacggcagagtgctgtgtttcaaaggcctttctttgtgcgaaagtgtgagttctagaggggagggagagaagcatcttcacttagttttgcctgctttttgcaattcttagaagttgcatttcatcctttgagatgatgtagtatcctttctgtgacttatccaaaaccttggtctctcctggtttctccattagcccaaagttcacaaatggggaaactgcagcccggaggcatttactgatctaaccaggttcagttgagtgaggagtccagctggctccttctccagatttctgatgattttggattctgagccttggagttattaatatattttgtcttgagttattgaggcaaagctcctcattgctgaggttgtgaaaaacagcaaaccctgggcaaagtgacttgcctttccaactgtttccatttctccttctggaaaatgtgatggctgtctgcacttaagagagagattgttcacttaaaacaacaaaaatctaggacatccgtatttaaaaacaaacaaacaacaacaaaaaaaaaccactcatgagggagaccaaaagttcttgccaaaagggcagatagtggtggcctattaggacttttaaggggatcacagctttttttttttttttttttttttaaagtctgggtcttgctcttttgcccagactggagtgcagtgttgggatcctagctcactgcatccccgaactcctaggcttcagcgatcctcctgcctcagtctccagagtagctgagattacaggtgcacaccaccacacccagctttttgtttgtttgtttgtttgttttttgagacggagtctcgctctgtcacccaggctggagtgcagtgtgcgatctcggctcactgcaagctccgcctcctgggttcacgccattctcctgcctcagcctcccgagtagctgggattacaggcgcgtgccaccacgcccggctaattttttgtattttttagtagagacggggtttcaccatgttagccaggatggtcttgatctcctgacctcgtgagccacccgcctcggcctcccaaagtgctgggattacaggtgtgagccaccctgcctggccccagctaactgttttaaatttttttagagatggggtttcactatgctgcccaggctggtctagatcacagcctttgttctgtgactggcagcttgatatttggagtccagacactttttaagtttggaaactaacttttaggtgagtgctgaaaagaagtctcctgaggttgagagcacctttagcctattacctgtaggaggtcggtcagctctctcagggaggaaaggcaataatggggttaaaggattattctttgcagggatctgtggcccagggagggagaatggatgttcagctctgtcctgctatggtcccgcaccgggagcctcaataggatcttttaactccagaagagggggcagtggtggtagggggtacctcattacctcctgaagggacttcttgtttcctgatcatggttttctagttttagacccaagccccttcacctcctgcttctgacatggatggtgacccagcgtcatagcttagtagtgtgggtgcaacttttcaatgacttgggctgcacctgcatggagggctaagagaggctttgttgtggcttgctggggataggtattgcttcataattcttccaacagccaacttcatctaatccagcagctcacggataaaggtagggcaggtggtatatcccattttatgactgacaaaactgagaca

SEQ ID NO: 94642 - DNA, 1733 bp, Homo sapiens
aaatcatccctggataagaaccactgttgcagagggaagattattctcctggactgctggtgggaatgtgatatggaataaccactttggagaacaaagtggcagtatctactgaaatttaaaatatgcacatcctataacttagcagttcacttcttagcatctctacctagagaacaaaggcatgtggttaccacaaagtatgtttgcagtgtcgtttgtaacgataaacctgggaacaacttaaacatccaccaacaggacgatgacaaaataacctatggtatttccattctgaagataatatttaaagacaatgaggtaaaggtggaaacaacccaaatgtccatcattggatgaatggataaacaaaatgagatagagacatacaacagaatattattcagccttagaaaggagtacaattctagctcatgctccaatgtggatgaagcccgaagacatcataagtggaataacctagacacaaaaggacaaacactgtatgattccacctttgtgtacctagaatagtcaaattcagagagacaagaagtagaacagtgattctcaggaactgtgaggaggggaaagtaggctgttatgtttaatgatttcaaagtttgggatgatggaaaagttctggatttggatagtgatgatagttgcacaagaatgtgaatgaacttcatgccactgaactctacacttaaaaatggttaagatggtaaattttatgtatattttaccacattaaaaaatgaatggggtagatttctatgtattgatatgaaaagatttcaaagatgtaatatagggtgaaaaagaaaaaaacacatagatttaaatacatacctatgtatctaattgcataggaggtaggagtgtctatttgaggaggatcctggcttaaggatggtacttaaagaggattttggtgtcatctacgttttaattttttgaaaggagaatgtattcatgtattactatcgggtttttaattaataattactgcttagaatatctctagaaagaaaactcaagaaaccagtgacattgtctccagggaggggaaatctgggtgcttgggagagagatgagagggagacttcactctgttcactcttttgtaccccttgaaatttgaactatgtgacattattacctacgcaattaaaatttacaaataaagtcagcagttagaaaattcttcctgaatttatattaattcaaaacaactgacttttgttctttgtagctcccacagtccattccttcccatcctgcctttaaaaaactctcacgctccaggcgtgttcccagagtgtcattgttaatgactttttcccacggaatcatgttgtctaagccacaaagaatttaaaacttcacaaaagtcctagctttggctcaattttctatcacagccactctgtgaaataggtgttagtcttttgtgtttctaagttctcagaacaagcctgagcaaagccaaaagtcaggcttacagtcctggaggctttgatctcgatttccttgcctttcctcctgggaatccctgtgactggtagcatccttctgttaaggacatactgtatccaaggggaaagacgtctgggttctggtcctgactctgttacccttggtgagtggtcagcctcattttacccagtctcacaggctgtaaaatggggatggtataaccctgactgtttcggttcctcggggttatc

SEQ ID NO: 94643 - DNA, 1044 bp, Homo sapiens
ggatcagcaggtttattctccccatcggggccaccgtgaacatggacggagcagccatcttccagtgtgtggccgcggtgttcattgcgcaactcaacaacgtagagctcaacgcaggacagattttcaccattctgtaagttcctcattctttccctggctcaaaactgaaggcttttcttgtgatttcctttgaaaaaccaatctcaccacaacttggtgtctcgctcataaaatgaggacagtggggattcattacttgaagagcgtgtgttgactctcaagggcgtagccagcagagcctatggtggggcggtttttagtttccagccacattgcagctgcatggtctgcatttctctgtgtccactccacgctctatgttaatggctggccctgctctgccatcccttagagtgactgccacagcgtccagtgttggagcagcaggcgtgccagctggaggggtcctcaccattgccattatcctggaggccattgggctgcctactcatgacctgcctctgatcctggctgtggactggattgtgtaagtaacaagtcctgagaacaccaaaaagagtctgcactgagttccctaggagcttagcactgctgggcctgggccatgcagagaaacttcagacacactccagccttgtgaaggaggctacagtggagctaaaagggcaagatttagagctaggaaaaattaaacaatatgagagtcacatgcccccaaacatccaggaatgaccatgagatgtcattaccaagaacttgcttatagcatccagtaaagcaggggtccacagctgaggccctcagcgcaggcccaagggacacgagggtctatggagttgctgactgcataggagtaataagtcgatggagcagtgatcctttgggaatgattgtccctggcctggaagattctaaggagtgatttctgtgaggggagggaggatgaaccatgctgatgtgagtgacttgggcttgggctcagcagaggaggaggtagggaagaaggtgtgatccagacca

SEQ ID NO: 94644 - DNA, 3518 bp, Homo sapiens
tttgtttattttttgtagagataggatctcactatgttgcccaggctggtctcaaactcctggccttaaacagtcctcccacctcagcctcccaaattgctgggattacagacatgagccactgtgcctggcttatgtgtgatttttaattatggtgtctaatacatataaaatacgtgtatagaaaggtgactggaaggaaatagattaaaatgggcatacagattcactcagttggggactaggggtgagtggcttgtttgcttctttatgctcttttttattctttctataaaaataaaaagtgtttaaagaaaatcaatttagaataaggtaaagccaatgccttagaagcatgctctccaggaagcaacagggcccctcacaatcatgactttccttcggcatccaggctgcctgtgacaggacccgatcgcccagcagtagatataatagctgcctcttcttttcccaccagggaccggaccaccacggtggtgaatgtggaaggggatgccctgggtgcaggcattctccaccacctgaatcagaaggcaacaaagaaaggcgagcaggaacttgctgaggtgaaagtggaagccatccccaactgcaagtctgaggaggagacatcgcccctggtgacacaccagaaccccgctggccccgtggccagtgccccagaactggaatccaaggagtcggttctgtgatggggctgggctttgggcttgcctgccagcagtgatgtcccaccctgttcacccagccgccagtcatggacacagggcactgcccttgccaacttttaccctcccaagcaatgctttggcccagtcgctggcctgaggcttacctctcggcactggcattgggctccccagccggaactggttaccaaggacaaggacactctgacattcggcttgatccatgtccaggtgcaactgtgtgtacaccagggatctgtttggaaacaaccccttgagctgccaggctcaagaaatcatggactcacagggtcctgtgtggttacatcttggaaaaaatgcagatgtatttcactctccccggtcagctctgcatcaggtgttttctgagcaaaccaagggggtttatagtcatctgtcgcattgcctcgagttgcagtaattgaaaaaatgctcaaattcttagccatggctggcctttgctgagctgggactcaggtgtttaaagagtttgtgctatagctaggtgtggatagcttctgatccctgggttctgggagactgcaggtgccgcacattgtcaagttagaaatactccaggtgggtgttagcactgtggtggtctctggtccacagccttaggtaaacaacttagattctgaggtcaaagaaaaaaggagagggaatgcagccttgtgggggagaagcggggcagagggttctctaatctaatcaggacaggacaggtttcacatacaattgtcccagttcgcatcccagccctggggcacttttctgcttccttccagaggcctgggcctctgataacactttggctttttctccattcacgctgatttggcaaaaggccagagatgggcctccttccctggggaggtgtgatgtagttatcacattcaggacccttgttgatttatcatctattatttgaattcaactggacactctgtaaaatgctgcactgcagcaaaaacaaaaccaccaccaccccagagaaaaccatgtactaattggagtggggtacccccattcacaggttcccaggtcccctggctttggctgatttcaaaatatagagccctttcttgccagtacatccaagtttaaaattatcagcgaaatggtccatgtttttccaattacctgctgacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcctccttcactcccttgttttccctgttgctatgtgtcacctgggccctacagacaggggcacacgcttatggatgtgtgtaccattgagatgagaatgggtagatggaacggagaccatcaagccacacccccttcttaaaactggggacatgagcctgagcagaaagggtgaagaagagccatgggacacagagttgacccagccagggggaaagcccagctctctttaaaccagctaagccattccagtctcctgtgaagccaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactggaatctgcagttcctttattcccttcttgtgtgttgaagcggcacttgctgatggaggagctgttgctcttctaggagatgggctttgg

SEQ ID NO: 94645 - DNA, 1087 bp, Homo sapiens
ctaaagggatttgttttccttgctccattcatcaggcacgagcccctaagtcagggcaggcatgctcagggggcagtgctaccgccggagctgctgtcgctgatccttttgcggccacctgcttgcaactgggaagcgtcaagctgctcaggggcttcccactccacaccagcagggctcttgtaaaaagtgtgtggttttgccacatacctccataaagttatgtcttgtcagaacgactaggtcaacaggccctaactgagcatctactgtaaggcaagcattaagtaggaacaacaggaagaaagccccaggccctagaattctgggaaagtccctgaaagagagcagttgtccatgcctctactatggcaccaccacacctcgcccatgcttttatataatcttgttttcaatgacaccacattccagcaacattagggaatctagacacctcttataataggaattatcctgcaaacagagtggaaacctctgaagaaacagatcccctgtctgacctgaacatttccagctcttcatataatacaggaactggttttcatttctgggcaatccccaaaggatgaggagagagttcacaccgatcaggggcctgatggggcctgctaggagtaacgatttggattcttaccctggagtgtggttgccttgactctctgttgtggagagtgtttggaggttgggattagtacttgatgagtcagttttctgatgtaaccagaccaagaggagcaaatctacactcaaaccatctcttccctggggatcagaaggagcgctgatctgatgagctacttgaacctgctcacgggaactgtaaattgtgtctgaatagcacaggcgatgtagcagggaggaccatgggctgtctgggttccactcccagctctgctgcttgcttgctgcatgaccctgggcatgataacctctccatggcttagtctcatatttaaaattgggagaccgagtgcagtggctcacaccatcatcccagcactttgggaggccaaggcaggaggattgcttgaggccaagagtttgagaccagcctgggcagcaaaac

SEQ ID NO: 94646 - DNA, 1018 bp, Homo sapiens
aagggcgtggttggcgctcggtcctgccctgcgcgttttgggctgcggttggagggccgcagttgcagtcagggtccgccagctcggggccagcgcatggggctgctgagaccgctccggacgtgcgaagcgttcgcggtgcggtaggtaggcagtgtcccgcgtgcgggtgctggtgtcgggggtgccgcggcgctgggggcggtggcccgggctagatccgcgcgcgcgcccggccccctcccccgcgtctcttcggtgcctgcggggcccttgcggtgcgggccgtctggcctcgcgtccccgccggcaagggcacaaaggctccctggggggcgggggcgcctcgtgccttcgcctccatcttgcgagcggaacggcgtgtgctgtggcggccgaggggtcggggccgaggcgggcggctgggcttgggaatgcccgggcgcggcgagggagtgcgcgagtccgcgcatctggcggccgagcagctgcgccgctggtcggcctgggccccgggggaggtcactttccctcaggcctctcccgggcgtgggctgtttacccagctccccagtcggggctaatgcagctcgggcctttccccctggaaagatggagaccagtgatgtcttcttatcgccgcgcccagatgcggagagaaaaaatcaagatgtctcattttttttgcctcggagggctaccctttctaactgtcatcactagaacagttctcagcagcctggggacgaatgtccaaaacctgttccaggcccttgatgattagtaggttgggtttagtgtattgtttgtaacaaaaatgagcggaagcctgccagggcagattggacctcactgggaattcatcaggaccacgaagggaggtagcgtttgtaaataatctaacagttctcagatctagggtatgaagagtgttgtgttaaagtgtgtaacaaaggttgttgggtcagtttgccttgggtttagttgaaagatctagaagtcaccactttttactttg

SEQ ID NO: 94647 - DNA, 1072 bp, Homo sapiens
cgtccgtgcgaagggcatgctcttctccagggtcacttctgaatcaggctggagcctggcatgccccatcaggcagagtagggaagggccctcttggattccagtgcaaggcgtcctcagtgtgtgcagtgcccatctaggtggtatttcccagcgtgtgagctgagtaagatgagcccgcagccattccccctttgcaggctctccaccagcatctcctcttaccatctgtttgcctcctgactaaggaaacaaggccatttctgcccacatttaagctttgaggttggcccagtgcactccgggtggctgccgacatcctgggcattcacggttccgttacctccccttccacatcctcccagcattggtcttcctcctgttggctttttggccccctaccccatcccaccagggctctcagcatcaacttttgctggcatgcttaggctgagggtgatgtccctctgttgttcctgaacctctttgtgttggaatggtcctgtttgcagattcagctcccaaatcatcatccttccctgagtgctcggcctgtgctccctcgcctgcctgcctgctgattggctcttgctctcatgtgcacacatgctgtgttacacttaccctaccactgttacccaccagctttccacagcttccctccatcaccacgtgcagcataacccaggccagcctgaggagagttgctgatctctttctctttggtcactggccatccttggaacaagtagctctcacctgttccacaggctggatgtggtttctgtgctttgagagggtcccagcctgggcaacatggtgaaaccctgtctctactaaaaatagaaaaattagccaggcgtggtggcatgtgcctgtagtcccagctactcaggaggctgaggtgggaggatcacctgagcccagggaggtcgaggctgcagtgagctgagatcatgccactgcactccagcctgggtgacagagtaagaccctgtctcagaaaaaagaaaaaaagaaaagaaaagagagggtcctgcctcctctgccaggcagagccaagcatcttgga

SEQ ID NO: 94648 - DNA, 1044 bp, Homo sapiens
tggggtctggagaccttctgctctccggggaaagccaggtaggtactaaggcaagactgtagatggacccattgctgtcctttgggagtttgttcaggatttcctcaccatcttgcatcctttccttgctactgtgcagggtgaggaattggaggggcctgagtatgatgatttctgttttgcgggttcagctagagagctgggcctcaggaccggccggggggactgtccacggttatctcctgttcctcaagagtgactggtgactttttaaggaccagggattataggccaagaggctgctgcccagaggtccaggccaggggaattctggcaaggagagccctgccgtgtttctgacttggtgattaaaggctttaggggtaccctgaagagacttgggaaaggagtgtccagggctttgggctcctgggggctctgaacctaaatcctcttcagacccaagggacatgtcagaaccttggagccctgtagtaggcagcactgtccctggttaaggagaattccttgggcttctctgactgccaggcagcttctcctagtgggagtcacatggggcagggaatcctaccaggttctgtgactgcaggcaaatcaccagatctttcaggccctcagtatcattgggaggtgaccggaatgatctgttctgcccagctcttacattcttttctgttctgcttgccaaggcctttcctgggaatggctttgatcttctcggtgtcattgtagccttggctgctgcagggtccccttgtggggctgcaccctgtgaggaggctctgagcgggactgggagagaacagaggctgggccccacctgcctgggagcaaggggcagtgggaggctctggcacctgtgagtcagagattcggtgaggcaggaagcgaatcataaacagacacagaaatggcctttcacggggatgagtccggtgcttattattagaattcctgttgttcgttaagctcttaccatgtgctttgcacacatgggtgtatttaatccttaccttctgagga

SEQ ID NO: 94649 - DNA, 1254 bp, Homo sapiens
agtgtggtggcatgcactagcaggaggatcactggaacccggcaggcagaggctacagtgagccaaaatcacaccactgcactccagcctgggccacagaccgagaccgtctcaaaaaacaaacaaaaactctgacgtcagtttgtgtgcgtgtgtatgtatttgggtttggttttagttttcttgtttctttttcattaagattttgttattttgaaaatactaatgtggatttttgttaacttggtcctagatttaggatgactgcgtcccagtttgtgcctgttgttctggcataataataggtcccctttcagtctcagaagtgtcctgaattggaggataaattatatagttgtcatccctaagtctaacgttaaccttggctgaactcctgccttctagcatatctggttggctgcacctttctaatctcttcatgaagaagcagagggatatccatggtctgagcctgaggctagtctggaaggagttttctaaaacaattctttgaattcctacaaccttataacctgaccatatcttcagcagcagaggacacaatttacatgtgcttgggccagggctgagctgactgagggccttcctgggaccgtactccagctagaggaagggaggggctttgttttccaacttggggccaactaaagtgtagggaggagccttgcttgacctgggcaggctgggccagctgctccaccctactgggaatgctgtttcctgcagtgtggagagaggttgctttgagttcctcactttgaggaactccacaatgagttcctctccacactgcaggaaacagcattcccactagggtggagtgagcttgaggaaggagagaaaggctgactccaagggtcctgtatgcagactccacgtgcatgcacgcagctgtgcagggcccaggaccagtaccactacagagagaggaagctgccctggtagacctagcttagtggcctttcctggcttgtcagagcaggtgcaaacagaataattccatccctccgtcttatccctcctgccagccttctgtacctcagcttctaggctagacggaaacaaccagcttgctttgtaggtagagctgagatttgagctgggagtcactcgtgcaggtcagtgaggcataggcctcttgtgtcacccatacagctgtcacaaagtgggactgtactgctagccccttgcccgcacagaattgtgcatggctcatgcgtatgtgtgtgctat

SEQ ID NO: 94650 - DNA, 1081 bp, Homo sapiens
ggaggatgagctaagagaatggtagggtaaagccttgaactgatggcagcccctaatttcctgcaagactgtaaatcaagtgctgacagcctgcctatattatgcctcattttacatttttgagtgagatgggatttatactggaatacaaccgccgaagcaaagctgggcaggtcccacgggcttgagaggcaatgaggaggcactttcctgaccagcatggtgggcaggtgcataccgtgaagggtgtacagcaggatttctcagccttggcgcttttgccatattggccgcatgattttgtggggaattgtcctatgcattgcaggatgtttagcagcacccctggccccagtaaatccctgcttcccccacagttgtgacaacccaaaatgtttctacacattgctaagtgtaccctgggaagaaaaatctctagggttgagaggcatcagtggacagggaccactgaatagttttcagcaggtaagtgattctctagtgtgaattatatgagctctttgcaatcccctgcccttttaaggcctttgttttggctcttctggcattttcactagggttcttagattttttattggggcagaaattccatgtgccaagctcctttgctgcatgtaatttacaccagcattttactgaagcagttggcacatcagtgttctccatttaatcacagccctgtgagatggatagttgtggatttgccacaggccacaggagaagtggcagcctggcagagcccctgggcactggctttccgcagcttcccagtgtctggaggtgcagaggcctgagcggctcctctcttcacagaggccatgtgtaaaagtaggcctctagtccggacacggtggttcacgcctgtaatcccagcactttgggaggccaaggtgggcagatcacctgagatcgggagtttgagaccagcctgaccaacatggagaaaccccgtctctactaaaaatacaaaattagctgggcgtggtggggagcacctgtaatcccagccactctggaggctgaggcaggtgaatcgcttgaacccaggaggtggaagttg

SEQ ID NO: 94651 - DNA, 1697 bp, Homo sapiens
cgtaagccctgaagatggcaaaaggtgtcataatctcccaaagtcatctgtatagatgcttcatttaaccctttttcttttgcagacaaagggttaaaaatctcttctttctacctatatctttaaagagggattgacaagcccaaatttccttttatgaaaagacccaaggtttctggccaacaattcacttttttcagtctcttaggtcctcttgcatgcctgagaatattgagtattcggaatctcctaccagcccttggtaaatgaccctaccaggtggaatagtttgagctttatctgctcttttttaatgggatagaggggaaggcaacacgtcttattttatcaaaaattgcaaagctacacgctctttgtggagaagcaccaaaaggaaaaccttagtttggaaggattcattgtaaataaaaatagtaactcagccctccattcagggaggagaaaggcattttaaagctagtatattgaaggtttcccccttgacttcagtgttgaatggctcttgcaaggacttcttgaaggttttttttctcactagccagtgtttggccgacaggttgcacctctgcctgagaagatgcctgaaagagaaaaggcagcatttgttacaggcataatgttgtagaggaagaaacgacaacagcagtcccctgcattcattttagaaccaagatgacgtctcacagttgctctgataaaaacacagggactccctgctcttagcatacctatagtgctcacctagaaaatctatgagttaagcactacaaacattttgttgtaggagcgacgtacgacagtccaattgcagaattatgaaaagcattggcagtagcaactctgtggtggacacacccacctttgctctcctagctccttttctgtcattctgtttgactttctcaagggagcaaaagaaagttgtactaccagttaagtctccaaggtgtctttaacccctccatccccctagcctttttggaagggagtggtgtgggagatatgtggagaccctttgtgcagggcaggggtggtggtgcaaagttatcagtaactctgggtttctctaagcacttggtgctgtcagagatgcttggagatggagtaccaaatgagctggggagaagatcctgcagaacaggggtggccaggtcatggccccatactggaaaagtgtacctgtgcagaaataaagtaggtgtacagataagttgtgctgctcttgtcttgggatggcagggttggtggtgaagaaagtgccatagaaatggcagcacagaggcaccctcatcctcagcaggcagcaggggtgaacagtaatggaaagcaccgcagtgagccttcatcatcataggaagaccagcaactccttttttagtaccattggctgtcttcttccagtatctcatttgtttaaataatagttcttggctcaacaagcttctaagtagtggccaactgttacagcagggttggtgggcaaattttctttttgagttcctccacttaccaggttaaaccccttcacatgggtgctccattgccgccatgggctttttgtcagggataagggtgcagccagccagcatgtccagagaggccaagatagagtcatacaggcgatctgcgtggctctccagctcaccagactgctttgcgatcctcccaaggacatc

SEQ ID NO: 94652 - DNA, 1001 bp, Homo sapiens
caggcatcttctcaggcagaggtgcaacctgtcggccaaacactggctagtgagaaaaaaaaccttcaagaagtccttgcaagagccattcaacactgaagtcaagggggaaaccttcaatatactagctttaaaatgcctttctcctccctgaatggagggctgagttactatttttatttacaatgaatccttccaaactaaggttttccttttggtgcttctccacaaagagcgtgtagctttgcaatttttgataaaataagacgtgttgccttcccctctatcccattaaaaaagagcagataaagctcaaactattccacctggtagggtcatttaccaagggctggtaggagattccgaatactcaatattctcaggcatgcaagaggacctaagagactgaaaaaagtgaattgttggccagaaaccttgggtcttttcataaaaggaaatttgggcttgtcaatccctctttaaagatataggtagaaagaagagatttttaaccctttgtctgcaaaagaaaaagggttaaatgaagcatctatacagatgactttgggagattatgacaccttttgccatcttcagggcttacgtctttactttcttggctaaccagtttcttagaagaaaatgtgtcagggacttggggatctacagtcatgctttagcatggctatggagctaattatcaagcttaaagggtaactttgggaggactcctcccttcactcctagtctcccttggaagagcagtccaggctcagggaagggaacggataggatgacacagtaagtacagaaactgaagctgtcaatagtgaaggaaaaaggggaattcttcgttgctttggcattgacacataagtactttgattaaaaaaaaaaaaaactatggatcaaccattcaaagcatcaattctatagctttttgcagcaagatgatcagttattgctggtaactgcagattctacagaaaagcacttttaaa

SEQ ID NO: 94653 - DNA, 1074 bp, Homo sapiens
tagctcttcaacagtagctacacataaaatgcagtatttcaagtgcctgatgctgctgtggtatgctttatcataatgcttaagggcatgatcaaaattaaaatggcttatgagtttgccatattaatcatcttagttccatacacactgagactttaaaagggaaaaaccactctagcaaataattgtcaattataaacctgtatgtaaaacattcttgaaaacctagagttggttaaaaaggtagagatgtctgacggcctcttcttaaattgatatattttaccttctcttagatgtacatttataagtaggaacatgtccttccactgagtatgttactgaatagcccttaggaaattaaacccatttatttactaatatttgacaggcatagaagtgtattaattagcataaaagttggagatgaaaaccctatagaaacaaattggccaatattatactaattgaatgcagaatgtggcattctattcccattcaactaataatcagcttcaactgacaggaatttgcacagaatgttacacaataccctgtttcccaagaaagtactaccttacctagagatgatctaagatatttttgttcatcctctgaataaggtgagactaaagggtgctaactccctggacctggctgtgaatgctactgaagagtatcaacacaactgttaattataccgccgtgctttaagtttaagacttaccttaaaactcaagctgaaggctgggcacggtggctcatgcctgtaatcccagcactttgggaggccgaggcgggtggatcacaaggtcaggagatcgagaccatcctggctaacacggtgaaaccccatctctactaaaaatacaaaaagaaattagccaggcgtggtgatgggcgcctgtagtcccagctacttgggaggctgaggcatgagaatggcatgaacccgggaggcggagcttgcagtgagctgagatggcaccactgcactccagcctgggcaacagagtgagactcttgtctcaaaaaaaaaaaatcaagctgaaattgtttcagcctagtaagatg

SEQ ID NO: 94654 - DNA, 2342 bp, Homo sapiens
agttgtctcactagctctttgttatttgtctgttaggtcaggaacgatgtttctgtttattccagaactatattatcgaactatattatcagtctttcaaatgtctttttaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggtatgtttaaagtttaattttcatactgaatttgaaggtgttgaattatgtatgggttctgcagtaacagtaaggccacagccttttaaaaatatgtgcactagaatactgtgacagtgacaatttgtgtagcatctgtttggatccaatgaacttagttcctcacgctccattatggatggtagaaatgcactaagaattagtgaaaaagatttttcagtgttaattgtgcctcattattctcttaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaatatcaaactgtatggtgataagtattgttttgattcttatggttaaagggaaatagagccttgcattatattcaacacagccatttgtgtgtgcacaatgcaaactaaggtattctagacctatcttagagcagcatccagtatttgctttctagataatatgcccaataacatgacctagaggggcttctgtgctgtgtagggatttaaccaacttcagtggttcagggagctcaaactatatgtaaaacaagtttagaatgtatgctatctagcccgttatctctgatccttctctaaaaccatttgaaatagcttcattgatcaacatttcataaatgcatctgtggtagaggtagaaagcagcacctttcctaattggcaaatgatcagactaatgtgtgctaatgtttttcttccatgctttcagtcagattcaactattttatcctccacagttgcttaacttggtgttggaggagggtttaagcattaagataggaagcaggaaatttgattgctctaaatttagaaattatatccctaaaaattaaaacatgaatactgggtggtaatgataattgaggcaaatgtatttattttggtgacattttgcatatatgaagattttctgaaataggaccttcaagatcctagggggttttgtttggtttttaattgtgaggaataaaaaatcttctgcccacactggcattttaaggtgactgaggtcaaacgttgtttccttaggttgaaatagcagccaaaacattcttcacgcaggggcttgggatatggctgctggcaacacattttgttgtgggctccttaatttaatgataaaatttaagctaaacacaagccaaaaatgaataggtttttttaatttttatttttcactaaacaggcaattgaaatacatggtacaaaaataagtggtaagataattgtaaaatgaaatggacagaatattcaattttccatctatgaaaatttcacaataaaaatcatagtttactttgtattataggcgtgct

SEQ ID NO: 94655 - DNA, 1028 bp, Homo sapiens
cgcagtggctgtccgggcgtcgtggttcacgcttatagtcctagcactttgggaggccaaggtgggcagattgcctgagctcaggaggtctaagaccagcctgagcaacatggcgaaacctcatctttgcaaaacatacagaaaaaaacaaaaaaaaccacaaaacctctagttgccagttattttttttatttattcctagtgattcttctttttttcttttttctgagacaaaaatttcactttgtctccctcgctagagtgcagcggtcagctcactacatgattcttttagagacatgttaattctttatattgagctgaagcctgtttcttttacttctgtctcttcttattcctccgccttgtagagctgcctgaatcagattaattcctcttttattggcaagcctgcccttcagattgatcttatcacaacctttcttctacctctgaagtcctcattctttcctgtaatgatattttcagaaccttgtgcaatttgggttattcttacattttataaatgccttttattaaatttgatttcttaaatcaagtatgagatataacacatgaggtaaatcctgtcttgatttggagcctgaatgaatttctctcttgaacttcaagggctcatggccctttcttattattaatcaaagacaaccatttgttgtttcagtagctatattatttctagtttgggtcttaaggtttttgatttgcttgttttttcttttttctttttttttttttttgagacggagtttcgctcttgttgcccagactggagtgcaatggcgtgatctcggctcactgcaacctccgcctcccaggttcaagcgattcttctgcctcagcctccctagtagcagggattacaggcatgtgccaccacgccgggctaattttgtatttttagtagagatggggtttctccatgttggtcacgctggtctcgaactcccgacctcaggtgatccgcctgccttggcctcccaaagtgctgggattacagtcgtgag

SEQ ID NO: 94656 - DNA, 1107 bp, Homo sapiens
atgcctgtaatcccagcactttgggaagccgagtcaggcagatcacgaggtcaggagttcgagaccagcctaaccaacatggtgaaactctgtctctactaaaaatacaaaaaattagcagggtgtggtggcgcacgcctgtaatcccagctactcaggaggctgaggcaagagaactgcttgaacctgggaggcggaggctgcagcgagccaagattgcaccactgcactccagcctgggcgacaaagcaaggctccatctcaaaaaaaaaaaaattgtccgggcatggtggtacacacatataatcccagctattagggaggctaaggcaggagaatcacttgaacccaggaggcggaggttgcagtgagctcaaatcgcgccactgcactccagcctgggagacagagcaatactgtatctcaaaaaataaaaaaacaaacaaacaaaatgttcaaaatgaggccttcaggcatggaaaagaaattcctattaaagatgaaagacagacaaagatgaaagacagtgtcctataagatcccttccagccacaggaaagtaacaaaatatgaatgtttcacacacgaatacacacccaaatcttataaacaccaatgatcacacataatacaattattccataccagtgctttaaagtacagttttgggtagatctttatgtgctctttatggtgccaaataaaaggttgagactgtacttatatcgtgggaaaaaatatggagggtaatttgttcactgattgaaagtatttcaagctatttctgaaaactaaatccttgcaagtcctaatttgacacatcaagtgtgtttacttatatcaatatccacagccacctatcttttgttaacataccttcttttcctcatcagagtcatgtaagaaaagggagcaacttaacctatcaaacacccatttatctgggcatgtcatatcataagtagtatctatatgctgcccaaaagtttacaaagggctttcacacgtattgtcacatacacaaagctattacagttggttctcacaactagcttataaattagtaaatcaggtgtcatcacacacattttagaaaggaaactgggt

SEQ ID NO: 94657 - DNA, 1106 bp, Homo sapiens
ctttttaaaaattttaaaatctcaaactggaaaggatgtctagttcattctatgcttcagtcccctcttctgatttacttgtttagaagatttttgtttccttctctgacttctattttgctgctgactggcacttgggatttttaaaaaattattttcctcatatataattaaagacaataagtataacaataagtataatatggtaatttgctaaaacccaaacaatgttttaagtaatgcatatcattatgtaaacctacgtaatagttgaatattcacaaagataatcgcttatagaagttttatatcctctcttctttggcagtgcaattaaaacaaaaaaaataagttttatgtcttgtttacatgtaaataattttaatctaaattgtgacgtggttttcactttagcatatttttgaaagtaaatcaaaaaggacaaaatacaaaatcatgtatatcttctacaaaaacgatatataaattctaaggtttttgtccttttgaaattgcttaaaagaatgcatagaactggtgtctgagttgggaaggatctatgagggatttccttggagactgtgggtgaataataatgttgtcttagttccatgaaggaatctctggggatagtttttgagttaggcctggcaatgttagagatacataaagagagccttgttttatcactgggtgcggtggctcacacctgtaattccagcactttgggaggctgaggcgggcagatcatgaggtcaggagatcgagaccatcctggccaacacggtgaaacccgtgtctactaaaaatacaaaaattagctgggcgtggtggcgcatgcctataatcccagctactcgggaggctgaggcaggagaatcacttgaaccagggagttggaggttgcagtgagccgagatcgcgccactgcactccagcctgggtgacagagcaagactccgtctcaaaaaaaaaaagcttggttttcaatggttctgaaaaatgctttaatacaagtgtagagtgttagtcaagttttgcacttggataaacagcctgtgaatttatcacatttctagtttataatatgggctttcagaagttat

SEQ ID NO: 94658 - DNA, 1008 bp, Homo sapiens
gtgtcaagaaaataattttgattggttcatctttaaggaatgtgttaagaataaagcatgtctacctgtcttcagtataccagctaactatagtaggaagaaatatagtagtctacttagatcaactataattctttaatgcagaaaaagtttaaagtatttaccttatttttagcccccatccccttaagtatatcatggctccagaatctctgaaaatgttatcagtctttcagactttgctcttctttcatgttatactcaagaaacatttgacctttttttttttttttgcttgcattgtgtttcaaataatttttaacaaaacttaagtgtttgaaagtgaaagcaggttgtctttgtgacttttggtggtggtttgaaaaactcagaaaagtttaaagaagaaagataactagtattctcattgtccagaatatgattttttaaatgtctatagaatatcaccatctgtaattcttccggtaatttaagtattcagtagttgtataaaacctttaaaatatatatattgagaattttgtgtgaatgagatgatgagataatcttgtaggatcatttaaagataagaactgaggcctggcacagtggctcatgcctataatcacagcactttgggaggcccaggcggtagatcacctgaggtcaggagtttgagaccagcctggccaacatggcaaaaccctgtctctactaagcatagaaaaattaattgggtgtggtcgtgcctgcgtgtagtcccagctgcttgggaagctgaggcgggagaatctcttgaaccctggaggtgggcattgcagtgagctgagattgcgccactgcactccagcctgggcgacagagcaagactctgtctcaaaataaagtaaaataaaatgaagataacaactgaaatttcacattaaaaatttttttgtagcgactgtgcctcctatgttgtgcaggctggtctcaaactcctggcctcaagcgatccttccaaagcac

SEQ ID NO: 94659 - DNA, 1863 bp, Homo sapiens
atcctccccgccaggtttcaggtaatatggatgcttttcgggactgcgtgggattgaggggaatgagtagatggtgagaagcaactgaacatttattagttctctttttgagttgtgtcttggaggagttgtttaagagctcgccgggtccattgccctcctataaaaacctgggcatttgtgagaattttgttttttttttttttaaagaggacacctaagtcattttgtcttctgtgggtcaagggaaaaaaaaaaaactaaagccaagaaatgtctttttgatactcgcagattaaaggaagcttgctgtcaagttgaaagagaaacgaacgggacctatgatagatctgtatgtaggttttggattacctgcttggatgcttgcagatagggaatgaggttccatgacgtgtcatgaaaagttaatgcatttctttttcttgcttactcaagaagtcaccacagcagatgtgacacacctggcacctttcctgggaactggtgttcacttcccttgggtagagtttgttgggctctcctcaatggccctttaaaaatttcctctacagtttacatgcatgtaaagtaatgaataattggaagagaccgaattggtattccttttcagtgtcaaaggcctttgagggatgggggaacatcagtatttgttgtaaaagttgagtttatttgctggtttggtcaattactgctagacattttcccctaaaaggtccacccaccagtttagctgactgtcatatgtgtgtcacatggctcttgcaaaatgcttacaagttttgtaatagtgtggcttgaagctgaaatcttttgcactaaacagaaaccgtagtattttattagaatttcatgttttagaagttgagggtagtgttcttgtagtgacatttgctgtgttgacagtttaaaaaaaattttttttcaagggctccaaggacaaagttggttttgcacagttgaacggaggtgaacttgaggttcttaatttagtagttttcttggtaacaataaagaacatggatttactgctttatcgaggtttatagacctctactgttcaggaaattttctgaatttgctatatatatgtttattagtgtaaataaatcttcaagattagttgagaactttgacaagttactcagcctctgaattttttttcccttttgtaaaataggataattggagtcattattcctgtcagggtagtggtgaaattcaaatgtatataaaagaatttgaaaaaccgtgtgagcattcttcaggtggtatgcatcattttcatgaaaggcattctattagtaccaggatttaggaatataatccttgcgcttaagaagtttagatataggccaggcgcggtggctcacctcagtaatcccagcactttgggaggccgaggcgggcggatcccgaggtcaggagatcgagaccatcctcggtaacacggtgaaaccccgtctctactaaaaatgcaaaaaaattagccgggcgtggtggtgggcacctgtagtcccagctactcgagaggctgaggcaggagaatggcgtgatcccgggaggtggagcttgcagtgaaccaagatctggccactgcactccagcctggacgacagagcaagactccgtctcaaaaaaaaaattatttattgttttgagacggagtttcaatcttgttgcccaggctggagtgcaatggcgcaaatctcctctcaccgccacctccgcctcctgggttcaagtgattctcctgcctcagattcccgagaagttgggattacaggcatgtgccaccactcccggctaattttgtatttttggtagagacggggtttctccatg

SEQ ID NO: 94660 - DNA, 1105 bp, Homo sapiens
cccggtcccttgcctcccccgacccccagcctccgtcggccgccggcaccaccctccgcccctctccgccccctcccccgtggggcgctgactcgcccggctgccacgtctcactgatgacatcactagggcagctcggccttagccaatccgccagggggagtccgagcgaagtcctagccagcgagtcagaggggaggggagcagggaggggccgagggtggggaggtgagggagtggggaatggggcgggcgacaacccttcaggtacgcatgccccagaggcgcggcgcttggcgggaagctgagtcctggccttgcgtcgcactgtctgtcctcagctcgcgtagccgcgctcgcgactccctttcccggcatgccaggcggtgcggccgccctctgggccgtgtaaaggcccctcggtctaaggcttccctatttcctggttcgccggcggccattttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatagtgagttcaggagagcaccggtcggctgggtccgtgggccagcttgggggatcttaaaggggtcgaggagggttggggcagaagtcggggcatcggctggggtgaggcgagggtgatgggtcaggagaggctggcggccgggagtcgggccccattgtctgacgcggaggggcggccgcgcgggggaggggtcgggccggaggggtgagccgcccgggcctggaccgggtcaggttagagggcctgactgcggggcgggtgctgaggaagcctgccgaggggcctggggcggtgtgaaggggtatcttctctcggaggcagtgacttttgaaggaggacttgtctctaaggggaggggatggggtgggagagcccttctagagggcactgtcagaccctgcgcccgcactctgcggagctgtcaggatcttc

SEQ ID NO: 94661 - DNA, 1079 bp, Homo sapiens
ccacgttggccaggctggtctccaactcctgacctcagacgatctgcccaccttagcctcccaaagtgctgggactataggtgtgagccaccgcgcttggccttatctctggatttctagctacagccaacatcaacttcttttttattatttattattaaatacatgtctgatgttagttccacatatgatttattttgttggttgttattttctgagtcgtaaagggaggggttccagtgttcaggaagcccaaaatgaatgaaatttgcttgactgcttagcaacctcctacctaaaaatcaatcttttgagccgggcgtggtggctcttgcctgtagtagtcccagctactcaggaagctgaggtgggaggatcctttgagcctaggagttcaaggctgtgataagtcatgaccatgccagtgcactccagacgaggtgacaaagcaagaccccctgtcaataatcaatcaatccatctgtttgtagttatgcccaaggaccaggtacaggaaaggagtttgccctgaagctgcagataccctattttatgtcagctgtggacaggctatgaataatatttacgacgaaagaaggtagtttcagtttttaaaaaaaatttaaatatgtcttgcttctttgaacagtcatacttttagtttttaaccagtttattttgtgtaggttgatgtgaggagcactttttaaaaagtgttaactctgtggttaaaaaaaaatcaaaattgtcattcagcttcttaatttcctaaattagcctctgactttgattgattggtttgctttgagtttgtgctgaaaactgaactgaatctttgccaattcagacagcaatactgtgacttgatatcttcttcttctttttttttttttttttttttttttttttttgagacagggtctcactcctctgtcacccaggctggagtgcggtggggtgatcacagctcactgtagcctttacctcccaggctcaggtgatcctcccaccagagcctcccaagtagctgggactacaggtgcacaacaaagcccagtaaatttttttgtaaagatggg

SEQ ID NO: 94662 - DNA, 1082 bp, Homo sapiens
atttgatttttgtatatggtgagagataggtatctagtttcattcttctgcatatgttcttggcacctttgttgaaaatgagttaactgtagatgtatggatttatctccgggttcactattctgtttcatttgtcaacatgtctgtttttatgccttgctgttctgattactactgttctgtaatataattttaaaaaatttttttgagacagggtgtcgctatgttgccaaggctggtttcaaactcctgggcttatgcaatcctcctgcctcggcctcccaaagtgttgggattacaggcatgagccaccatgcctagctctgtaatataattttaagtcaggtagaacagaggggacaagagtgcaggggttcacatgcagagtcagaaagggaaagaagaagcaagaaattcagactccatgtgtttgagagatcaagaaagactaaaagccagtctgcagcaagcactttggagagtgaatctgagtggagagtaacgtggagtgtcaagagatgtgcagaaaatccaaagaagtctgaggacattgtgtgcatcaagaaaagaagaaccagaagtcactgggacagtgatgatacttaacgtagaaatctaagtgggaaaaatataacaaagttagttttgtgattaaaaaaattttaagtcaggtaatgtgattcctccagttttgttctttctgctcaggctggctttggctattctgggtcttttgtggttccatatacattttaggtttttcttttttgttttttgtttttttttcaatttccatgaagaatgtcattaggattttgatagggattgcattgaatctatagattgctttgggcagtatggacattttaacaatattgattattccaatccatggacatgaaatatctttcaattttttgtgtcctcttaaatatctttcttttttttttttttttttctttggagacagaatcttgctctatcacccagcctggagtgcaatggcatgatcatagattactgcagccttatacttggaactcctgggctcaactgatcctgccaccccagcctcccaagta

SEQ ID NO: 94663 - DNA, 1049 bp, Homo sapiens
aaagtggaacactgataacactctgggaacagaaatcgcaattgaagaccagatttgtcaaggtttgaaactgacatttgatactaccttctcaccaaacacaggaaagaaaagtggtaaaatcaagtcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagacgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttgaattggttatctagttaccaatgctgcagtcctgcagtcacctatacattatttaaatgtatttaactgttaaatgcgctacccaccaataatgaaatagacctttatgaaaaaaaaaagtctaagaaagctgaagtttttatattaacataagataaaataaacctcaagacaggaataccagctgggtgtggtcactcacacttgtaatcccagcactttgggaggccgaggcgggaggat

SEQ ID NO: 94664 - DNA, 1062 bp, Homo sapiens
aatttttttgagataatttatacgcatataagtgagcattttcatccggataaatggatacttttgactatatctgtttattacttggaggtaggcataataatttaatatcaaaatagtatttaattcccatatttgagatatttgtgtaaattatgactgacattaggctggcgatcatgacagatgttatacagaaatgtgggaacaatagggataatgatgagaacagattctcttccatatcatttaagtttgtatcaagtaaactggattttgacttaaaagagagtttgtgatttgggagagaagagtgtgtgagaggtgtgtgtgtgtgtgtgtgtgcacgtggtgtgtgtgttatgttttagtttgaaaatactaaaaaatactagatgttattcttttcctctgaggtagtttttcctccatgtcttaggtcacattatttaagaagacactgagaaaaaatgaactactactcctgaattctgttcattttaagggtgggaagtgtattccagttcatcactatcaaccactgccaaggggaaatagctgtgagcaagtgggttatctattgcatatgctatcatatcatgctaacttctgccttaaaaagtaatccaggctgggtgccgtggctcacgcctgtaatcccagcactttgagaggctgaggcgagtggatcacgaggtcaggagattgagaccatcttgaccaacttggtgaaaccccttctctactaaaaatacaaaaattagccaggtgcagtggcgagcgcctgtaatcccatctactcaggaggctgaggcaggagaattgcttgaacccaggaggcagaggttgcaatgagccgagatcacgccactgcactccagcctggatgaccgagtgagactcagtctcaataaaataaaataaaataatccaaaagaattgtattatacttttagaaatggatagctgtacctgaaaaatgcccttaccttggtggctcaatataaactaagactaggtttgtgggcttgtaagaagacatctgaataatatgttttatgt

SEQ ID NO: 94665 - DNA, 2320 bp, Homo sapiens
ttattttttgcttctttcattatgctttatagtacttacatttatcattttgatatttagtgcaaagaaatgtgctgcatgcattgagcatttttctacaagtttttttccccctgatgtgctatttcacatatcacaggccttattttttgaacaattgagcaaaagaaacagatgaaacctcatacaaaaccctccaaaatatgaaaatgtggggtttatttgtgctaatgctcttcttttggaaacatttgtgttaaaggtaaggtcaatttattgatttaaaccacattgtatgtaaaaatgtattatccatgattaaactttctaagacattgttcttgatagaaaagattttctaacttgtggaataaaaagatttattttgcaagtgtcagaaatattaaaattaattattcccaagttttcttaaatattatgcaaaactttgatctacagctttgacataattttctaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtgagtttttatgcaggatatgcatatgtgtatttctgtgatattatgttaaatcaaaaattttcttactgttgctatggataaagagaataaaaataattgttttccttcagatcttattaagtatctactatatgctagtcattattctaagtaggaaagtaggatagatcagtaaacaaaaaatcctactgccatggagtgtatatattctaacagggaaaaacagaccaaaaaaattaagtttttaatttagtgagttaattaagttaattaagtttttatggaggagccagcagaaggagactgaaaaggctaatacaataagcagttacagagttaattaaatggtttgttagaaggtgagtgatccagttgacccatgagcaatgcaggggttaggggcaccaaccctccctactcacgtgcaaacttaactaccacccaaaatacttaacttctaatagcctactgttgaccagaagccttactgataacataatatgtattatatactatattcttaacaataaagtaagctagaggaaatactgttaagaaaatcatggccgggcgcggtggctcacgcctgtaatctcagcactttgggaggcggaggcgggcagatcacaaggtcaggagatcgagaccatcctggctaacacagtgaaactccgtctctactaaaaatacaaaaaattagccgggcgtggtggcgggtgcctgtagtcccagctactcaggaggctgaggcaggagaatgacgtgaacccttgaggcagagcttgcagtgagtggagatcgtgccactgcactccagcctgggcgacagagcgagactccgtctcaaaaaaaaataaaaaatcataagagaaaatacatttactataccttaagtggatgtagatcatcataaagatcttcatcgtcattgtcttcacaccgacgaagaagaggaggggttggtcttgctgtctcgggtggcagagacagaagaggtgcaaggggaggcaggaaagatttattgacaaaaatcgtgtataagtggacctgtgtggttcaaacttgttgttattcatggatcagctgtagatgctaaaggcaaaataaatcaggttaacggggagtgggaggttgtaattgtacataggttgtgagaaggtgatgtttaaacagacagggtaagtgagttagccagggtatataggagaatggtattccagataaagggagtagccagtgtaaaggtcttaagttaggaacaagcttggtatattaaagaataagcaaggaagccagtgtggttgaggagagagcaacagaagatgaggtcgagtaagtaatattggtgccttgtaggctctaattaggaattgggcggctggaagtggtggttcaggcctgtaatcccagcacttctgggaggccgaggtgggcggatcacgaggtcaagagttcgagaccagcctgaccaacatagtgaaacgccatctctactaaaaatacaaaaattaactgggcatagtggtgcgtgcctgtaatcccagctacttgggaggctggggcaggagaatcgcttgaacccaggaggcagatgctgcagtgagccgagattacaccactgca

SEQ ID NO: 94666 - DNA, 1063 bp, Homo sapiens
cgctctattgcccctgctggagtgcagtggcgtgatcttggctcactgcaagctctgcctcccgggttcacgccattctcctgcctcagcctccccgagtagctgggactataggcgcccgccaccacacccggctaattttttgtatttttagtagagacagggtttcattgtgttagtcaggatggtctcaatctcctgaccttgtgatccgcccagctcagcctcccaaagtgctgggattacagacgtgagccaccacgcccagcctggcataacatttttaaaagcaaaacagaatgtgataagagcagttacctaaatctatttaatttacctttttttccccaaatatattttaggaaaaattgttgttggtaatgattttggttacagaacagatgtatttataagtactagtgttccggagaacactgggaaattttaatcttttgctgattagtacctgattattcttggtttctagctcccagatggacgtatcatcaaagttgggggagagagatttgaagcaccagaagctttatttcagcctcacttgatcaatgttgaaggagttggtgttgctgaattgctttttaacacaattcaggcagctgacattgataccaggtacattagaagtggtgatttcaaagttatttatcagaaaaatcataaaaatagttttaaagttatttatcagaaatagatggaattaaatagaatgactaagtttataaacttacttgaaataatttcagacttacggaaaggttgcaagaaaaatgcagaaaacttatctgtatcctttatctggatttaccattttactaattctaatgttcttcatgtttgctttttcattctgttttttctgaaccgtttgagggtagattaaatgcatcagttctttactagttggtgtttcctaaggataaagatactctcttacatagtcatgctgatttcagatcctttggagatacacccagtagtggaattgctggatcatatggtagttctatttttaactttccgaggaacctccatactgttttct

SEQ ID NO: 94667 - DNA, 1190 bp, Homo sapiens
ccatcacggttggaacgagaacttaaacagctttacttagaacgagttttgaagggtgatgtggaaaaactttctgtaagtattagtaaatcaactattactaacattcttttaaaaggctatacagtagtttgtgaatcttgacaaccaccagagggagcaagacgtcttccaaaacaaattcctactgcagtcaagtgcatcctggaaatgatagcaagaaggaaatagttcaagataagctctggtcacctctatagagttggtggatggaggcagtgaggtcagggccaaaagttctggttcatctgtaacaaccagcacggactctgaggcacctgtatatgcatgagaagaacctgctgtactatagggaaataaatgccccacttgagttttgttctttttttaaacttattttttggatatgcaatcagccttcagcacttctcttgggctatctcatatttctgactttatttgttgcatatgttgtcttctcagtcagattgaaaaacatcatgtctcaaaattttttgcattccggtgactgtcataactcttgaaacagactttaattggttgttgttggtatgtacagtagaaagaaatttttaaactagaaatagttgatgtttctttggcataggtttttgtgttttttccaccagactctggactatgtgaagtatacagtatgtgctgtatacttaaccaagagttatctaatcctgagttaatctctgagctttgtctcactgactttgatcaactgttttagataatgagattatgtattacagagtactgtatgttacatctttcatatatgactcattgttgaaattaaattgagtatgggctcacatacattaaacagattaacagactggaaaggagccatactgtctaagtacttcacttatttttctgattttattgagttttacatataatttataattaatctcaggtgatcatttattcagcaaacatttcttgaactcctgggtgccagacataggtctaggtgccggggacaaacaaaacaatgaaaacagaatccctgcttttagtctaaataatgtattagtggtaataagtgatatgaagaaaagtaaggtgaagagctggaaaatgttagtggttggggaggtagtgtgctccttcataaactgtgatcaggaaag

SEQ ID NO: 94668 - DNA, 1457 bp, Homo sapiens
tcctgacctcgtgatccgcccgccttggcctcccaaagtgctgggattacacttgagccaccacacccagccatgcaagtcctcttatccagactttgcttgacagcaaagtgactttcccaagtggtcatctgccattggatgggaaatttgctctaattatgtcttggatgtttggtctctcagtagggtgttaagtcatgtaatttactgatcaaattaggacactcaagaatggaaagggtggtattaataatgatgggacaccacgtgtaaatcaggactgttccaagcatgctgggatggatgtgtggtctcctaaacatgagctttgggcaaattactaaatgtttctgtacctcaggtaccaaatattacgttctacttatattacaggactgttgcaagtttgagggagagcatatatttaaaaagccattttcataaagcagaaagcactgtgcacatgtaccatttcattatcctttctttctcctttagaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccgtcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctataggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatca

SEQ ID NO: 94669 - DNA, 1191 bp, Homo sapiens
gccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatagctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccctgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaattctgttttaaaaagcaatctgattcttagctcttgaaactattgctacttaaatttccaataattaaaaatttaaaatttttaaattagaattgccaatacttctacatttgagaagggtttttttagaaatacatttagtaaagtccccaagacattagtcttacatttaaacttttttctttaaaacatggttttggtggttaacttttacacagttctgagtactgttaatatctggaaagtatcttgagatatcagtggaaagctaaacagtctaaattaacatgaaatacttcattt

SEQ ID NO: 94670 - DNA, 3304 bp, Homo sapiens
cagtaatttcaggaagggtctgtttcttcacggagcatcgtgatggagttatcgagaaaggtgcattttggacggctagggagggagaaggtggggtgtttttttgtttgtttgttttttggccgctgctgtaaaataatgtctcctctcctacgggacagccgatgccaaggccctaccgccaggtgagcttcccggacgacgacgaggagatcgtgcgcatcaacccccgggagaagatctggatgacggggtacgaggattaccggcacgcacccgtcaggggcaagtacccggacccctcggaggacgcggactcctcctacgtgcgcttcgccaagggcgaggtccccaagcatgactacaactacccctacgtggactcctcagactttggcctaggcgaggaccccaaaggccgcgggggcagcgtgatcaagacgcagccctcccggggcaagtcgcggcggcggaaggaggacggagagcgctcgcggtgcgtgtactgcagggacatgttcaaccacgaggagaaccgccggggccactgccaggacgcgcccgactccgtgagaacttgcatccgccgggtgagctgcatgtggtgcgcggacagcatgctctatcactgtatgtcggaccccgagggagactatacagacccttgctcgtgcgatactagcgacgagaagttttgcctccggtggatggctcttattgccttgtctttcctggccccctgtatgtgctgttacctgccccttcgggcctgctaccactgcggagtgatgtgcaggtgctgtggcgggaagcacaaagcggccgcgtgactcagtttccctcccttctccctccatccgcagccacaggggaactcgtctcttacatactctcatcttctcccccgctcccttccactccaaggagcgaggagggcaagcggcctcccagctccctggtacctcgaggcaccattccagccagggacgctgccgggtagactctccactccccctgccgcccacactgcagcagccacatccatacacacacgctcgcacagtgttctgaggaaggaaccttcgccacagactcctgtactattaacaatctgtaaccaagctaactgtctcatccatgtgttgatttcctgtttcctcctcccccgcctcttccagttcaaaggagtctgcaattggaactgctgattttcggtgggttttgtagttgatttttccaagagcgtcgaagactctctttctcttggttcaccttgcctgtcgctagcaagcatctggttcagcggaaatgggatgtgagaatgatgaaacccgacagaagtatctcagcctgcagtcagttattatgtataggaggtgagctagttaacaaacttgtaccacaaaacaatatcgctttaacttttctaaagccaaatttcccatgtaagctgcagtttctatctttagcccatcatcattttctgcccccccaaaatctgttgaaatgattcactgatgcaaaacattcacccgtaatagactgagaattgagccttaacttcagattaacttgtgagaatcaggaaaattccttcaactgcattgcatcctcttggaccagggctagaatggggatttcaggtttctatgagcctccccattacccctaaagtagaacattttttaaattgtgttgccaccacttctaaaaatttagcaatattagaataggatactagtgaagtaagaaattttgcttgttgttttgcaaaccaaatagtttcctcaaacacaaatcagtgttcccacgaacaagttccagttgagaaacactaaggttatggtgaataaaaccatagggagcttcttccccccaacccctggctattttatattaatggggagaggggatttttaaatgtcataaatttgaagagtggtgggttgcattttcttcatgggtttatgttttcgtttcattttggactcaatttcacatcaccaaattcctcatttatacttggggaaaaaacaaggccatatgtaaaaacccttccaatgcctaagtgtctttctcctgcaactccaaacccagactcgccactttgggtgcacaggtggttaggtcagccaactggttctgcctgtcgccttgccacggaggaggcttctaattagctggaaaagagtatttttctaatacgttgcaaggattagccaaatcttcttattgaagaaagaagaaaagtgaagagtggttacctatacctagcatagtacaatcagaacctcgtggagaccaccggggacaggcttgcggacgccggctgttcttcccgccacgatctttctgtggtagcggccagcagaagacatggcctgctccccactccctttccccactccttctttattgcacacaggacaccagtcttcaaggaaagggacttttttccagtctgccaatcatattgggaaagtgctagctgtgctcaccttcatggggctgtttccagctcgtccacaagctcatcgattttctttagtagattaccggtgtaaatacccagtgtgcttatgagtcagttagtagacgtcttcattcattggagtaactggtttaggctttccagtttggaaaaggagcagagagctgtccatctggattgatggaagaaaagagaacctcatccatgcctggagaacatctagaaaaccttcagccagcctccagtgctgtcgagagaccaccttcccccgacccggaggcacttccttggggtctttctctagggtctcttctctacaaagcacaacactaatgttcgtttccttagacctcagttcaagtgcccctatttatttcaataagaacgcacatatcccagctgttttttgtttgtcacctctatttagttgttacctgtttctctcttctttcaccccttgtccttttccacccttttaagagttacgctagcagatcttactccacgtatactttttggtttgtgaaggcatcggttaagggcacaaagacagccatggggacatttatgtaaatacgtctctaattgccacactgcagctgaacagtgtgtagtattttcccagtcagctttgccatactgacgtcaatcatttgagagaaattattcagattttatttttgtatctgtggtaacaaaacattaaccaaaagattttctgtccagaagcctccccgaccccccaagctatttgctcacattaacaaattaaagtgcctgaagcataattcattctttacctgtatactaaaa

SEQ ID NO: 94671 - DNA, 1052 bp, Homo sapiens
ctgcactccagcctgggtgacagatcaaggctctgtctcaaaaaaatgtatagcaaaatagaaattttaaatcccattttatttttgccataaccccaaggaagattttggcccaattttacagatgtaaacactggagttagagattaacttgaccaaaatcatcttataattagcagagaatgattcaaatctaatctgcctgagctgagaccctgttgtttttagcattgtaatactcccctcgtttctgttgttcagtgcctcatattaggttgcacacttcttaattggacatcttttttttttttttttttttttttttagacagggtcttgatttgttgcccaggctggtctcgaactcttgacttcaagcgatcctcctacctcagcctcccaaagcgctgggattacaggcatgagcagctgcacccagctggacatctttttagcaacaggcattgacattgagtcagagtcaaacccaaaggcaagagtgtttttagagggtacatttgcaggtggcaagggctgtgctccctgcatcatagtgcacaagacctcccagtgtcagctggggccagatggcaatgccagcctcagtgtccacagcaggagacattaaacgcccactctgacctgctctctcaggatgctgcagtcatgccttctaggagcctgaagtccccgagcacagagtagtcacaggggacctctgcttttgttcttcaaagccctaacagttcttagacccccactggagagcaaggggagtgtagatacagttgggagcatgtgattgccaactttttcattgaaggtgacagctttcagattggtaggttggtaggtgtcagtagcttgtgcacagaaataacagagagatgtttaagaatcttgcttgtgtattaggtatgtgcatacctcaggtgggctgcttttctgcagcccacggaaaccagggcagagttataggagagccagttcagaggtgcatgagggtaaaaggagattttttttcccctttgcctttcttggagatgccctggt

SEQ ID NO: 94672 - DNA, 2822 bp, Homo sapiens
tgttgctcacgctgcagtgagcaacactgcacatctgccacacagcacagcagtgtcagctctcccaggtctgtccaaggttgtcttaaagtctttgctcagatttaggatgaccagctgccctggtttgcccaagtctgtcctggttttagcacaaaatgtccctagtcctgggaaacacctcaatcccaggcaagccaggacaatcgcttgccctatttggagtcttctgtgaacacgcttccctccctggcatcaggggggaaagccagcagtatctttcctgatgagtaattaaacatctgataagaaaggcctgcaggctgacttaaggttaggcccaagtgtgctaacgcaggaaagggtttttagctgttttgacacagcttgagttaatgggatgtaactggaaacaaaatgatttctcagcttgctgcttcagttaaatcctgtgcttctagaagttaattaacaaatagttcattgcctgcctgctgtgtgcttagagcagcaagttacgcgggacagcattttctttctttcctttttatttatttatttattttcaaagatggggtttcgctgtattgcctaggctggttttgaactcctgggctcaagcagtcctccaacttcagcttctcaaagtgctgggattataggtttataggctttagccaccacgcccagcctggacagcattttcaaattctgggccttgacccacaataagaaatatatgtatgttgtgacccaggacacatatgtcaatagaaacctaaagcaaatcatatttcatcctctgcattctgattttttttctgtttcattttcttccattttttattataaaacttttcaagcacacagaaaaatgtaaagaatagtacagtgaatgcctgcataccgtacacctaacattcagctgttgtaacatttgggcacatttgcttgatctgtgcaagcgtgtgagcttatacacacacagatatttttgttgttgatccatttgaaagtaagtcacctctcgtactttagcatgtgtcccctgaggttcacaaaggaatttaagggcagtgacactactctgtatgtcaccgtaatggcagatgcatgtcattatgcatttgtccaaacctgtagcatgtataacacctgaatcctaatgtaaaccgtagcctttgggtgatagtgatgtgtcagtgtacttcatcgattgtcacaaatgtaccaccgtggtggggatgttgataatgggggactttgcatgtgtggggacaggggaaatctctactttccactcggttttgctgtgaaactaaaactgctccaaaaaaaaagtctaataaaaataatttttaaaagaaataaggcattttcctgtgtaaacacaccaccattacgatcccttagaaaattaataagaatttcataatgtcatctaatatccacttcatagttccccagttgtcccaggagtgtcttttgtaagctggtttttattttatattttaatatattgggtgcaacccattaaacttgtctcccattgtactcatggtttgcaactggtgatttgaaaaaccattaccttgggaatacaaaggtatgtgagccatggctccaaccctcaaagagatcacaagatggtttgcagaaatgagactgacccatgagaggcttacagactgtgaaaagtagtctggttgagagatgagggaggggcatgggatcaaaaaagtcctcgctgggggtgaggctggactgaacctctcagttgcatttgaacggggttcaagaaggggctttgagaactgggagccacaggggcaaaggtggaagcaggggtttgcgtggtgcatagcctgatcattgccgacccaacctgacttgaactgagtgtgcagagggggtttcaggaaatgaactcagttgtccttccttggattggctggtgtgatatagctcccaacagacttcctatagtgctccgagcagatcctctcaacagttggcatgttgcttacatctgttcctttgtcacgttttgagagacaaacaacagcaggcgggttaaaaggtggcttcctgtgctccagagcaaacctgtcattcgcagctgcttcccagctacctgccagaagtgatttatagaatcagaagagggtgagagggaaagggatgatggaagccagaatccctcctggttttgtcctttaatccacgggggatccatgtgctactctaggctaacaccaaatgcctggaagaaagtttaggagcagccctgctgcttccgggcacttgcagactcactgcagaaagagcaccacttaatttcttgtattctgtatagaccctggtgtctgcgatcaattgccttcattccatttgtttacaaacaaggacctattaacaatagtacctcctttccctagaaaagcccagtaattaggccattgactcttaggaacacactccatcagggcttacaaaccaggtcccccttcatttatgagctccctgtcattagattttctgtcctgagataatgaaatgtctggaacctagagccagggacatgagcactgctttagctcacatgtggtccacagcttcccagagtggggttgtgttctaaaacttactggtaagacagatatttagaacttggaactcagcgcagttgtgtctaatgacatcccagccccctcccatccacctcaggtgttgtctaaggcatggatagagcacatagttaaaaccaaagcaccaagacaatgttggttttgtcctagatgggcttttgggtatttgcaagt

SEQ ID NO: 94673 - DNA, 1107 bp, Homo sapiens
attcatggagcatgccattgaggtttggatggtggcaggtaaaacagaaaggcaagatgtcatctgacattaggctacttataaataaatgtttatctagcttttatttcatgccctaatgaataaaacatgcttggaaaaagaaagtaacaagaagtagtggtatcatactttgtgggtttttttgggttttttttttttttttttttttttgagacggagtctcgctctgtcacctaggctggagtgcagtggcatgatattggctccctgcaacctccacctcccaggttcaagcaattctcctgctgagtagctgggactacaggtgcgcgccactacacccagctagtttttgtatctttagtagagacagagtttcaccatattggctaggttggtctcgaactcctgacctcaggtgatccacccacctcggcctcccaaaatgctgggattacaggcatgagccaccgtgcctggcccatacttctataaattattatccatgcttatagataaatactttggaaagtaatcatcacctcccaagggtgggggattgacacttcataatatatggtcttatggaggaactcaaatgttcagttctatgttatgaaggaatctatgataggaaggaaaattgaatgtccaaaatctgttttaaattcatggccctaaacatggaagaacactacttctatctgtatttgatcatggagtgtatactcagaagccaacagatgattcagaatgtgcaggattgtgcaggatcccacagagaaaatgcaaagacaccacaagaatatgtcagtgttacatctgagaccctttacagcagcatctgttgggttttatgtgttaagtgtacaaatttaaccttcttttgcaagcacttcttatagtttaaaaaaatttagaaaatagataagacagaacaatttgtaaatgttacatgtgggttaacagaaatgttattttcacatttgatttcatttctgaaaatttaaagggagaagacagctaattttaagaagtatttgttcaggaaataccctatataatagtcaaataatgaaaacattcttgtttataatatttttg

SEQ ID NO: 94674 - DNA, 1058 bp, Homo sapiens
aagggaatggtagatcttgggttgggggggccaagggagatcagttgggtggcagtggagggtgagccatagggggtcatagaaaatctggtggctttgcctttagcggtgagtgaggtgagcagggctgtggggcacagggactgcctccacgtctctggccaattgtggggaccaggttctgagtgcccagggtgagggcgtcttccctgaggcccagggaataatgggggttctttgttactctgcaactttgtttcctgagaatctgttataacgcctggcatatacaacacgcaaatatatgtttgaatgagtaaaaatgaattctatccaaagaaagaaaacagcaagtgagaatgtaatggccttgccaaaaatccaaataaatttcccccaaaagtgatgaagaatgaaaagaagctagaattggtctctgggggagaaaaaggatttttggcaaatgtgcagaagaacttattgtgaaattgaggttttagactggaagaaataaaatcataaacagaagtctacaaatatgtaaagggttattggaattgaaatattttcctacctagatacgtgatttcatggtgaatttatgatttgcaagtagattatcctattttatgctaaatgagattcttggctttataaaatgttaaaacttggtcattcattttcaactcattttaaagggttgaaaccataataccgtcttaataggtttgtagtctgggcgtggtggctcccgcctgtaatcccagtgctttgggatgccaacatgggtaaatcacctgatgtcaggagttccagaccagcgtgccaacatggtgaaaccccatctctactaaaaatacaaaaaactagccaggcatggtggcaggtgcctataatcccagctacttgggaggctgaatcagaatcgcttgaacccgggaggcggaggttgcagtgagccgacatcgcgccattacactccagcctgggcaacaagagcgaaactccgtctcaaaaaaaaaaaaaaaaaaaaacaacaactaaaaaccaaaataggt

SEQ ID NO: 94675 - DNA, 3041 bp, Homo sapiens
cctcagaaaagcagggacacagtgaagactggacggaagagcctgttttctcctcttgataaacatagagcatagtgccctggcactgtgagctcacaggaaagtgttagtccctgtttaagtacacgggttcttttactagtactctccattgagtgtatttgttggctgatttcactgatgttaaataactgtggagaagcctgttgttaagtgatcttagcccacttttcaccttctgtacatcttacatcatgcaaactggttctctttatgaaacaaacgtttaatgatcagaaaatctcttctctgcctcacagtgcctgctcatccatgtttgagagaagagctgatggcctttgccagaattggctactgccagatctggcatctttgcgatcgagtctttctactgtgggcatttatgagctttcgttaacactgttttctgtaatggcctaccctaaccacacaaacagtacatattttggtggttaacacaaaggccttattttctgggacattatagcgtgtagagcaagtgttctaccttcaggggcttgtacagagcagaaaatcatgttaccaccatgcataaaattacgttatgttaactttccttgcccataaagttcagaatatataaacttccaaaaccagggcagtccgcttttaaaaaattcttgagtagttgatacttaagacgaacacccacaaaaccaccacccgacttaacaaatagaaagtatgaccagtaccctcagcttctcaacacatttgattctactgaagcattttgttgattctttttaaaaagatcactagtcatatgtattttatattcacatatacttcatacacacatatataatattttaaacatataattcgatgaaatcaaagagcctttataaatctataagcacaaggaagaccgggggcgggggatgtgattaaaataaagtgagtgtgcctggctccctgcaagaagttggtgttatatttggctcagctggcgtctgggagttgggctggagaggctgggatcttggctaatccctctcaaggtctggtgaagtggagaagaggctgggaggaagtgaatctaatgttgagcataatggagagataaaggagccgtgtaatcagataagggctggctgtaggaagtatttatgggggaggtaaaagtcccagtctccatccctgaaagaaatggggaggggcaggagcagagggccagttcacagatggcggacagcattattttcttctacaggtatgcctgcagtggacgactaaacctggtctttataaacctgacttctcttgacaattgctggaggtccatgtcaaatttcctcctactgtcaagagcctgacagcttccctgcccctccactctctgatagctggaaagggcaggcagtcgaaacccactcctcagtggccagggaagctggtgtttcaaggacctgtttttgtcactgaggtagcctttcagcaaaaatgatgatggttacaacttaccaaacttctggatctgacacgacctgtaacactactttcagccagcagggtagatcccctattcattttgcaaaggaggaaactgaagcttaaaaagaggtttcttcagctcctgagagggctggggacttcagggccgcctggccctagagcacacattctttgtgagacccagtgctgcctcgccgtcatctcctacacttccttggtttatgtctgtaacgtggcccagacggggcctgctttgaaactggagaacacttagaacataaaggctgaggtctaaaactttcctgtggagatgctaatccagttttgaaagatttttttctctgccttcctatcctgacttacaatgtcacctgcctcttttgcatattgcgtgatcccgggacaggaagccctgtttttacaaaaagtccacatgttgggaacacaaggctttttccttaaagaagccacatttaaatgggagatcctcagtccagccagttttgctcataacacaactaaagaatatggtattgagggctggtcgtccaacaccatttgtaataacattgttggggctgttcagctcaagttcagacactcgggctccattcagttggggtttggacccttggctggagcttcactagatccacaccattacagcagttgttaatttcagaagcattcttttaaaatgttgttatttttgacaaagatagcatgttttgacatttttttctaaggcataccagcagcagtttccttgtgcaaatttttaaaactaatctgcccttgcccttcctgccccatccccccaccactaacaaaccctgcatctgttttaaacagatgttgtttaattctttccagaaagagggggagggaaggtgggaagagagttttcctcctttatacctttttggtagtggagttcattgtcatttctgtgctgggtggggtgaagtgcctgagtaacgtaaatacaccatggataggaagcagttggcacgcagccatgcagctggattatccagacatcctttgcagcttttagtccagcactttatccccctgccttgttttaaatagccagatgcctcagttaatgctggctgtcggggctgttgccggaggagacaaagggggcttctgcccctgagcctccccttcccccaatcccatcacagagaagtctataccctggagaaggcacttgataggaggcatcgaggcaggaaggaggaggcctcagagtgcaagcaaaggccagagttaacagccttgtagtctggacacagaagggtatggtatttttaaattctctaacaaatgggtactttttggaaataagtttatggcactaacataagtaatgcaaacttctctttttcatgtttacttaatcccctcaaagaaacagaacagcacataactgcaacacaaaaaaagtgaaagcatgttttaacaagaggtgcacagagtttcaattcttcaccttagccatctcctgttgagat

SEQ ID NO: 94676 - DNA, 2603 bp, Homo sapiens
tctttccctatttttaagctaaataattgctttgttaccttttcctaacattttctccttttcactctgaatgtagtaaagattggggctggggagttcatgttgagtcaactgataaggcagatagaatcaactgtttgggagaaaaagggtagatctctcttctcttcttggcctgcatttgttccataaatatgtcatggggtttttcttccatgtggctaaagagaatctcacatttgtggatgcgtaaacccagctagatgaccaggttgtaccttttattttcccccagaggatcttattaaacttattaaaactcaattttcatcattttcttgctttttcaaaatacttggataaaccagtttcactcctggaaacttcataattgtgtcataacactggcactgagagaacatatctgttagtctgtcatggtttcaggtctttgtggtttcaagttttttctctactcaaagtatactctcagttgcattttactgctgaaagttttctgatctgcttttgtagggtattttagtggcttaagtttgctaagccctctgccacaactacaggactttaaggccatttttttaaaacacaaagcatgaaaagggatcaaagttgaaagggtctcaaaagtcatttgtggtctctacccctcattttacacataaggaaactgaagctcagtaataagagtttggggtgcctcacccggttgtgagaagatgtgtaatggaggttaggtcaggttaggtcacctgtcctgacttacggcactcattacaacagatccaaaaaggaattacctctattggtgtgaaacttcagcaggatgagtaggatcaccctctagctctgtgattttttcatgtagctgtgttgccagtgttacctcttcatttctccttagaattcctttcacaatcagttgcctatccagtaaatttcaagggaccaagataaggaataacttatcctccagagcacctaacttgaatatgcgcacttctgccaccacacgaggtcctttcaaaagtgtgatcgggggttgtcacagagactgatcttagtcctttatctgtccctaatgtcagtgaccttgaacaagtcccttctgcagtctggattttaatttttccacgtgagagaggagtctagcatagacggtttccacagttctttgtatgaatagcttaagaggtggaactaatgtgaagacctgaactctgccttcgggctgacctctataccactctccaggagggaagtgaagccgtccagcatgcttcagggagaacaggtgccttgactgtgtgttgtttgtttatctgtgtgtttagctctccatctctaatgagggaggtggcagaatcctagaaaaaaaggaactaaatgcattagtaattcttgccatctgagagggcatccatttctagtggacctgtgggaatataaacaggctcttaaaaatcctgtcagcttattgctagcatgatctgctgattttcctccctcctctataggttaaattatcaccttcttttgtttgagagcaggttttttgttttgttttgtgttttgagacagagactcattctgttgcccaggctggagtgcagtagcgtgatcttagctcacttctaactccgcttctcgggttcaagcgattctcctgcctcagcctcccaagtagctgggattacaggtgcccgccatcacacccagctaatttttgtatttttttagtagagacggggtttcaccatgttggccaggttggtctggaactcctgacctcaggtgatctgcccacttcaacctcccaaaatgctgggataacaggcatgaaccaccgcgcccggccagagaacaggtcttattaagggctggcttgtaaaggattttgtaggtttagaatttggtattaacatagtttggtagagtcatttcctgaccttcttattaggttttctttggggtagagggcaggtggtagatagcaggtacacacacacaaaaaaaaaaaaaaaaaaaaaagagggaactggggaactgcactctaaatagcagaaagaaaagtaatcagattctgtttagtaccattatcagcatcttgtagatttagtgttgatttccatttagaaatcaaccataacactacaaatctctcactctcccaatatttatgattttcaggtgttcagaaaagttgaaagaagtgtatgctcaacatccatatgcctaccacctcaagtctgcaattagcattttgctattattgttttatcatacacatatctatccatctatctccatccatgattccatgtttttttaaatgcatttcaaagtaggttgcaaatatcatggcatttcttcctagacatttcaacgggtgggttattacatactcccttcctttgttttctccaataatgtgaaagaaagcaaaaatattctgagaaagtcaggcataggagttcaagggctgcaatttaaagccctaaattggagattattaactttaaacaactcctctttgccatttgttttttgaagtaccaatttttctattacatgtacactttaat

SEQ ID NO: 94677 - DNA, 1035 bp, Homo sapiens
cacatctgagagcagctcagacagttagctgcatcatcttcatagagttcagtgtataagaactacagcaagattactatctctttcttgatttcaatcgaagagatgacttcattcattcatttgtaaagattcttcagattggagatgtccaagctagatttggctttttttgttgttgttgttttcttttaaacacatgttccctgtacccatccagtggaggagatgggttgcctgttgttgccctggccctgtggggctctgctgtttgactgggcctcttgaattccattaaatgaagcacagacagcatgtgtcataaaggctgcttgggaggggtgaagagcaaaattagtgtctgtgggtgggcatgtgttctcatcacgtcgccagagaactgcaatgtgcaaaatctggctggaacctgttccaaagaaaaataaaacagcccctttttccctgctttgagtaatattaaaaaacatcgcttaacccccatgtagaagaaatggaactgtcaggaaattcttgtgattatgtgtgtgtgtttaataatctgtgtgtttaatctttacaactgaggttagaatacaagagatgaaaagggactaatcatgaaaaatattttggtgtattctgttgctggtgttgtagacattgtaagtgttctttctattaaagtagaactgcctaaggattagaggaatttgtcagagctaacaattcagggaaaatctattttgtttaactttcttctgttcttctttgaaatgattttgtaagaaaagccatttttgtctcagtaaaaccagtaccaaaggaaatgtttgtgtttttcttatatatgattcacctggtaccccaaggaacaaagcaaagccaacatttacacttacatttgaagcataagatcttccttttatagttttcttgagaaggtcttgcatatttattaattgctcctcatagtatagaagaatgctttttaagggagggttgtgatgtatgtagtttgcataatggggacatatg

SEQ ID NO: 94678 - DNA, 1050 bp, Homo sapiens
taaaaaaatactttgtgagtcttgcttgttagggacagatgctatagttagtttatagcagtactatttatgctttcctggtctgtctgtccagaatggctaggtcaggacctataacacaactgcccacaaatttgcctaagatttagcatttgtggagcagcccagtgtatagcagtaaatcctgttatcactcagagagcattaaacagatctggggttaccaagctggaaaaatcggcaatctttgtttctcttcccctttcttataaaatccataataatgacttgttttccttgaagtgtatgaattttaagctgtcagtaaatgcattcaatttacttaactacattcagaaattcctataatttggaaaaccagcatgaagggagtttgtttctgtttgttttgtagattaaggggtgtactttttatagaatggccaatttgtttttggagacaagaccatctctaaatttcattaattttgcattctataaatgaaagccacctgttatgctgtaacgtgctaattatggtagaggacaataatgaagaagaacagtatttgaaatatgtgggggttttgctaagaattttcatgcccacatctgtagtgcttatttttatgtgtgtatacatgcatatatagtacacatttaataatagcacttggtgacattaaaaaatacttcagattcaaagtgagggccattttttattaacaacatttttttaagttgtgaaagaaaggctactttaaaagtgttagcttgaactaagacccatattttgccatcttatagtaaacggggttttttcttatagttttggtgaatgccacactcaacttagggttcactttatcaaattcattagaaaaatatacattaattttgttttattttaaagacagaataactaatttcctgtgctttcacggaaacattaggtttcatggtagcattttttttttccttgaggcctatggtaaatgattatagtcagggataaaaaaaacatttattttaaagttcttgatttagtga

SEQ ID NO: 94679 - DNA, 1496 bp, Homo sapiens
ccacatttctttaccccgtcccttatttattttttgctaaaatattcacaacaaaccccagatatcatatcattttacccctaacatacttcaacatgcctctctaaaaaagtagacattttataaacacaatgccactatcccacctataaaattaatccaggaccaaaattttgatgtatactttttacatagcttctgcagctgggtaacctcacagcacaagaatcaacaagtccatgcctacacgaattcagctgataactttaaagagagggatccttgctctcaactttggacgaaattctttggtttggggctgggggcaggtgaagaatttgcacttgtggttctccagaatgtaatctcaggtattgaactgtgccatttgcttcctgggcatttcatcctttcatcaatgattggtaatcataacttacaggaatttttaaaacaatattttaattggaaaacgcatctgtcagctgtcaggcttccagtttccacttttgagaagcaggatgttgaatgtgagtaatgacacaacaggcctataaaatgcggactaaccctcggatgactcatccggtacaatgcagtatatttgtcaaggagactgaatcatatatgggggaaaccacttctcaggcagccagctggttctcaggtcagcaagagacgatccatttttatcggaagctttatagtagcaataatgctaatacccagcactcgggctccacaatgtagaggaaatggcatcgcctggcaggtacgtgcttactgtttacatgaactttattttttcattgttctcttattcttaacctttctggtgcctgcttttagcatttttttaaaggagaaaatttatcctagttgtagaggaccacagtgtgtatgtgtttgtatttgtgtgtgcccacgtgcaaggacagataggtaacctctggtctgttgatagacacagagctcttagcctctcatgcctctttctgaaaacaaatttctccttagatattctgatagaaatgttttgttgttgttgttgttgttttttattattaagtcctgaatctaaaagatgctgcctaggaaacagcttgcagagatggtatacctcttgggtgggtagtgtagagctttaaaacaaatgaataagcagaggtgagctgaaggaggtggtctaacaattactattgtgttacgttggatttctttcagtactgtgcttttttcctacccccatgatgcgtgacttaatgcaagaaagctttattcccctacggagtgaatagggtgggttttgtttgtttgtttgtttgtttgtttttataaatcacaatttgctcatactgaattcatgcattaactttttctaggtgggagaaagggtagtggggatttggtagcaacatttaattatagcgttcacatgatctgaaggatcattctgcataattgggaggctgtgtctgcctgtctgaccctctctc

SEQ ID NO: 94680 - DNA, 1071 bp, Homo sapiens
atttgttaccattttactatctttgccttattctcattgtttgtgcatgtgtgcacacattattattgctattatttttgtatttttcattactgaaatctgaattataaaattcttcaatgaactgtgaacttatttctccaaaatactatagaaactcaaattagactacaagtttattaatttcccccatttctacctgctgcattaaggtaaattatgcttttcaagtgtgtgaaaagttataaaatttcaaggaaacattttgataaggctgcagcctgcagtcctcgtgaggaggaaagaattgtcaaagccaaggaagtcttcagttgaggcccatgcacaatcctaatcagtctggattagtgaggttgtaatttgatgttggatgggactgtcccaaccatttggagccagtttgaagtcctattagacagggtcctttaagaattagagtcagctgtttgctgaggtgtgaacctcagcctgaaacatgcttccatttttaagtttcaggactaagggggccatgcaggagctctgggctttagtgacccctctattttgtttcctgtggtgacttgtcatgttttcacagcgcatcaatatggatagtttttaaagtgacagccagtttcaacagtggttttatttcacatacattggagcttccatatctggattttttttttgtcagccactaaatcaaagctcttcctcctccagatggtttaagacacccaatttgaacattaagtgagtcaagcaaaccctgtgccacattaccaaagggcctgctggtttaagagactatggatgtgacttacataacctctcatggagcatttccaaaaccttgtaaggaagctgggtatagtcacctctccttcataacgttaacactgagccatgaagccagggcttgtgtcctcagagaatgcataaggaaacaatcaccagatcgccctgggaggagaaggcactaggcgtttgttcaggaggttgatgcaacactcacaacagccgcaggatacatgtatcatacctcccagctggaaggcagaaaca

SEQ ID NO: 94681 - DNA, 1013 bp, Homo sapiens
acagctggctgaggcttcttttttcaagagaacataactgaaggcagttagaatggtttcttttgtgcaaatttcccctcccagagaccagtcccaggagttccttcaactgcattatccattaatgctgtggattcatttcccccaaataaacaagttttcctgccaaaaaaaatattcagtatgattggatgcggggatatgtcttgggacctgattttgaggcacgttcttcatttttctgggttggccctcattttccttactgagctcttacgggcagcgacagggtggctgtagccctcatttctgaaggccctcactgccttgttaatcctgtgtgtggctattcagcccccttgaaagcatccttcatttctgtttgcttagtttcctgcatgcctcttccagatcatctttcacctcttgcttcaacctctggggacatgtgtggtttctacataatgcacaaatgtgacttcgggggaggggaggatggctgtggactcatacacttcagctggaatcactggactctgaaataggggaggtcctttctgaatgggctggtcaggaaagaggggagatggaaagaccaacaggcaacctcaggcactgtagatttcccctcctaccgcaagacagaaagctgtgtatgtgttttgcattataaggaaagtgtgaactacagatcctgtggaccaaatcactataaataacactcttgtatctgattctaaattgggacattgaggagaataagggaccaacaaccaacatttctgtaggaaaaagatctggttctttattcacccaaatgttgatcactgggggtcaacgaattttctctatgaaagttagatggtaaatattttcagctttggggaccgtatggtttctgtcacagctgctcagtcctgcctttgtagctctcaagcagccatagacagcatataaacactcgaatgtgtggctggccataatttgcccacctctgagagagtctaaattca

SEQ ID NO: 94682 - DNA, 1016 bp, Homo sapiens
ctcttttagaccagttccccctcccttctccctttggagtggttactcaagcgcagacatatattgggaaaacacaaggtggatgtgaaaccaaggaaactcctgctttgagaagtacagaagtgcagacccacaaccaacctcctaatgtcaagctggcattttaggaaaaaggtgtgtgtggtggggggaattccactggtgtctgaaagcccccaagtaattccctgttgcaaggaggagtctcatgttgacttcagaggtccaggcagaacctgttgaattgcacagttcccatttgctagaggatattacacggtgagatctctctgctcagggaccggggctgagggcttctgtcatcagccagtggagcggccctgcaccgaggcacctccctgcttttgccacattttgcccaccctgctgtctgtcatgtactgaacctttgctggaataattgccataggtgtcaacatgtattaagggcttgctgtatgaaggtactatgcaaagtgccttttgctatgtgcagctaactagcataacaaaccccaagatgccccagaggagatactcttgtttccctgttttgcagatagagaaactgcaggttagagagatgaaataagttgaccaagctagaaattggtgggcagggaacacaacttgggccatgctgctttagagctgccgagtgtttaactgttaaggtgtcattctgcactgcctagaccagcccatgtatgttaccgttccattctgcatgagcatttgtctattatcaagacatctgctggtgcaggctgggacacaacaccaagggagggttaaattctgggttgccaaaccagctgagctacgagttgaggagcactgagcgcctctgagctttgctgggctaacttggtgaggtttggaaatgagcaaaggggtaagaaagagccatgtgtctggagtcaggctgcctatttggtttgacctctcaatggcttcataggttgggctactccttc

SEQ ID NO: 94683 - DNA, 1089 bp, Homo sapiens
taataaataacaaattattttcattttgtaccaggccctgcaaatcatgcagctggtcctgcctatggagatgggactgtaaaagtagatttggctggattgtgaagagctttgcccgtcaagcttgggaacatctgactttattccataagcagtagggagccatggaaagtatgctgacagggttgggagaaaggggcactggaggctgtgagaccagggaggccagcagtccaccgagggaggctgataacaccacgctgggatagacaccgagagctgcagttcccacacctggtggagataggccggctctgggcactgggaaggaggccgagagcggccgttgcaggtggctgaggcttctagctgagcagatcctgcacatcaagaatgcaggagaaagaagtccctcagccagtggcagcgaggcagatgttttgcaggagtggggcaaggctctttccagaaagacccggaaatctctggtgggacagcttgtagaaacatgcactgcagctgctcagctacagcaaatgacctgcagatcaaggtttttgtcagtatcgagagcttcactagaacaaatattcatccaaaaataaacttcccgttcttcctgtttttataacttgcctatttcctctgagtttgaggctgggctccagttccatgggttattaatcttcagaggatcaagacctctatagaagtatttcctgtacatgtttatctacccagccctaaattatattctccaaatgataagagaacttttccatactcgtgtgtcagacttctccttagggagatttcgattaggcaccacagcaagtagggccaaaccagaaagccttatctcagaacatagggaacccacgtaacggtggggagcggcctttggtgggttttgatgggcactcagcctccctcctccatgtgaaaggtagcttctttctggccagagttctaaggacataaagtaatagctgaagagggccctatctgaggatattttaaattccctgttgaataccacaggggatattagctaaagaaattctgctcctttgaagagctcaaaatacc

SEQ ID NO: 94684 - DNA, 1077 bp, Homo sapiens
atggcgcgatctcggctccctgcaacctccatctcccgggttcaagcgattctcctgcctcagcctcccgagtagctaggattataggcacccgctaccacgcccagctaatttttgtatctttagtagagatgaggtttcaccctgttggccaggctggtctcaaactcctgacctcaggcgatcctcccgcccccgcttcccaaagtgctgggattacaggcgtgagccaccgcacccgaccagtcctgtgctttctgatacaatatcatcccccttctttgcctcaccatctcccatgggcatgatcagttaacaattgctggaaaaatcaactttacctgaacatttaggaagctatttgggatgtccagtgtttttcttcctcttgaaaaacactaacgcaggtctgcatttattaggggagtggggatcatcatctgtctcttctgccgctttgctctaaaggaactcaagagcccataagcattttccctgaaaaggtcatcatttccaaagaaatgagagctcatttaaagtttctaggtatgaaaatcctaggttcttgcccttctccttccacttcttggtggcagtgggtagggaatcaaacatcagatgaccttcttcctctctggtttctccccaccgctgtatcagaccaggaaggtgaaagagggtcatgctgactctcctaactcccatccctctgccacgcctcccctccactgcagcactggcatggttacctgtgaagcaactgccaaagacaacatgggcagcctttgtgtctgggtagcccagttcacaatggcggttaatggaagttcctgttcagacgccctccaactccccagagggcgtgggcatctcctcttatgtaaaggggaaatcttaggaaatttttaatttttcctttaatcagtcagcaaggtcataagaggctttgtaagtattcattagaagtggaaagcaggccgggcgtggtggctcacacctgcaatgacagcattttgggaggccaaggcaggcggatcacctgaggtcaggagtttgagaccagcctggcaaacatgg

SEQ ID NO: 94685 - DNA, 2808 bp, Homo sapiens
ctgtcacccaggctggagtgcagtggcatgaacctggctcactgcagcctctgcctcccaggctcaagcgattctcccacctcacctgcccaagtagctgggactacaggcatgcacccccacacccagctaattttattttgcattttttgtagagacggggttttacatgttgcctaggctggtctcaaactcctgagctcaagtgatccactaccttggcctcccaaagtgctgggattacaggcatgagccactgtgcttggcccagggagtagattttctgatgataaaattaacgtgacttgttctagaaaatacagggaaagagtaaatgtgcaaagacttaaatagcatttacatgtagcccacagtgctctaaatgcttttggtggttcacagtttaatcatcataaccctatgaactagatactgttgttgcatccccatttacagaggcatagagacatggagtaattcacccatagccacacagcccttgacagaatctggatttgaactcaggcagttcggatccagagtctgggccattgaccacctcctgcatctctgtagatccccgactccagcctctcctcttgctgcctctctcaacagtaacgatgctgttactccccacgccaaacctctgggctggccaggctcactccagtcccacagtcattgccaggactgcctttgaccttacacagaggaaacatcttccacctgtcgggagggagccggggcggggatttccatggcagagttactgttctctggtgatagagttctttcagttttgctacatggtcttgtggcaaaggactgggtgcaggtgcagccttggttatttctggaaacacttctccttttcttttattttgccaggtctggctcatcagtcaccttcctctcagaaaggtgattttggctcctctgcccagaccatcaaacatttctggaggtgtcacaagcttccgtgagggttctggtctctgcgaattgcaggaagaatccaaacataggaaaggggtgatgtgtatcagggtgtccatcctcagctttgctccacaaagaccctcacacttgcacattgttttgttaacagtattatctctgagtagtgggtttattgtttttgcttacctgttttaaacacttcttcaacaaacttgctttactttccattttttaaaagtgtatttcaattttttattaataatgccattttactcctgcaaaatttctcactccttcaaagtctgtgtatggcaaagatcttcctaaccatcattcaagttagagcaactccatttctgtatcaaaaagaaatacctttagttattgtctgaacttgtcagaatttctgagaacgatgccagaaattctataattgttttgtcacattaattgaacaatgagagggcaccagcattcctcactcatgaggtagaagcaccacatctacatttctttttagctatgggtgatgtttttgcttttaaatcttagaaatctgttaataaacaaataacacaacaaagtttggggtacttccttgtggggactgggatgcttaagctaaaacaaagtttaaatttggactgtgtgtgttatgtttcgcagaatctatatgtttctcaaaagtgggtgtcaccctccttcctcccccaacacacccttcaggggtaagaggagaagtaatgtagaaaaattaactgtttctccactgtaaaagtagggtgtctttagaatgtttcatgttcaaaggaaagattgtgcttctcccaaggcaaggtgttcccttaaaaaaaaaaaaaaaaaaggttgagcatgtctttgtattgctgtctctggaagaggaaatgaggcatctcttggggtgagaacaagggagaattgaactctcgggcctggccagatggattcctcacactggcacagagctgtgaagggaagggcctttcatcctccagaggaaagagggctggggtctcagaggccagagcatagggacaggcaggagtcctgcagccctgatgcctgcccctcccagtacagaatctctgtcctgacccccacctgttgaacctttcaaatcccagtgactcgccagctttctctgtggatattggctgaattggtggcttgtgtggctgcctgggagagcaatttacccctgagccaaggagggggtgggctacagtgagatggagaaagaccattttaattaaagaatagggcctttataatatgaaaccacatgctcagggtttgggttttgctttgggtacctaggaaacatccgtgaacacaacagtagtgtttttagttggggtgtgtgtgtgtgtggtgtgcctgttttggggaaaaattgcttttcaccacccccctcctgcttttggtcctttgtctgccctggaagaatcactggaggggactgagggacttcctgcctaattgataacagcccctaagagcacatggtaaaccctgcagtaggagaccaggacatctcccagccaccctcactgtactcactatactcttatgggctcaagaagtcactgaaaatggagccgtaagcccatgggccttggctaatttttcaaggcccaggatcaagtaggagcaggtactttagctgggagccaggcactgggcaggcagggcggccctgcccacatgccgcctagggctggcatgacctcaccgtcatttgttgggcactgataatgtctttggcccggcccctaataggagacacgcgatctctaccttgagggctcatattcagagtttcat

SEQ ID NO: 94686 - DNA, 2224 bp, Homo sapiens
gatcatttgaggtcaggagttcgagaccagcctggccaacatgatgaaaccctgtctctactaaaaacacaaaaattagccgggcggtagtggcacgtgcctgtgtagtcacagctactcgggaggctgaggcaggagaatcacttgaacccgggaggtgaaggttgcagtgagccgagattgtgccactgcactccagcctgggagacagagccagactccatctcaaaaaaaagaaaaaaaaaaaaaagccttatgattaatcactaaacaggtattgcataaaatagcaattttcagctctggattttggggaagggagtagaggctggaaatgtaggtggagagtcaggctggggagagatgccacattcgcaacattgggttttttacaatagtactgcatctatctctgtgcaggagtctaaaagtggttggaagctacatttaggattatttaaaataacatactgccttatttttatctctgtagcaacaactttttgtaagaaaaatagctagttccatgatcttttgccttttgaaaaggagagatctattttaaactctttgcaggctcctcgaagttccttttcttgctgttgagtagcaggtagaatctctagttcatggaggtctgacggatccatggtcccgtgctggtccatgtgctgccctctgcttccgtccctcatccttgccactctcaacagtcttccccgacaacccttaggaagacaagggcttggaggagggggaggactgagtgtccctggcatgttctgattaatcctattcattgtcaagtacagctttttaatgaactgattcattactgagagtaggtctcatgcaaatccctagtttgtatcctgtggatttaatttctaacaatttcctcatttcaacacaactccattgtaccatgggctttgtgattttgttctaatatagagcttgacctcacattttaagactataagatgaatactaaaaaaacgaaatccttaaaataaaaaataaactagaagaacatgtaggtggatattcaactcctctctaaaggaagaagggttgtccacacataaaagttttggaagagactgggtttagtggctcacgcctgtaatcttagcactttgggaggctgaggtaggaggatcacttgagcccaagagttcgagaccagcctgggcaacataatgataccctgtctctacaaaaattaaaattagccaggcatggtaatgcacacctgttgtcacctgtggttgggaggctgagtgggaggatcgcttgagcccagaaggttgaggcttcagggagccatgattgcaccactgcactccagtgtaggtgacagagcaagaccctgtctccaaaaaaaaaaaaaaaaaaaaagaaattctggaagaaatgacagaggaaatcactgataaatttcgaaacataagtttgtgcaatatcagagacaaatttaacaaatatgtaaaatttgcctccattatgagttaatataaaactatgaagagttcaggagattataaaaagagacaaagacaaccaggagaaaacagataacttaatactttttaaaaaaacaccaggctaacaaaaaagaaatatatagttgactaaataaatatagcacaatatatttaaccctacaaatttcaactaatgcaatgaaaacataatagcagcttttcaactgttattattaccagaaagaaaaatattttaaaatgctattgtggttttggtgagggaacatttttcatgccctgttgtttgagagtagaattcagtgcaccctttctggaaagcagtttggtaacctgtaatacttcttttaaaaaaaaattcatcctcttgtctaaaaatttctcctctagaaacttaaagataatagtcaagtgaaaacacatttatgggcagtgtttaaagttttgtgagtgaaactgttgataagaacctattacaatggttaagccacctggaacattctattgatatattatgcagccttggaaaatagtacttttaaggaatgttaataagatgggcaatacaaaactgaatgaaaatccaatacagaattctgcctacataacatgatccaaattttgcctaaagtttgcctaaaacgtgcatagcaaaagaatttcgggaactacaccagaatgttagcatgggtccatcatttctgagctgtggtgttact

SEQ ID NO: 94687 - DNA, 1415 bp, Homo sapiens
tggaccaagaaattatcttggtttaggtagttgtgaaaagcttgacagaagagaaaggaattgagctttgctttgagtgattagtagggtttaggtaaaaaggaaaaagagagacatgtcataagccacaacccattctggttgccagtgagaaaagttaaccctgctcatttgttcaggatgggggcggtgagggctgggtttattacttggcgctgtctgtggctaacttgtgacaggcctgagtcattttcagggtactcaggagtaaatactgtgataggggtctcagaggccaggccatgcagatgcataagcctggtgccaagatgtagtgtgtatctgtttctttatcaaaatttttctactttggtatttcattcaaaacaaggagagaaaagtcaaatctttttccttttcccttttctgatggctatgactgaatttttttttttcatgaacgattcttgtgttcttatttaaaagaagaatttggcatatggcagacctcctcaagctatctttagttggttgtggggtgtaagtgattaagaatgcagctgtacttgctaccagcacatgcttttaaggagattgctaagcagacaggcctggttagaagtttagaatagcctcttggaaacaaagatctaatttttcaagtgcatggtatacaagagtccctcccttcaggactgaagcactgagggctgtttgcatcagagcagggtgacttatttgtttaaaatggcaacacccttggctctggggaggcggccatgcttcacttggaggagacaggggaagctggcttcacttcactttgtatagtttggcttcactgctcctttggaataaaaaaattctttacttctctagtatgtcccaggacaaacccatctctgtcctgttgctcagttatactacagtgctggttccgtagtcttcaaagcttggaactccctcttgcctttgctccaaaaatttgttctttcactcagcaaatatttaccaagtttctgctatatgcaggaccgtgtggagaactcaaagatgaatcagacgtggggcctgtccacaaatgttgtcagtcaagtgtaggacatagggcaagcacacgggagcttttgctgttgtgtccaagaatagcatgatgcgccgtaggtatttggtgggggaaggaaattagtgggtgggtttcaagtaaacccacatggagaaggtgacatttgagttgagccttgaaggacaggtttatctgtgcagagagggaagttttaggcagagatatagcacaaaagttagaaaacaaaaccaaaacaggtggaagagaggaagagtaatcaacctttaactgcgttgccatgcccttgactgaggcctcacccacattatcccatctaatcctcctcata

SEQ ID NO: 94688 - DNA, 1851 bp, Homo sapiens
taagaagatggaaccagcaggcaaggagagaagctcaagagactggttttatgaggagctgaaatcagactgatgggtaaaaggaagatagcctgggttggtggcctattagggaatgcctctctacacagggaccatgtcataatcgttttgataacattctttcttcttgcccctttagacctctggctcccttgcccagcttttgatattttgttgttgtttgttctgagaagtaaaaatatagctagagctttgcactcggtcatgttagtattttaagacactcccaagagtggaagagagaactgtcctccagttggagttatggggaggttccctgtgctccacctttcccacccttttctgtctacctgtgtgcacggaggcatgagtggataccgcgtctccacgggtgaaaggacaagtgatccagctgaggagagttgatcttttggtttaaccaaaccagacacccaaacctagatttccaaggcatgtgaacagggatgtgcatgacagtcattgacatgaagactcagaatgagataagctttaagttggcagcacttcccaccccctgcagagaggaagtttgcatgccatgcacctaccttcttgattgcagctctcatggctacacagcaatagattagaaccccctcgtgctgaatcttgacttgatgaagacaatcaaaatgccccccaaaatgccccccaatacacaacacacgcacacacacacacctgcagccacctcagtttcctgttaagttattgtggtttgggagtcttcattgtcagttcacattagctgtgaagtcagaatccttctgtcatgggacttttagcaaaaaaaaaaaaaggagccagcgccccatttgagaaagagactatggctcacacctgtaattccagcactttgggaggccaaggcgggcagatcatggggtcaggagatcgagaccatcctggctaacatggtgaaaccccatctctactaaaaatacaaaaaattagccgggcatggtggtgggtgcctgtagtcccagctactcaggagctgaggcaggagaatggcgtgaacccaggaggtggagcttgcagtgagccgagatggcaccactgcactccagcctgggcgacagagcgagactccgtctcaaaaaaaaaaaaaaagagagactaaactttccactgtccagtaacttggaccagagccctgcctgagcctccaaggcaggcagcttgatggagggccctgcctcactctcaaggctgagctctcaggaaaggtggattttatctctaaggaagtgcggctgcctttatcaggccattctggtggaacaggttagcttcctgcaagggtggaaaggaaaacgatgttactatttttagcctgcctcttgtgtacagcaaggtgggctgatgtgctaagcagaaggaaagtgaagtgtgagttgctttctgcccccaaccttccatttccacccctacttcccaaaacctcccccagaggtggaatgtcaggacatctcacatgtggtgcacgaagagtataatgaccaactttatttctacaactagtgaggctccttgtcactgcctttctaaaagcttgcagtcttacaaacaaacttgtgtgcacagacatgagtggataaaatattgggtcctgcctagcaaaaccaggatctttgatttggggggaagggttggtgttgctctctgttaacatttccatttattcttgacctctataaagagtaaattataagaatggggtgggaggattggaaagttggtggatggtaagtttgggtgtcaagtattaagaaatcctggctt

SEQ ID NO: 94689 - DNA, 1109 bp, Homo sapiens
actacggagtactcaatcctaaaggccacctctgtgccttactctagccacccagtgctttttaatagttcctgagtatgtgtttacacaatctgaattttatgaagtccataaagacatatttacccaacaagtcaccagcgttccaaaggtcagctttccttgatttgtatgaaagccacttaactcaaagtcaattaacactaagatagaagccaattaaagcaaggaagtgagctgttcaggccaacattccatccctcacttttgtcccctgttgtagcttaatttcacaagtcccttcaagccatttacttcacacaacctatgcatgtgtggcccgtttcagcatataggaataagtaccatttgtcatgtcatcatgtgggagtgctgtttaaaagcatgtaatttaagtaactattaaacgatgccatattagcacttttgcaaccaattcaatcgccctcccaccgcaagcagcagggatatcacagcaatgttaggaaagaaggaaagagaggctcggtgtccctcaatgttgctatcagagcctgctgttgaatctgagtcttgcctgggtccagaaagtacacaaagtaattcctcaaaagattgctggaggattaaatgagataatgtgggccaagtgctcagcacagcacctggtacgtggaaagcaaactttttttcttttaaaggtagctgctgcagcagatgatgattataatataaaaatggaaaaccctgaaagagaactaacccttagagttagcaattgcagtaggtcaagcgcatcctctgataggttttccacagtgaaggcacctcgaacaaacagtctgaggtccttctgtgcagaccatgacccctgtcccgatggcagttggttgccctgcactgagaaccactctccaaaggaaaagtctacaagtacaataggctccttcccgtctcacgatagaccctctgcattacatctttcaagctaactgattatctataaaagcctcatcctttaggttcttttttgattgggaaccaatttttttttttttttttgagacagagtctcgctctgtcacccaggatgaagtgcagtggcgcca

SEQ ID NO: 94690 - DNA, 1602 bp, Homo sapiens
gagacggaggttgcagtgagccaaggtcgtgccagtatgctccagcccgggcaacaaagtgagaccctgtcaaaaaaaaagaaaaaagaaagaaagaaaaaggaaagaaagaaagaaatatttatcactgcaccagccaggggagagttcacttccgacaaggtgagtcttgagtctttgaggactcagaaaaggatgatggtagtatttaggggaggagacaggtcagcaaggtggagaggagacatctcatgtccaaaggtttcttccacagatagggacactccatgtctgagtttatgctgggggagctcagagaaagccagtcaagtcaggtgaggctaaatttgggaggatattgagtaccagccaggctgacaaagcacgtatttggacttttgttctttgagtagaacagagctggttgaggctttgaaacaaagagacgatgaagtgatatgttggtagaatcaaacagattagttagagagtgcaggctaggctggagtcagggagaccactaataattctgtctgacagatctcagctggatttttctctctgactttagttaaatgcagtgagcctggatatagaaacatatattgtgaagagatagttgttggggaagatggtcaagggggctgtgaaattcagaacaaaattagccaacttattttgtaaatcagacatacagcctagaattaacccaagtgaagttttgtttttgtttggtttcagtattgttacttctcacagcactcgtcagtgaagtggtgaatgctttgccctttctcgctgaagtaaaatggtttccatctgaccataaccttttagaactagagaggatcttaggaaaatacgagctcagctccctcttttttacacataatttgcaatctggagaggctgagtgactaactcagggtcacaaagctagttagtttgggctagatcagtgagatatcatctggttccaggcctgttttgggtactgtgttaaacattcatgacaactgctttgagttactgaaccctcaggagataggaaaaagatggtggaaattaattgagataaaggtggcccaggtagatgttgaaccaccagcattgaacagatggctagccttggtcacaccctgcatgaggtggaggtagatgagcttcccagatgctcttcttgtgtagctctcctgaacatggtaggtaggggtcttaagctttggtttccgcatgtctgtgttccaggtacaggagcactgggagtggaggcagggaagggccttcagctcactatcctgggagagagaaggtgggtccttagatgatcagctgaaatacatgtgaagttccaaggtttttgcacctgggcaccagaaaaatgtttatgaaacattacctatgcttgttcttcccccgctgctccagtgccttctgttctccccatgtgtttgcttttgatgttaactgccaaggtggtgtggtcatagacagcaggaagtaatatctgatatgcaggtctcctggggtggggggaggtgggtgccaggatgggaagggtggcggttttggcacattgttgtgagaactctgtgcacttag

SEQ ID NO: 94691 - DNA, 1802 bp, Homo sapiens
agcaaatgaaattagaactcatttagaatcctgtaaacacctcagaactatgtagtgacatttcttccttgcattcctgttcagctctgtggaatagggagccagtgccaatccaggtggccttttctgtactgagatataaacagcaactctacaaatacttgttttggaaagagtaagccaacttacccctgatggaaagcttgtgagagcaatgtggctaacacagcattgtgttcacctggacctgtattgtagccttgctgttttgtggggaggatcctgtagccgtgcttctcaaacctgagcttacatagggattccctggggaaatctggtaaaatgaggattctgatcctgagattctgcattcttaacaaactccccaggaattatgccactgagggttcatgggcttatccatggctgtgatggttttatcttcattgtccagaccctaataaaaagatgacttcacatctttggcattttgaatgtttgctgaagaggctcatttgataagaaggtggtgatcatacactgagaggtatcatcaggtgcctgtccctccccattcttagcaggacttccagctttgaggtacagcttgattttaaatggaaatgtactagaagaattttttctttttttatggctgaaagaaagttctcggtgaatgctaggaggcccatgagatccatcacttaaaaagaaatgtgaagtcccaaactgtatgtgtaatgtctgactgtcagacaaatcagtcatgtatgcacggaaaggctgccgccctgggaagcttgggcgctcagccctagaagaaatcacaggaagtaattaaacagagaaggtcagagaaagaggaagtggttgtgttgtttctgatgcaaagagcattgttgttactgggaatcaagatgatgatgtttaaatctcttggaatgtgactgcttggggatttgattgtattgtggtccttttagtttattcttttagacagcaatgtagttaggaaatgaattgcttttaggtcttatcaggaatccccacgtgcctaagcagaagtcttaagcgggagttggttgtagcttggcaaattgcacttaaatgaaatgaatgtcaagactattagaggttaattttaggtgtctggagttctccctaattctcctgattaaacactttaacataatagtttccttaattggaataatgatggaatattagcatgcatattaaaccatttacccaaatttgaatagggttaaaatgcaaattatccatcacttgtcagtgcttactctttacagataattctggtgagaaatcgggaagagactggaatatgaattggaatagggctttctacttgaggcagctttgctgggaaagtcaagaataaactagaggactgaaacaagtgagaggcccctttgtttccccccaaaaggggtactaaaaatacgaaggcctgtgctgtcaataactccaacacggaggtgggtacaatgggaaatctgaaataaactatagaccctccagttgtatcttcattaggttgtcatatttttccttttttttttttttttttttttttgagacagagtcttgctctgttgcccaggctggaatgcagtggtgcagtcttggctcactgcaactgccgcctcctgggttcaagcgatcctcccacctctgcctcccaagtagctgggtctacaggcaagcgccaccacgcccagctaatttttgtatttttagtagaggaggggtttcaccatgttgtcctggctggtctcgaa

SEQ ID NO: 94692 - DNA, 2597 bp, Homo sapiens
ttttattactttttttttagagatggggtcttgctctgttgcccaggctggagtgcaggggtgcaatcatggcttactggagccttgaactcctgggctcaagcagtgctcccatctcagcctcccaagtagctgcgaccacaggtgtacaccaccatgccctttgagaataatttattaaccctcatacccatggcctggcagaacactgagcacatagtaggctttctgtaaacagttatcaattggttgaagtaactattcattaattgaaaaaataattgtaccgtgtataaaaatttaacaatttttcacaatttaacaattatcttttttggatacctatatccaaaaaagactttgagttgctttttcaaaactactaaaggagaggctgccatgatggtagtggaagaatcatggactttggagtgagaccgtacctcttcccctgccactaagggaccctgctaagtatcccaagccaccagccctggattaatgtaaatgaggttcattctgctgtatacctaataggctgttaaaaagtagaaatggaccaggcatggtggttcatgcctgtaatcccatcactttgggagtccgaggtgggccgaccacctgaggtcaggagttcgagaccagcccaaccaagatggagaaaccccatctctactaaatatacaaaattagttgagcatgctagcacatgcctgtaatcccagctactcgggaggctggggcaggagaatcgcttgaacctgggaggcggaggttatgccaagcagagatcgtgctaagcagagattgcaccattgcactccagcctggtcaacaagagcagaactccatctcaaagaaaaaaaaaaaaaagcataaatgaggtagccttggtaaaacattttagcacagcacctgagaaattgagattcagtagcatccatctaccccaggtctgtcccccatcatgtaataaggtgttctttcttttcagaatttacaaggcagaggagatccatgaactttacaaggcaggaaacaagattttcactttgtaccttagagagctgaaatgacttgctcaaggctcctcagggagcttgtgggaggataattaggatttagaagtcatgttctaagactgactgtttcttttggctttctaatggtgtcctggtagtttttgtactgtgataatcaataatgcccagctgaccattggcccctttactcagtgatcccagttggctgtgctttttgagattctgagttttatagcttgtctgttctcttagggtaagagtacctacctgtaatagcatccttggctcccctgccatccctacgccattcctgatatgtggtctagataccttattaccagcagcattcaaattctctctaaaacaaaagtcagtaggcttggtgtggatgggtgggactgaccatcctcttaggagtcacttggcttatgacatgttttgtctacttgaatgccatgtttggcatttcattttatttttccagccaaggaataaagtggacgatggagtgggaatacagacatagtgctagactagaggtttaatttatcaacatcccagtaattttactcatttttatagatcttttaaagcagcgtaagtgtgactatagtcttaatatagttattacatttctcccttttgcttaaaggttaagtcaagtttgatttttttctcaggctcagactcgcaaagcaaatctgccttgctagaatgatgtgcctgggctcaacagctcacctctggccctgaaggcctaataattggttgccttctcattgatctgtgtgtgagcacacttcagaacagtactctgctgtttgttaaaataaaaaacaacaacaaaaaacctttgaagaccttaccgtccattctaagatgtcttttgtactaaggaaaattggggatactagattataggtgttgatttggagtgtgatatactgtgaatcggaataacttgaatttagaatgtacttaggccccagttgcaaaattatgtgtaaattattgtattggataaaataaatgagtggaagtacagccagaggagagggagccactagccattgaatgcctaccatgtgccattcacttactgcaaatatagagcacctagcctgccatacaataccagagctgtggctcaggaagtccctgctctcggggcacttacattctaggatgctagacagtttcatctgctttaaggtgtgaggacagccctcttgatgactgactaactgattactaactagagttgttttcctttttcttcccctccttcctgctgggttcctcctagagctgcaaactagaaatgtgatgtgttggggttctcatatttggggtaggggaactcttcatgcacagcattgaaggacctacaggcccttgccagaatcttcaaacaagcaagcttttcaagtcgtttttaggtatgagagaaagaatgagtgagggtaagagagagagagagagagagagagagagagagtgtgtgtgtgtgtgtgtgtgtgtgtgttgtacatacaagcacgtacacattcacac

SEQ ID NO: 94693 - DNA, 1340 bp, Homo sapiens
aattctcttctttcttccttcacttctccagtaggtgacattctgctcatgcccccagccatctctgagccattgcgtttgggtggtcctttttgactttcccaccataaccccctcctcccagtcaaaatcaagtcaaagtcaaaatgcaagtcaaaatcaatgtctgtgtgtattatttttttccctacattacatggcaattattatttcaagttgggcttatacccagctagattctgcatccgaatttgagttttttggattcaaggttacttctcaaatgcctagttttctagttgttggcccaacaccattgggcacattgtggttgcttaatgtctattgaataaaataatggatttaattattttaaagtgctgtttcatccctactgactaatgcaataattacaattgttgtatttggttaacttagggtatatatatatataagcctcctgagaaactcaaccatgttcacattgagcctctggtattttgtggaaattccatgcagaactatctggtggtagtgatctgtcattggtaactcaaaacccatttttattccattcattgttgcgagaactgacaagtaaaaaatcttgaccacaataagacagggcctgtttctatgcctctgtaggagaatctctgcagaaatcacagtattaacaattttcaatagctgcagggttctgctggagtcttaacacttgagggtggatacagctgtgctgatgaactccaatattggcatcattcttgtattgccggctgaacacaaatacagtctaacagcaaaattttcagaaattgaacaagtgataatagaggcagaccagaaagttttggtgtatgtgattatttgtttgggcttgtttttactaaggtaaattaggccgagttttttaaaaagaccccgtcatctcaataaacttgataacttattcttagaaatatttaaaaattactatttaaatctagaacattgtgatggtgcttttaaggcattttctagggctcttagtgactttgaagtagaagaaatattttgtattgatgctccagtgccccgtggaacaaaatatattttttatatgctttccctggatagacatgaaggattgttacatcttgacatatgtcccatgtcatggaaagaaagtcaggccaggatcatgggagtttgctaaattaagtaacaattgtttcataactacccatttccctttctcatgtaacctttatcaacattatgttcacatgtggcatattgcacacgtattatcaaattgtgcttatgttcttcctgctactctcaaagggtagttgaat

SEQ ID NO: 94694 - DNA, 1218 bp, Homo sapiens
cagtttactttcatatgtcatgtcagttttatatggagtggacaaaatgggaatagacactacctattttgtggagctgctgtgagaattaaatgagacagcctacgtaaagcttatagtacagggctaggcataaaacaggtgccctatgtggctctttgcagggcactgagatagatttctttcaggctgagcttcattttcagataaccctgtgaagaaggtattacccccatttaactgatgagaaagccaaggtcaagttagttgcccgagacagcaaacatttttttaaagcactttattcatttagtcttcttaaaaatcctgcgaggtagttggtattattatccctattataatagggagaagtgaggcacagagaggtgaagtcctttcctcaaggtcatcctgtgagtaactgaaggagctgggaatggagcactccagtagcctggttcaggaaggtctctgtgctcttaactaaccactatgaaccattggggtggtccagcctcagtcgttctgactcagagctcgcagcctttctgccaatcatgcttgttcattattcttctgaactggtgacaatctgtcattgccatcatttttctcacttcacttatcttcccagaaaatgctgtgaagcatgaggggcatactgaattaaaatggatttaaataaatttgggcttgagaattctgtgatacacctcaaagataatgggagtagtgcaaattcagagttggttattattggaatgttagatctatgttaactgaaataacagttgtggaaattaaaccgatacagtgagtattgatccattttctttgtgtttgccttaaaaagggaggtatgtttctaccagggggtatggttctactatacatgagtagaacccttaaatgttaaaaatatggagttgactgtgcagaattagaatcttgatttattcctcagaaaatccccacactactggagacccaggcctggaggatgatagcttgaggccaggaaaaccagcctgggcaacacagtgagaccctgtctctaccaaaaaaataaaaaataaaaattagccgcgtgtggtagcgcacacctgtagtcccagctactcaggaggctgaggggagaggatggcttcaggccaggaggtcgaggctgcaatgagctgtgatcgtaccactgcactctagcctgggcgacagagtgac

SEQ ID NO: 94695 - DNA, 1072 bp, Homo sapiens
ataccacattttcattcataaaaaacacggcggagcgagaggaggacaggcgcgggctgcgcgggggtctggtgcgccagggtccccgcgcgggccggcgtgctggagccgcccgaggggccccgcggcgcgtgagtgcctgtgcacgcgcttgtggccggcacacgcgtcctgcggggtcgggcggctcggggcggaccgaggcgtgtgcggcgggggcgtgcggggcatcgcgctgggggcgcgcgtgtgtgtgtgtgtatgtgagtgtcctcgcgggtgcgcgtgcacgggcttgtgcctggcccgcgggcccgaggggaacaatgctcggggcgctccgccggagggatcctgggccgccccgcgcgggacccgtgactgtcgccagcccggggcggaggtgcagctgcctcctgcctcgcggtccaggggtccagtttggcattttccctccctggtctgaggcgttttcagtctcgggtgcgacgggggcggggccgcggggcccgacgcctcaagtcttatgcctggggtttgagcggtcaccgcgcggcggccgccgctgctgctcagtggctgtgcccgccaccagccacttttttttttttgtgaataagacgcgctcctttattgtcacatgatatccctcccctcctcccctgcacattcataaatccggagcctgcatccgttcctttcattcagtgctgccattagccaaggtagcggcggcgcgggcttgggcgcaaagagctggttggcagccgcggggacgcgccctggagggaggccccgcgcgcgtctttgcaggggagtgtgggcttcggaaggcgtgctccggaggccccaggtcttttgccccccgcaggcattgagcctcaagagtgctgggaggggaagtgactcagggctgggcgactgggaggcttgtctcttgcagcaggtgacagtgctgtgccctactctaggaaatctactcactttattaaatataccccctttatcctttggcgtctgctgttgccagtccgggcgggagtggggctggtgtttgggaaagggaatttca

SEQ ID NO: 94696 - DNA, 1029 bp, Homo sapiens
taacctgaggtccagaatcacctatggaagattttagggtggtcttgttggaataatatttgggtttatgtggatacttgcatatttttcccaaaggatagggttcaaaactttttatcagattctcaaacaggtatacagtgctctcaaaatttgagaaccactgctctaggagatgttcacagggctagacaaaacaacaagaacaacaacaacaacaacaacaacaacaaagaagttgttgggaaaaaaaaatcttttgctggaaagacctgaaagatcactgaatgtacactctaacttgttattgacagccagtgtcctccagacactatttctattgtcataaatggaggcaggcagctagaaactgcactccatcagtaagttcttcttgatcgatatataatatataaactaacttaatttttgctcatgttttttctagttctagggccccaagagacagccatttaaaatatttgaagcaagctatgattctcctcatatcttctctctttgacagctagaacactcccattttcttctatcgtttcttaagaacacttcaaaataagttgtttggggttttttctgattccatgtatggtattttcaatctctaaggcaatcttactggcatctggtagtaaaatagaaagaatgagctcccctgactcctccatgagtgagaatggtatcttaatcttctctgtcttctcctttcctagctcagcacaatgcatggctcatgttcagcaggcaccaagtgcttagggaatgaatctgaattgttcattagtcactatgccaccaacatcccaacaaacaaactgcaacttcaaaaactatcttggcttcctgaataaagttaccactggtgacttttttttcttctaccattcactctttttcaatctatgccttaaatttggacagaggtcaggacctcttatcactttccaggtattccttggataattccctcctccacagtggtttgatttcctatatgctaccagacgtgtg

SEQ ID NO: 94697 - DNA, 1040 bp, Homo sapiens
aacttctctgtccatggatttggggggagttcgttctgattagggctgtcttacatatttatactagaagagttcatgagctatttctgatacttagactttaatcatgcttaatgaactgaactaagcataattcttgttctgtttttgtaactttgtggatttcttctaatgctcagtttcatgtgactactcattcttaaatgctaatacacaaaaatgctaattcaagaaaggagcacaaaagttagatttcacttcagagaagtgcattcagtattcataggccttctggaggagcaaggctgtgagaagaatgatattaggtgaaaaatattggctcctacctttggtgaacacacaaatttaaacatataggttgcacaaaatttggataaactgaggtggaatccaacatttcttgcatgaattcctgtataatgtggcgatagctgtgagaaaagaggagcccagcatctaaggcccaacacaatgaaaatgcaatgaatcggaatgcctcacagatcatagcggaatcagaatttccagcaaggaaaatcttttcatggtgaattaagtggtggatgaagaaaaatggtgatgaaaaaaggtaggcacagatcacaaacactgggctcagggctcactgctgaagatttaagaaccttagctaaagctatgcagaatagaatgtggaaaattgaatttactaaacaattaagcattgaattaatctacatcctgcacagtagaaaagtgggggagggagcagagcagagctgaataaatcagtggagctcattaaaagatagtgaatatatcaggtctgttgtagcataaaggaggacagcttcctgtataacaaggaataattctttggttctaagtcacctttttggagtcctagtcttaatcagattaacaaacatgcttctgatgaggttggtctgtggctctgtattttagcttgttatcgctagcttttctattaattaccagtcagatcaccagtcaacaatagtagtgagggacaacataaa

SEQ ID NO: 94698 - DNA, 1025 bp, Homo sapiens
ttattttagcttggaagcagaaactggcaaattataaatgtgccaatgcagctctgagctggaaccatggttgaagggggatgggaaaggtggcatggttatgtgctccagccctccatggctttgtcattatgccatgggatcctaccaataagggttcacagatgcctcttatttgggtttctgatttgtgcccccacagccctcttggaacagagatcatgatgacacggcatctactcgttcaggaggaaccccaggcccttccagcggtggccacacgtcacacagtggggacaacagcagtgagcaaggtaggagagatgttattctcttttgctacttgtttcatttttaaggattgaaaaatcagaaatgtctagtgagttactaagtatacagtttttcctagaagataaaccccctttaacttgagaatcagctcatcttattttattctctgaccctgctcttctgtgctattccagctgcttaactgtctgtcacctggccagcttcataaaacagggtagtgaattgactcagggcaagattagagaagtagcttagaagtttgaatgtgaataaatagtatgccattcataccctgctatacaaataaaaagtattattactacttgccctcagaggcttttcaagagctcatgaagaaacatccactaggattccaagttaatgatgtcttaggatgcttataaggctgtgagccctttagtagcacatgctcggcttccctctccactgggttgaagtcatttttttctggttttacttatctgaatctcctaagtgcttgacttcattgcaaagccagactaaataaaatttaggaagacatggaaagataacaggttaatttgtgttgtcctgtgaatgcacatacctatgtgtatgtgagtgtccatggattatgcatgtttgactataactagtaggaaataaagtttaaacatcaagctagtcttcagcaaaagggcgaattgagtattcaaatgtctgtactg

SEQ ID NO: 94699 - DNA, 1031 bp, Homo sapiens
cgcagtctgactctagagcccaagctcctaactatgacatcctatttgatacactgttttactggagaaacagatcatttgacagacattctttctgttagcaatttgacaactctttccccagttgtctgtactgaacctggcgctgtgctccgtaatggtgacctagctgtgaataagatagaatcaccttaaactcagaggggtaatgttctgttggggagggagaacctagttttgcatgctaagtagaatgatgaatgaagtatttacaaagggagcatgatgactgatatgattcattggtattatgtattaagagcctatatcatttcactcattcaaagacttagtgaattaagaatagaagcatgggaacaagtaaagatattgctcttgcagaacattttccactgaaagctcatcatattttcctcttttgtgaggataaagaaaaagtattatttctacatggaaatttgatgtaatacatttcaaccctaaaggcttttaatgattgctggaatctctaaaacccacttatgaacttctcctttaggaggcaggactcagaataacaatagtaccacttaaaaaaaaaaaagcaaaaccagcatgccaggatgtttctttaaagaagattaatgctaagcactgcatttctctatcataatgtatcaatagttgcagtgcctcccactgccccatccccctccacaccagcttttgtgtgagtccaggcaacctataggcagaaggcaattccatttattattgaggggactctccaggcagttgttccagacctgtgaagccagcaggcagagcggcctgagagggggtggggagcaccgggcgagggaggtggggaagggccacattatgttccagatgactgagtaacgatttatatatcactcgccttttttacatgaagaagaaaagtaataacagcccaaacccaggcatttgaaacagtcagctgtccgatgaataatgggataggtgggaaggagcgctctgattggatg

SEQ ID NO: 94700 - DNA, 1050 bp, Homo sapiens
ccacatgggtgctaggaaaaagtgtggttacaaagtggctctgggtcatttggaataaatcagttggacaactctttttttgttgttttattcaggacactggaagtttgtctcattgctttaatgagagttgcatcttcttagttatgctgttgaacacatctggggcctgttactgcacccttactcttagataaattgtagcacccatgcccacacaggtagacctcctaccttcataaagggaagtcagaggaagctgataccccactcaggtggcctttaaatttgaggggcggactttgggaccatgttgcttggcaacaaataacatatagcaaaaacaaacacataaagatatgacccatgatattcaaactttaaattctataacactagtttgcttaagatatcagctgctatacggtaaagtttttaaggcagctgtaatttgcggaaatgctggcatttactttttccatagtcttatcttgaaggcataaattggaactaaatctgggttcaagccccttctcatttctctggtactcttccagtaatatagttaacatttggataaggacgcatattatgattctatctatagttatttaccctctcccagtttaacatgaagccttgctagcttcctaactataatatttccaccttattttttagttatgtgttggaccctgagttgtcttaaggactgaggaatttaagactcattaatatttttattagtgttatttccttataaatgaattatccctttcagctaactatatctttagaaaatgatcttggttttcttccatcatcatatcaataataataaaattagctaagaagttgtaattactcttcctatattctctgtgatgtgcttaaatagaatatccacttattatgatgttaatttccatttattacaaatgagcaggaacaaaatgttcctaactgtctgactccaccttttcctgcacattatgactcccctataagtaaaccacacagcccactatcgtatgttctctaatgtacttt

SEQ ID NO: 94701 - DNA, 1099 bp, Homo sapiens
ttttttaaactaaggaaaagaagcaagtctagaagacaggcaattagcatgatcactcaggccagtttttataattttggttttcatccaaactagtcacatttcatacttttaaagtttttaggcttttctgctggagatcatcttcctcacactgtgattcttaaaggttatgtattttttttaccctgatcatacttacgtcttttgacaagagagaagacggacatccagctttgggtctgcagtgatccatcattcaacttccggtctttttcatcatattagattgtgctagtacttgctctttccttaagctatctccattacaggagggggaacttattgccccaaatataacagagatgcctgacttatggagagttacttcagagatgtttctggaagaaagagttctttgggtataaatgagaaacaaggggacagttgtgtttcccacaccatattttggtatctagcatgtaaattatactctcatagaccacctggatctgaatggctgcgatctggggccctttcccagttttgcatggcagatgaggaaaatgcaggaaacgctgaggctttgaagatgtgctagaacctcagcaacacagagccactgagcagcaagaggaggctgagacagggcagaaacacccccactgttaagagtgatgagggtttggagcacctaatctggatctagaaattggccgctgtgcaggcagctgggtggttcaagatctagcacccaaagagtgtagcaagttcaggcctgggcatttcggcataaccagtctggtaggtggggccagcaagaaggaattctaggccacaggccaattcagaagtcaggcaggcctacgattggtattcggagatctgtttgggaagagatgatcatccctccagctggcagcacaggagagcagtattcagttctggggaaagaaagggctgggccaggggaggggaagagagattcccagccagctgatgttggagagaagactagatccagaagaggaccaagagcagagaaggaagtaattccttggtttctgtgacttctttctcacccaagatagatttcagg

SEQ ID NO: 94702 - DNA, 1232 bp, Homo sapiens
attgatctttgaatattgactttgtatccagcaactcttaaattaatttagtaattttttctactttcttttggatttttctatgcacatagcatctatgaaaaattaactgtatttcctcttcttgagaaattcgaagactctcaataatctgaatttgactaacgtgcaattttcgttgtaaattcaataaaaagttgctagtgtattcaatctttccaactcacaagctcccactctcagtttacgcggacctgactactacccgaacaacccccaccagtctggaggattttgagcctagacactcctccagagcaggctcctgtcccggctgcggaagtgcgcgcgccctcggcaccttaacagttccgcccctctcccggacccagccaatcagcggccgcctcttgcgcgcgccccaccgaccaaaatggcggctgccgttggtgcggggtgcggtttgtagtgctgttgccctactcatccctttgcaaaatgtgaaagaagaagcggctggtggaggcgggccataggcaatgagtcggcgaaggaaacatgatgacagccctagcccgaagaaaacgccgcacaaaacagtggcggcggaggaatgcggctcggtggtcgagccagggaggaggcggctgagatcggcccgcggttcgtggccctgcggggctagagaggggcctcccgggccagtgcggcagcgagagcagcctccgaccgccgccctgtgcagtaaaagtaaccccgagggtgagacgtcggcagcgcggcctgccttggcttcggcgccgcatccccacatcccagcttgcaacagggaaatctggggtgggggtggagtctggagcgtgtattctgtctctgggattcacccctcgagagtccaaaaataatcctataccactccccgatgggcttttgtccccgaacttcagcactaccccgttaggtttgaccatccatttgcctccgccacaggaataggtaatgtggtttacctgtttgcgggagggcggctgctttccaggctgctcctccagtcagcagcagtggtggagtgagaagaaacagctgataggcccgctaacctcagtttttgcccggagaagttatttctctttaaaccctttttttccctgtgacctgctttagagaagagttcataggaaaagttaaagtttgtctcaaagcctggtagatgtctcacctcattgtgaata

SEQ ID NO: 94703 - DNA, 1215 bp, Homo sapiens
ttagtttttattgtcttttttctttcttttgtttttttggaagacgggggatgctacactggtactttatacctctttttttccctatctgccaaaggatgaaaaaccaacaacaaattctatgctggacatgtggattggtgaaactgctattccttgtactcccagtgtagcaaaaggaaaatcaagagcaaaaatcagctgcacaaagtaagttaagacttttcagcttttctgaaattcagtgaagcaaatattttttgataatactccattttggttttgtgaatatatcaaaatttttgttaataaaatttccacagttttgatctatcaaattttggagttaaaataattataactgttaaaatcttagagctttaacatcaaaatatgttaaataacagttggatataatgtttcagaacatttttagttattttttaatcttgtttaataggttaaaaacacaaagtcaagaagaagaacttatgaaactggctaaacaatttgataaaaatatggaagagctagatgtgattcaagagcaaaacaagaggaattatgattttacccagatgatttcagaaacagagattttaagtaattataaagataatatacagatgtggtcattacataatatagttcccgaaatagataatgctacaaaaaagccaatcaaaggaaacaccaagatatctgtggcaaataatcaaaatagcagtcagaagccatttgaccaaattgctgaagcagcctttaatgctatttttgatggttctactcagaaatgtagcggacagttaagccaagaactgccagaggctttttggagcaccagtaatactacctttgtaaagacaaatgctttgaaagaggagaaaatcattactaatgaaactctggtcattgaaaaactgtcaaataaaaccccacgatcactttcttctcaagtagatacacccataatgacaaaatcatgtgtgacttcctgtactaaggagccagaaacttctaataagtacattgatgcatttactacaagtgattttgaggatgattgggaaaacttactaggtagtgaaccttttgctatgcaaaatatcgacatgcctgaactctttccttctaaaacagcccatgttactgatcaaaaggaaatttgtacctttaatagtaaaactgttaaaaatacgtcaagagcaaatacaa

SEQ ID NO: 94704 - DNA, 1508 bp, Homo sapiens
agtaaaaccagtgttagtaacccaaatcagactagtgcatcaaaagtaggttctttctttgatgattggaatgatccctcatttgccaatgaaattattaaagcatgtcatcaattagataatacctgggaagcagatgatgtagatgatgatttgttgtaccaagcatgtgatgatattgaaagactaactcagcaacaagacattagaaaggacagtaagacatcagaaagtatatgtgagatcaataataattccgaacatggagccaaactaactcagcaacaagacattagaaaggacagtaagacatcagaaagtatatgtgagatcaataataattccgaacatggagccaaaaacatgtttgctatatctaaacaaggaagtaatttggtacaatcaaagcatttgaatccaggcagcatttcagtgcagacatctttgacaaatagctcacaaatagataagccaatgaagatggagaaaggggaaatgtatggaaattctccaagatttttaggtgccacaaatttgactatgtattctaagatctcaaactgtcagataaataatctgcatgtgtcttatactaacactgatgttccaatacaagtgaatagttccaaattggttcttccaggaagttcaagtttgaatgtaacttcagatcatatgaatacagaaattactacttataagaagaaattgagtactaatcagccatgccataagactgtaacagatgaagctcagagcaaccttaacacaacagttggattttcaaagtttacatttacaaggatgaaaaattctcagattctttctcagtttaatcaaaattgtataactggaagtatgtctgataccaaaattacacagggtgtggagaaaaagaaaggtgtcaacccattactggaggaagctgttggacagcaatctttggtgaaactttctgaatctttgaaacaatcttcaaaaggtatgtatgaaatatgaaatagttttctttgaaaagcatcttaaaaagtagtaaaataattatttgttgtttttgagtgtgagtaatgtataaggtaaaactattctatgactagttaattttaagaattaactagaattcttaaaatgatacttggaaataattatacggcattatacagagtagttggtttatttttcaaaatattacattgaattctttcccagcacttaatacaatgactggcatatagtaggtactcagtaaatattttttgaataacttattctttcttggaaaatcatacctttagatatatgtattatagtgttcattaagattgtatttactaaattgttttaaaacttgagtaatctgggaagcagatgatgaagcagtgaggtaaataatatttagaaatttagagcattctaattaaacgtctttactagtgtgatatttgatataaacgtgctagcggtgatggttaaaattatgatttacttatttgataacagctatcatt

SEQ ID NO: 94705 - DNA, 1317 bp, Homo sapiens
cagagtatatatgaacagagtcaaggaaataacagacaagaaaaaggctggcaagctggacagaggtgcagcttcaagatttgtaaaaaatgccctctgggaaccaaaatcgaaaaatgcatcaaaagttgccaataaaggaaaaagtaaaagttaactttttggttttgatgtacacatattcaaaaagtacatcttcccccccccccccccccccgcaaaataattctgtggcagggcaaggtttaaatgtgtttcttattaatatgtaaattcacagtaaatatgtaaagctaaatactttcctctccaaagatcattatctttattgattagcactgaggattttaacattgtgatatattatatatttataatttaccatctcttgatgagactcttatttctttatataggtcagtcttgcaagtaccattttataagcagctgtgaaatttaagtgaaatgttctttgtaaacatttgtactattttaaatgaataatgaccttatgaagtatgctatctgtaggctgaaattataggtacatctgttttcactatatgatattaagaaagcgtgaaatgacttaaatgttcatttttttctgtatagatactttatcatgttttcatgattttaggaattactgctttgttgatattcaaagtgtgaaactaaaactttatggttgtactttaattcttggcatgttgcctctatgtcccatttaaaataaaatacattctcattaactttagatgggaaataaggttgtatgttgatggatgaattttggcatgatgactgtactctcaataaaggctgaaaatgttgtataactgacctgtgtatttttatcttttgagtaaatttgccttccaaattaggaagataggttttagaagtcatcacaaatagagaaattcttgagtttttgttcctgatgcatggtgtccacagttcttttcatctcattttttttcagattttttttatttcatgtttttgaggctgtatcaagtacatacaagtgttttggaacaacttcttaagttacctaatgccacttaagcagatgagaagtccaaaggagattacactgtgtttgtattgtggtttatttttctggaatattagttacagagagtactacatagtaaacctttttttaaatgtctaagcccatgaattttaattatatgcccttaatgctttcagtgtttgaatccatatcattatgtgtaggaatgccaagtatagtaaagtactttaatttttgaaaaaggagttgttaaaattttctgtgtgattaat

SEQ ID NO: 94706 - DNA, 1052 bp, Homo sapiens
catgatgtctgtttctagaaatgagttgttgcagaaggtattttaaaaatgtaatttcctaaaaatgaatttcataaaacagaatgctattttatgaaacatgtggaagaagaaacagattaatgacctatgccccttttcccctttatttcaattttattagtgtttgggtatttttaggggggaaacaaaacaaaagaaaactccagccttaggaaatacctcctaactatgtttttaacttagttttggaaaaaaaaaggagcactcacggtattctttttgacagactctatctttgaccttttaagtattacaatgatgttatcagggtttctggaaaccctataggacaaaaacagtaaattgactttgacagtctaaaacaaatctcattatgtttcttctgtctttcgtattgcctaagcctgcttcttatacataaatgcatcatgtacaatgtttatattgataaattacttttgacttacaaagcccagatcgtaactcccgaaattaaaataattcaaaagaatttttcttgggttatgcactttccttgtctaactaaagatgataccctaaggtgaaaatgtgtggacaaaagtcactcattaagaaaacttctttttacaaattattttcagatcatttggttattggattatatgaagtgaaaaaaacttctttgatacattgtacttggtaaaagtcaaatgttatcagatggtgttcaaagtttgtgtattttttttctgtctcactttctctctttccctctctctttcttttttaacagttggatccacttgaacaagcaaaagtggatttggtttctgcatacacattaaattcaatgttttggggtatgtgtgttactttggaattaattagaaagcaaattacttattgtgtgaaagatgatttatttttaaaatgctaacaatttatttacaattatactttataacacttttaatagatacttatttttaaatctagatgccagtgagccacacatagatttagtattacatggaaattgaataatt

SEQ ID NO: 94707 - DNA, 1523 bp, Homo sapiens
gtctctactaaaaatataaaaaaaaatttgctgggtgtcatggcgggcatctgtagtcctagctacttgggaggctgaggcaggagaatggcgtgaacccgggaggcggaggttgcagtgagccgagattgtgccactgcactccagcctgggcaactgagcaagactgtctcaaaaaaaaaaaaaaaaaaaaagactttggacttgaaaccttccagaggaacactcacacaatttaagataggttctggagtcctctgaccctcattgaacaaagctggatttggctgatgataaaagaccccagccacaagcctctgggccagcctccagcctctctcggggcttgtttgctgacttgctgctgcacgtgggtatcagaagcaccaagtaaactatctccagggccagttcttttctctcccttccatttctaagtcaatagttgtctataattaaacatatttcagatttgttctgtgtccctgaagttccatattttatctttatgcttgtgttatgttttagtgtctataatgttgtggtgggaatcatttcatttggtttaaaagagtttgccttggaaaaactgaattaaccttcataaatacattttgagagatttcagtgtgagtaattttctggacataatattattgtataaaatatcaaaatggtgggccaggcgtggtagctcacgcctgtaattccagcactttgggaggctgaggcgggtgaatcacgaggtcaggaattcgagaccagcctggccaacatggtcaaaacccgtctctactaaaaatacaaaaaattagctgggcttagtggcgggcgcctgtaatcacagctacttgggaggctgaggcaggagaatcacttgaacccaggaggtggagattgcagtgagctgagattgcgccactgcactccagccctggcgacagagtgagactccgtctcaaaaaaaaaaaaaacaaatatatatatatatatctctctctctcaaaacggcacggttggtctagatttgggtagctattttctgcaatttaattcataaaacaaaatgctttgattttaaagagctcttttttacttaaaatacaggaactgaattggtgagacttttggtttttgactgtggtaagtgatggtgaaatgtacaagattgtaggggttttgtagtcttatttttggtcatactttaaaaatgcattttatgaataaacttctgtttttgagatctacagaagctttgattctgttaccttaacagtagtaataaagttaacattgtcacatcattttgctttataaatgcttaattagtagttttaattcactttgtttctttaatgttcaacatatctttagctaagccttttggaattattgactttaccacattttcattaagcctaccctcccccacctccattgaagagaacgcagccacctaaaacattcacaatatgtaaagtatatgtgatttcaggggatcatggagagtcacttatttggaa

SEQ ID NO: 94708 - DNA, 1088 bp, Homo sapiens
tacaggcgtgagccactgtgcctggccaaaaaaaaaaaaaatgttttttttttgagacagagtctcactctgtcgcccaggatggagtgcagtggcatgatcttagctcactgcaacctctgcctcccgggttcaagcaattctcctgcctcagcctcccaagtagctgggactacaggcgcacgccaccacgcctggctaatttttgtatttttagtagagacagggtttcaccatgtaggtcaggctggtcttgatctcctgacttcgtgatccacctgccttggcctcccaaagtgctgggattacaggcataagccaccgcgcctggctggaaaaaaatttttatgggaaaagttaaaagataaatgattgttggagtgctttcacattatctgaccattttaaagctgttttacttagtataaaagagcctcctgagtaatactggtgagactaccaataataagtattctctgttttcaggtgtgtagcttggagtttgacagaaaagacataagtatgaataagttagtagccacatctctggaaggaaagttccatgtttttgacatgagaacacagcatccaaccaaaggttttgcctctgtttcagaaaaggtaaatatgagggaaatgtctttctatgaagaagaatgatagcttggtttagactgataagtagaattagtcaccaaggtttcttccaggtctttatgtgaagggagctatttttgatatattcctgtgagatcttgacaagtttttctgtgcaaagagtacttccccaaagtttatcaactttagacttcttgattataataaagatctcaggtaggaatcttattttgtagtttaggagcaattagaagaaacctagctgatattaggaatttgatcaacaaaacccagcctggtgtttcctaataagtatataatatttgtgctaatacctggttatatatttttcaaaataaactatatgtacatgatgtcatttcattacactttgttttatattccagtttgctatattaaatgaaattatttgaatcactgagtactgtgattatagtaaatgttcaaaa

SEQ ID NO: 94709 - DNA, 1030 bp, Homo sapiens
atggataccacattaataatcttgatgtcctctcaggattggtaagatgggatactacccagtgtgatttttaagatctgatttaatataagttttatgttagtttcataagacttttttaaagcagcctttataaggatgcatttataaggatgtgaaatgttgtatcttgatttccaggcaatgcttataatcaagaagaacgtgttgtttgtgctggctatgacaatggggatatcaaactatttgatctcagaaatatggcattacggtgggagacaaacatcaaaaatggggtaaagtacattctgaggctttttggtttctctgagcatgtttccattcacctctgaactattacaaaaggaaaacacctctagtaactcatctgagtcaacccctctgccaacggttcttaactttttgaggccaaatccgtttgagaatctaatgaaaatcctggatcctctcttcagaaaatgagctcacacccacatgtggtttgcacagcgttgggggagtcaccagccccttcagcctgtctgcagacccctgtgggccatgtagtaagatttcaaaataagcaagtaaaaggtctttttatgccaatatcagaaagcctgaaacagtagtcacctccccagctcagatttttggttccttagttgtgcacctttagcaaagaatgtggtttcctcctgttttctactgttagcctttacttaactgttaaataatgtaaaaagttaaataatgattccccaaaggcattcactgagcatgggaacccaagattgttttgttgatcttactaatggaaaaaaaaaatgggttttttgtttgtttgtttgtttgtttgttttgagatggagtcttgctctgtcgcccaggctggagtgcagtggcgcgatgttggctcactgcaagctctgcctcccaggttcatgccattctcctgcctcagcctcccgagtaactgggactacaggcgcctgtcaccatgcccggctaatttttcatattttttagt

SEQ ID NO: 94710 - DNA, 1050 bp, Homo sapiens
ggcagagatctgaaagtaggtttaattcatgccgttgtgccatttacctcagcaatcaagatcggaacatttctttgatacttccaataacgctcaggtttacagaatgaggactccaataataaaatgtttatttaattgatttacatataagcctggaggcagcctagtttagaggaaaaagtctggattgtatctggctcttgggaccttaggcaagtcactcagtcctctgaacctgtttcgtcatcttgaaagtggtgttctgaacacttagtttgcagtgttgtatatattagaaaagggatggtctagactggaagaatatctaaaatgtatctgaaatgtaggtgttcaatagatggttgctattttcatgattgcatgtcaatgacaccagaaactgaacagtttgtcagaaccctggcacatgaaagtatggtaggagaaaagagagagcaaagaaagtgaactccagccctggtttgtctgtccctagtgttagggctgagagattcatggatggtcatttataccttcattcaacaaatgttgaatgcctgctatgcgttaaaaaaattaggcaaggccctgctctcatggtgctcacattctagaaagggggacataattgcatgaataaaataattttgttgataagtataatggatgattaaacagggtgagtgacagtaatttaggggtttttcagattggagggacaaggaagacctctttgggaatgtggcatttgaactgaaatctgaatgaagagaaggatagaggcatggtgacctggggaaaagtagtccaagcagtgggaacagcaaattcaaatggcccaagtggaagagaccttgacaagtatgaagaacaaaaagcaagctgtctggtgtggctggaattagtagagaaggcaggaaacaggaaatgaagtcacacacacaagaccagatcccaaaggactttttgcattttgtataccataggccttcatgccactcttgtgagtctgtgcttctcaatgtagatacattttacttctttcct

SEQ ID NO: 94711 - DNA, 1026 bp, Homo sapiens
aacgcagagcgccagggcagaggagggctttacccaggtcacccgcaagggtggccgacgggcgaagaaacgacaggctgaacagctgtccgcagcaggagagggcggggatgcgggccgcatggacacagaggaggccaggccggcgaagaggcccgtcttcccacccctctgtggggacgggctcctggtatgtggctgggaccctaggacagcaacgaggcaagggccagacgcggatcaagccgatggcctctggagaatgttgaagctgcggtggggctgttctgccgtgatgctcagagagaagtgattctttgaagtgtaactagttcagttaaaggaggccctttgtggatcagatgtcattttaaactccatcaccgtccctccatagccttctgagttgtgtgttcttttatttacagagtgggaaagaagaaacaaggaaaattccagtcccagctaacagatacacaccattgaaagaaaactggatgaagatatttactcctattgtggaacatttgggacttcagatacgctttaacttgaaatcaaggaatgtagaaatcagggtaaggaaaatctcaatcatttcccaatacaccaggctttctctcctacagagatgaaaaggcatgaataggctttacttaatgggacttttctgttgtatggtttttgtccagtttaaaaatttaccatattgagtttgaacttcccaaatgccttaaaaatctgcattcgatacaaatattaattgaatttgtaaattagttctgagatcacaccaaaatactggctcttcttctgtgtatcttttataatgttctatgtcaaattgagaaaaggtcgagtaaagagattgccataaacagaagcaggtaaataatgaatataagcacttgctgctttacaagaagtatatacagtcagcgtcgggaatatgttctgggatatgttttgtcagatgacttagtccttgtgcgaatattatagagtgtacttacacaaacctagatg

SEQ ID NO: 94712 - DNA, 1040 bp, Homo sapiens
agtctaataagggaaattttctattatactagtagggaacactcaggatcttctactctgacctcctcattttactgatgagaaaactcaagacctaaagtatctatgggacttgtctaaggtcacatataggattggaactagggtctagttttaaatgggaaagctctggggactctcccattgcacaagcccatatggttttacatttgttgaatacgtggtctcttcaactagactgtgaatgtgcatgggacagtggaaataacagttttgaaatcagacctgtgtttaaatcttaccttttttgctttttagtactttagtttcctcacatacgaaggtagtcatatcacttaacattcaaagttgttgtgaaggttagagttatggtgtgtaaagcatgttatttatagtacgtgttatttacagtggtaggctttttatgaataacagttatttctgcatttctcaaataaactttgaggacaggttcagtgcttcattcattctttatttccccaatcagtgcatgcaggtagttaggcctggagctgttggtttaagaaacatcagcatataaatgataactaagaagattaagtcaggaatcccagggaagactgccttgagagagaagagaagaggacattgggcattgaagggatggacagaaggtagaggttcttcagaatgggagagattgggttgtgccagaggagtcttgctgttaaccccaaaatctgatcatatagtgcggttagttatttgacactctttgggtggaacagccaagctttggagctgggaacgttttgttttgcaaataaagtacagcacttatctgaccagaacctgtgtcatacagaatatattagggaaaggtggtggtgaaggaaattctccaataatgggaaaggacatttccagtattttgttaggacattttctgtttgattctcaacggtattttgtacccttttttgttttttaacagacttgtaaagaaaccaaggatgttagtgctctgacaaaagcag

SEQ ID NO: 94713 - DNA, 1036 bp, Homo sapiens
acaactgggctggggctatcagtgaacaagagacaaatcactacccttttggagctttcattttattcagtagtcagggaatacaaaatacgtaagtaaactgtgtcagaaaagaataaatgccattgtagaaggaaaaatatagaggaggaaagaagagccaggcgtatctgtattttttaatagggtagccaggacagttccttttgagctaggctgtaactgaacaaacacctgaaggcattagctatgagatactgggaaaggaaaggggcaaaaagggactgatagcgcaagggcctaagagacacaaacccaagactccaggtaccaccggaggctaacatggctggagtagagagaggggtagcagtaagggaagtcatggcaggaggtgatgggagagtactacaggaatttgtaggtttttatagagattaaatgtcactttaccagactgtttttaagaatttaaaagcctgagaggaaaaaaaattctcatagctatggaaaccatcaaagaccactgaatacattcaagcaagtttcaaatattttattttcttattcatacagtatgaagttttctaaagatcccacaacatgacgtatcatgcagaagaaaaactaaacattcaacataaaccatcccctcccttacccacccccacacacaaactaaaaaaaaaaaaaaaaaaaaagaaaaagaaaaaaccctcattccccggtaaggaaataatgtttacactatttttctgtaacgccagccaagatatgcacaagcaagagaaatagaaagcatttgctaaaatatttgtaacaaatacttatgtacaaaaaattcacaaaaggctagttcccccttgaagcagagcacatggcagttgacactggaacagttcaaaccactggctgggattataagccatgccactgatccagaggaagaaagttacatgtagtggagattttcagtctgaacattaacatttccaaagtttggcaacattatcttttaaaattatgcaaattatgt

SEQ ID NO: 94714 - DNA, 2521 bp, Homo sapiens
caccacacccggctaagtttttgtatttttttagtagagacaaggtttcaccgtgtgttagccaggatggtctcgatctcctgaccttgtgatccacctgccttggccttccaaagtgctgggattacaggtgtgagccaccacgcccagccccctagtaatattttttaaaatttgatgaagtagttagaccacgaatgaggagtttctcagacactgtgaagcttgatttgttcctgtctgttgcaggttgtaggtggcctagatatccacaaaaagatggtggtagatgtgtgactcttatcagagagtaccacccaacacttttgctttcttctccatctctgaagatctgctcaagacgtccagcaatgctctctgtgtatttaaatggaagtatttttctctgtgaagccacattttccaacatgagcctcatgaagccaactaagtgttattgaactgtaattctctcaataactcagtgtagcactttaaagtctgaaggacagcaacatgaaaagagcatatcaatgtggtggagaaagggaaggggttggctttttaatttatttttcttcatcttttataacaagaaagtatctatatatacatatgtaaatatttatatatagatatatgtagctttctatatatgtagtaggttggctttaatttaatatacttgattcagaaacaaaacaatagagtacaaaagtgccaagcagaacataaaacatccttacttttatttcacacagttttatatatagatagaagactgtacaatttgagccgggtgttaggccagctattttccttttcctgtgctttctcctttgagagattgacaaagcatttgttaacgtcctattatttaccttaattacatttttgtaacaaaggagtctgtaactttatttatacttatgaatatatccagggactacttctcattgctgagcagcttttaatacacctctgcttgaggagaaagtctagttcattgctactgccaagagctagttcttgtgttcatatagtaactgcacagggcttatagctgcttcattctgctactttgtaactaggagccattgcatttattaaatgtccctcagtaacgttaagtgctagttgtgattttatacataaaggccagaagctgtctgaggcaatcatgattgattgtatgtatcacttactgaagaatacctgaagtgatcatgtaactacttataagggatatccatttgtttgattacatgggtaaataatttgtcattaaacttgtgtttgaatcatgaattcccttgtttcaaaagacttgcagctaatctaaaaaactggtgatatttaatatgcatgtatgtatctaaacacccacatatatttgtggtttaagtgtgagaaatcttgctaatctatatgccacagaagagcaaaattgtatccaaatttatgccacttaaatttctttaccacgagggatagagcatgcatactggtttttttttcttgatttgcccatataattggtaatggataacttaataaatttgtgtgatataaaagtagtgtatcatgttctactgtttgatcttatcccttcccatttctgcaaaggtactgttagctggaagaaaaacattttggttagctttgtatgacagtagtctttccctttatagtttctctataaaaactggttttaaaatcagtggaaaagggcaggttgaatcaaggtgaatcaatctgaaattgagcacacctgcctgccatcgctgttccttcaactgagtgctgcacatcatgggctctgtctgtgagagaaaaatcccggtgcttggtgtccttgcatgacatggagttttgcatgtagatcaatttaaaatgtacctcttgtttacataatttgcataattttaaaagataatgttgccaaactttggaaatgttaatgttcagactgaaaatctccactacatgtaactttcttcctctggatcagtggcatggcttataatcccagccagtggtttgaactgttccagtgtcaactgccatgtgctctgcttcaagggggaactagccttttgtgaattttttgtacataagtatttgttacaaatattttagcaaatgctttctatttctcttgcttgtgcatatcttggctggcgttacagaaaaatagtgtaaacattatttccttaccggggaatgagggttttttctttttctttttttttttttttttttttagtttgtgtgtgggggtgggtaagggaggggatggtttatgttgaatgtttagtttttcttctgcatgatacgtcatgttgtgggatctttagaaaacttcatactgtatgaataagaaaataaaatatttgaaacttgcttgaatgtattcagtggtctttgatggtttccatagctatgagaattttttttcctctcaggcttttaaattcttaaaaacagtctggtaaagtgacatttaatctctataaaaacc

SEQ ID NO: 94715 - DNA, 1103 bp, Homo sapiens
gtctgtacctttaaaagtattttattatgtttattattcagcacagctttgttaatatttttactaggatttgtattgtttttgtagtactgtggttacagagttgcataggttttaagtgtctgttccggactgaattttccttaagccatgttatttttaatgggtggttttaagaacacgaggtttttttcagggacataaatatcatgttatatagcaaacgtgtcttttcatttagatcccccaaatgccacttgaatctgctacttcttcatccccattgccattgacatcattgtgctaccatttatttctcaggtgggctattttgatagcccacataatacttttttctttttgcctgtggtttcttccttcattctgccttacctattgccatgagagtttttctttggatgaggaaatcttatgtcaatgctttcatttgaaagtcaaggctacgtctttgagaattaaaaatctaaactgttttgcatgacagtcgggctctgacccttatttctagccatccttatgctgtaactggttcaaactgctgctttctcagattccttatcctttttcacttattgatgcctttgtactctttcttctgttggcaatgtctctcccctttctctgtctggcaaacgtcaagatccacagtggcattgtgtgaaaatgttcccaactctcccaggcagttaatggccatttgtaagtaactttcactgtagtacattccatatttcattatgtttaattgcctgccctcctaaactgttggctcctcgagggcagtggatgcattttttttttcatctttgtaaatctaatccctgttgtggtatctgtcacttaatgcagaggtgcaatggagctaagttatattagtcatctaggactagggagacctttgcaagtcctgtggataagtgtttagaaaacccccagtgtgttaggcacaaataggagagctaccagaaaggaaactgctattgattgtaaaagagatcttttatgcttcaaaattcttgttacatatctgagtagagacttatatgtcaggttgttactttcaataagtaaacattttcata

SEQ ID NO: 94716 - DNA, 1602 bp, Homo sapiens
ttttttttttcctgaaagttaaagtctttccctcccttcacccttatttgagttttaaattgttaagcgtccagggagaatgaaggttatatgttaaaaaaaaaaatcttgtaaatagtgagctcctaggaatttcccctgaacgaggtgttttatatatgtttttgttgaaatagataatacggattttgttctggatacttaaatgaacataatataaaggtaattgttttacgttttgtttcttaagggaactttaaattttataaaggccttttcatgtctttgtgcttttaaacttttaaatttttttttatctccatgatctgcatctagaacttaaaacaaatttattgccgtctataactgtatgtagagttttacacaacatattctagttcagattctgtggcaaaggccactttttagaaaaaaaaaaacctgtcttatgaccagcggaattaaaattcacatctgtcctgagaaaatttatccactcattttgtcccatagtgaatgagaaaattaaaatggttcaaggtataaagtaaagaagctgactaagggtcagtcagcaatgagagggacagacaagtatggaaggatcaggcaactgttataggtagtaaggcagtataaggaagtcaccttgggccaggaggatattaagtcagacagtgggcctggagtctggggcaagcaacagggattcattcctatcaacaaatacttgtagattttgtctgccgtttactggttgttgtgctctctgttgtggaggatattgcaatgattaaggcaggtttcctaccttcatttaagtagagaatgtaagacaaatggcagtaaccgtgaagtaagttagcatgtgatgagtgtcatatgaatagtacacacaaagcatgatagaaatttaagaaggagcaagatcattttcacctgggattaggaaaagttttatgaaggaggtggtaattgagctagctgggtctaaaaagatcagcgttgcagtaggcagagttggaggcatctagaagaaggcactttaaatcctaaagggaggaagagacaatgtacatttggagcactgatggttcccgaaccaacagcaacagcatcatctggaaacttgtcaggccccaccctggaacaactgaatccaaaattctggagatgagccaagcagtcttaagttttataggtcttccaggtaattgtgatataggctgaactttgagaaccactgtttagagaataggaaggaatgtgtaaagttgagtcaagcgtctcttaatgtacctagcactaactatatgtacttaagacataattgttatctacaaggaaattaatcaagtagggtaaataagacagtgattatgcagtgtgctatgtgctattaacagactaaacatgggatgctgtaagagcacatggcagggaagaggcttaatccacactggggatgaatgtcacttaaagtttcctggaagaaatggtgtctgaactgagtcttgaaaggatgagtatttagccagtgaggaagggcacaccacatagagagcttctgttcgaagtcatggaagcatgagatatacaagc

SEQ ID NO: 94717 - DNA, 1562 bp, Homo sapiens
gcactttacataagacccacttactctccagagctgctgctgcttccactcactgcctgtttcccagcagtgagtcttggcagggaaccctgccactcacttcccctctcctgcgagcgtcggtttagctgcggtgcgcagccctgcggggtttccgttcgctgctgctttgctcgctgccctggcgaaccggaaagatccaaggtgtttgttcacgaaaacatacgcgaacttggtttgggagaaatgggggcgcttaatttttcatgcttccgttactaccaagggttttttcattttctttggtaccttcttgtgtctctctcttggagtggttgtttttgaatcatggcgattttaatttgtctttccttaccctcacattaatccctaggtagaattcgctgctgtagtgtttcagaccgacgctaggggtgtgtctcccgcctctgtcgctgcagccaagaaatcaacgacgcccttttagcctgttaccttaccggttctctcgctcggggaagccctagtcgttagtttcctctttgtaatcaagagttgtatacacagtagagaaagttcagagtgctattccgcgtatatcagatactccatcatgcgattcagttattaggctttctctaaaagtctttgaacagttgtcagaagacttaaactggttgacggtgggtaatttctcgcatcttttccactgtatggtatcccaccctgtatgtagaatttaagtgcttcagtgtacgtggtggattactgaagggaggaatgctgttgcttacaacttaaaatcgatttggtgaaatcgattttaagggaagaacgtgaaattagaatattcaggtaagtcagcttttatttaaaatatagggcaaatgagtaagtgcttactggtgcacttaaaacccagattaagagcagacttaaatgattgccgattttgatgtgtagagaaagtttttccttgccaacttgcgaggcagctcagagaggcaactttggcacctgaaagtcacaaaacaatttaggaagatcatagccattcatcatataatctttttgttggcatagtcttttgaagtgaagaattgcatttcagtgctttaatagaatttccttatgcacatgctttacttgaaggtcaggatcttgaagatctttgttcattgcagggaatgtttttacttagctttataaacagcacatttgaggaacaatgatctagccttttgttgtttatatattatacagcgaagtggtatggtttccaaatagtaactctcttgcggtgcaccccgtcctctgttttttgaacaacagactgaaactgggaagttctcttttagctcttcaatttcttattttcctgttaactctgttttcttgtcttttaaaatattttacggtgtatcagacgatgttgtttcctgccaggtcattatgttccttttcttcccagctcccttttcagtatttatttcctaattcaactgttgggtttttttttttcctctttcatcctcccaataccatttcaggacctacataat

SEQ ID NO: 94718 - DNA, 1047 bp, Homo sapiens
gccagaccctcgcccagacatgggggacctgccgggcctcgtgcgcctctccatcgcgctgcgcatccagcctaatgacggcccggtcttttacaaggtggacgggcagcgcttcggccagaaccgcaccatcaagctgctcaccggctcctcctacaaggttgaggtgaagattaaacccagcacgctgcaggtcgagtgagtgcggggcgcctggtggcagcagggtcccccatggggtacaggcagaggactgaggcccccaggacagcccgagcctctcaagggcctctggcctcgcgccgctcccagcgggcccgggggttggaggaagaggtcactccctgtccgccttcgtccccttccttccctttggcttgtattcctccattctcgcttccctccacccatcgcagtgacctcagtgggttctttaaaatcagtgacaagaagccagggtttttgcttgtctgtttcttataaatttctcctgccttctgtccagccttgggcgcggaaccgcaggcggtcggggtggagcagatgggagaggtccgcagggttcagccaccgcaatcccagccctcctgcgcgcggtccaggcggcccacagggtctgcccgcaaggctgaaggagggagaaaggaggaatgaggtggaaaggcaggggaggggtgattactggggctccctgagggatgctccccactcccttcgccattcagtggctgggaccctggggtggagcagcagacactagtaagagagcggccgccccttctctggcctagtttcacggttttccatgccgtatgctgttctttttctcctgagttttctgttcaggctggtgatggtgcctgggattagcaacatccccacagcaagaggatgttttttggtttatccatggcagggacgatttcttgccagcgaccgctggataatgcacccagtagacctctggcgggaaagtgtgtgggagcatgcagtagcctacccggaagaactgcgggtggagcccctttacctctcgtttctacctac

SEQ ID NO: 94719 - DNA, 1271 bp, Homo sapiens
cgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaaaaaagaaaacgaaaacggatcttaagtaagagaatgtggagccaccaggggaaagaacaattgcagggaaagaggcctgattatattccagaccctggtcccagccattccttatctgcttacctaaattaattcaaattgagtttcaccatcatactgggacccccacctgatgtggtttcgttgcccatttttcaaatatgtattatttgtggcttacattaacatcttagatttcactctgacttcctcaccagtcagtcttaatctgctataatatggccatcactccatatggttgaaactgttggtatccaaattacaagtgacttaatgtctaaatccactggatgcattctacttgttaatatatttgacacacataaacactcacactgacacacataagtacttcttaaaactctctcctccatgggttggaactatagtctcttggacttttctttccctactctaacccgtcttctcagtttcctccaaagactcgctttccttcacctactcattacatgttagtgttcccccaaagttccacctgttgtcatctcgtctctatactctaacatccttggtgatcccatctacaactcctatgtcagctaccattgttggtgctaatgccgtctatgtccgtgtcccaacatcagatctccatgagatgttccagaaatacatatgctattatcttttggatttttatccaaagatagtataagtatatatatatatatataaaatatttgatatatccaaagatagtttatatataagcacctgaatcaaaacttaccatctcataaaagtagttcttcctccagttcctatctcagtgaatggcatgtcctgttagaaaatcaccatattttacttttctccatcattctccaagtccagccgagtcaattcttacttgattttatcatccaaatatctaagtaattcacctcttccccatctttatctctgcctcattacttaattcttgtccttatttgacattgggatttctaaaataacctcttactggtgttcctgcctccagttccttccttttactgttagcagtgtagtctttgttaaacc

SEQ ID NO: 94720 - DNA, 1093 bp, Homo sapiens
gctaaagtttgtccaattgagattcccattaattttatataaacctggaacggctctcaggagctgaaagtaagtggaaagtttccagaacactttaccatcagaatgccacactagcctggtaaaactctctttctgacagccttatagcaccatctagtgtgctattcttagatagcaagacaaaggactttcagctcctttttgttttctccatattaaaaagaaaactgttattctaaagaatccttaacacttgtctttgttaaagtttataactttttaggaacctttattttaacttttaaaaacttttgtttctcttttttcataaaaacagattatatgctactcactataacaaattgtttattctgaatctgtggttaccaccatagtaaaaaagtgtctacaaactgctttagttagtgtggggttttcttcttaaaaactgttctctatagcattaaatataagaatccaggaaaccaatatttaacaaataggcaaatattagaaagatgccccactatatgcaaattctgtatgttgaatcaagcagtagataattaattgtctcctactatcttcttagagttggaagagtccttgaaaatcaggcagtcaagtgtccaggactattcagtaattttctcaataggaacactgtcagtcagccagcccaagctgaaatcctgtacttctactaatagcatctctgttatgtcacagaacagtccagttgtagtctaggcttgcactgaagaccacctctctgtaacgtttgccttctagccccacttccaccctctagaaccaggctgattcagtccttcctgtctatgattgccagatatttgaagactgatagcctgtctcttcctatgtcttctctccaattccactgatgatcatagagtataatttctagacccaacaacattctcttctgcccatttactcttaacaaaagaaaggggctgtgcgccatggctcacgcctgtaatcccagcactttgggagaccaaggtgggtggatcacctcaggtcagaagttcaagaccagcctggtcaacatggtgaaaccctgtct

SEQ ID NO: 94721 - DNA, 1022 bp, Homo sapiens
cataaaggagaaagggcagaagaggggtcgtttccaggcatccaggcgaacctggacgtagaagaaagattcctagtgggattttagaaactcgcaaaggtatcccctgctgtgaaattcaaaagccttcattcccgttacaggaattccacaaggggacgcattttattctcccagtaagatcctgggagaagtggataaacacactgtaacgtttaaatgcactgtaacgttttcctaatgtgagattcttttcaagaacgttgtggtttggctttggtttgtattggtggtgggaggggccaaggtgcatggcaaaaacttgctcttgactcacccgtttttacgtttgctttcttacttctcctaaccctcaagaagaagacctctgttgaacacagactgcagttccagccaccacagctaatctggatcatgaatgggagccaccgtggtcttggcaagtccgaaaacatagctgagtagctcgtctagaaaagagatttgtgttcagctgagttaaaagaagtatttacctcaaacctctcctcttgcacaaccaacccccgttataaaaggaagtgcaaaatggaataaactgattttaagtgaatacaagctgtctttatatacaaaagtaactcaaggatggtgatgtacccagtcatgctttcaactgatttgggaagcctacaccattcaccttaggtaaattagctgaaactgagctttaaatctgggcttcaaagagtcacatactgtacctagctgagttctaaacattgtttacagttgtcactcactgttgcttgatgtcttcagtgactattatccttagcttgtaattatgcatgtaggatagcttcaaggggccatttctaaaacactactcttatgactgagttgaatatttgagactttgtttcataatccagatctcatcttcttgtccatttcagatagtagttgtgtcaaatgtaagcacctacctacctataagatacaagtagataaaattctta

SEQ ID NO: 94722 - DNA, 1152 bp, Homo sapiens
ttcttttctctttaatatataaataataattatggtacttataagagttagatttattaaacttttaagtctaagtttatgcttaaatttttttgataccaaaattatgaattcatatttaattgtatttttgttgtaattttgagttacaacattattgtattatattcttttttaaatttaattatattcttttttaatttgttagatacacacaaatccatgtttttaccagtcttcagagaagagtcagctcttaccattgaagccaaatctatggtgctatttgaatcctggagacagcttttctttgttagttgacaaatacattttccgcattctctctataccctctgaagtggaaatgcaatgtaccttaaggtaagtgcctgatgaaatgagagtaagaatgttatttttaatctaattcctcagccatcacaaatccttcggtaggaaccagtagaaaccattaaactggagatagagtaggtgtgtaatgtgtgtgtacgcatgtgtgtgtgcatgcctttgcatgtgtgtgtgttttgtgcacatgcatgtgtgtatctgtttctagaaaacatttgactttggaaacttactatgcgttgatagcagttgctcccacaggtggtgtcttttaccattgtattgagaatgtattttccatctaacagtattcaatatagttaattcgaaattgactaccttttcctcatttttttagctttttgaattttattaaggtattaacttctgacttacacttgtctaactcctctttcttataaaaatagcagaaaatatagaacagagaaactgaggaaatgaggtattagaataaatatactgatgtctggcttacagttaaaattcatacactagtttttttagtcagaagattatttggcttcatttcagcttttaaattatagaatggataaactagacttatagaagtagatggacagaattatgcggagtatgttctctgatagcaatagtattaagtcagaaatcattaacaataaaatagctacacaaatatacaaatactttgaaattaaataacacatttctaaattacccttgggtcaaagagaagtcatagggaaattggaaaacattttgaacagagtgatactgaaa

SEQ ID NO: 94723 - DNA, 1129 bp, Homo sapiens
ttcacttagaagcactaatattaattcttcctccccaatagtgggtgcttaataagtgttggttttttgaatgcattaatgaaatatctgaggatattaaactgagtgataatgtgataagtataacattttgttttcatagctgaatttcattgctgatgaggaagtatgacattttcactctagggagattatttattttcagacacttatgaggaaagtaaagtaaatcctttgttatactgaattacttttttttcaaattgttgaaaatctaagtatgtagattccatataaataactactaattttaatcattgatattgaagaaacaataaaatggtgatgaaaatgtcatgatagtatgataatatgcaagtttcaaattcatttataattatttaaaatgtagttttagatccagctcattcataatagtagcatattttatattaaagatatgaaaatacataacataaacaaaatttggaatatatttgaaagacttaagaataacttaattgccaaaacaatcttagaaaaaaagaaaagagttggagggttcacacttctggatttcaaaacctactatgaagctacagtaatcaggacagtcctggtgtaaagaaagacatatagatcaaggaaatagaattgagggtccagaagtaaacccctacatttagggtcagttggtttttgacaaaggtgtcaagacaattaaatgggggaaagaatggtcttttcaacaaatgatgctgggacaattgaatatccacatgcaaaagaatgaagttagtctcctgctgcacaccatataaaaattaacttacaatggatcagaagtctaaatataagcactaaaactacaaaactcttagaaaaaaacaggtgtaaatctttgtgaccttgcattaggcaatgtttataacaccagaaacacaagcaaacaaaggaaaagtagataaatgggacttcattacacttaaaagttctgtgcttctaaggacacagttaagaaagtgaaaagatttagtgccatccccatcaagctaccaatgactttcttcacagaattggaaaaaactactttaaagttcatatggaaacaaaaaagagcccacattgc

SEQ ID NO: 94724 - DNA, 1606 bp, Homo sapiens
caatggtgcaatctcagttcactgcaacctctgcctctcaggttcaagcgattctcctgcctcagcctcccaaatagctgggattacaggcacccaccaccatgctcaactaattttttgtattttttagtaaagacggggtttcaccttgttggccaggctggtctcaaactcctgacctcaggtgatccacccgcctcagccttccaaagtgttgggattacaggcctgagccaccgtgcctggccaaatttcttttcaaaaaactaaaaatgttttaagttattaaactaagcgcatagaaaatagtggcatttaagaactttaaaatgtgaatcttgaagttttaagtttacattttgcatggatcttgtagttttgtgctgttatgctcatatctttttaaaaatgtttcatttatttctgatgtttttcatatttgttttacaggaaatgccacaatcattttctgcaatcacattaagtaacacagagatgaataatattaagactaatgcacagagaaacaaacttccaatagaggaacttggtaaagtttctaaacataaaattgccactaaaagaacaccacataaagaagatgaggcaatgagctgttctgaaaattgttcgagtgcccagggcgactcacttcaggatgagtctcaagggtctcattctgagtccagctctaatccctccaatcctgaaactttgcatgcaaaggcaactgattcagttctacaaggttctgaaggaaacaaggtcaagaggacatcctgcatgtatggggcaaactgctataggtaaaatgaaattacagtaacatttaattccattattttgatagcgtgtagctatgtagatacatgctacagtatattaaaaacttaataaaacccactggcctaaaggttaggggctttatcgtgtttctactatttgtacttcctcagtatattttctagaaaatccttttaaggcttttaagatacagtgggagaattaaatgttttatatatagacatgctgactaatgtgaggatctgaatactggggaatccagacatgaagactgaatcccccagatctaaatacctgttatttagtcttttcttaaatattagagagatggcttcctacagagttgttgtctacaatataactataattttaagttgtatttaggtgtcttttctttatatttttgtaatggtgctttgaatcatcatggtaccctgtaaaacaactgaatataataatcctggattgatgggttgctcctatacttgcttcatttatttacactgccctatatactctaatttcttattttgagaattcaaattataatctcttagttttaggctatactttcatccatagtgtttatagtaacatgtttataattacataaccctatttcagaaagatttcttgccattccaacttgccaaaccaaatatcctagcaatcctttccagtagtttgtcttctgtgtcaataagacactagtcagcatgtatacatataaaacattcagttccccccactgtatcttaaaagcctatagcaggattttctagaagatagatatctttattgc

SEQ ID NO: 94725 - DNA, 1029 bp, Homo sapiens
taagtcagtgacctgcaccagcatggtcagtaggaaagatcttcccacaaatcgtcaccatagctttgttcatttgcagctgtcttcatcacaactaagttgtacagcttattttattttcaagtttaaatttctttttcatcaaaaggtcaaatttgggttagttatgctaaacacacaatcttgtatagaatcttttttccagttttcaaagctgttgaattaggaccttaattaactgtggagttacacttttgcactgtgtttaatacttgcattgtaggaaaagttaccagaaagaagagagattagggatgagtgtcacactgacacaaggcctggcatgtaataagtattctgtaactgtttcttgagctaataatgaagggatcaaaggctaacattatttatttaacacctaccaagcccttagattaaagacttattttgcattatctcatgaatcctcacaacagcttcttgtgagtatgggttctgttgttatctcccttttacatgtgggaaaactgaagctcagacagcgtgcagggaggtggctgagtcaggattccaatggggtctttctgactatagtcactaacctcatactttcaatcatagcatttctacctatagaatgtttacttcgtttgagagtcacttcataagaaagagggtgtttggctgtggtttgagaaggattaattgtaattaatcttggctgaggagagaggatcactcttttcttggtttttgaattaaaactgttgtccaatatgatagccactagccacatgtggctgtttacatttaaatatgaattaactaaatacaatttaaaattcattttctcagctttgttacccatatttcaagtgcttaacagtcacatacagttagtggttttattggacaacacagagcaaatttccctcatgacaaaaagttctgttggatagcattacaaagattccagggttatcagttgaaactcttgaaagtaacactagttaaaacctatctcggaaa

SEQ ID NO: 94726 - DNA, 1110 bp, Homo sapiens
tagaaccagttcttctgtctggaccagtcactctcatgcctaaacttataagcaaaatgaattgccattggtatctcatgtttcgatcttgcttcagggcactactttagaatatggacagttaatgcaaattaatacagttatcagccctactgaaatccatcgaatcttagtaaactaaggtcttgtttgctagatttgctatttaaaaaagaaaaaagatacagtaagggaataaaatagatgccaacttggcattattctttcagtgataaataaaatattctgacagaggagttcctgattaaagatgcaaggaccctgtcatgctaactgcagctgatttcctgccttgaaatgtcttcctgcttgtgtcactgccagtgactgacagctggcttaataattaaattcaagcaatgtttgcttttcttgacctttactgggaaacaaattttcaagctctggacatgagtagagtgttttaatttggggagaataatgtgtttgcatcatttccagcaacctgtgtctgtgattacctgtgttattttacattccacttcacagcggacttctagagggtggctggtagttgaagtcactcggtaattaatatccagctttggctccctgcacatgtttcacccaaaagagggcatttttgtttctggtagacttaataagggctctggcagcccactgttctcaagtgtatccaaagccaatttattttgaacatctaggtttttcatagtctgttaaggtctttagtcattcttgcttataagaacaaatcgttttctccagttgtaaccttgatttacttgcctttctttacttacatgctttttgttttgttttctttttgtttttgtatatgctctccatcgccctctaccggggcagacagggtggtgtagcagcaaagagctcccagacctgggtgagcttcagatttttatctggaaaatggggataacacacccatcttgtagaagtgttgaaaggatgaggagaaaatatgtatgtaatgtgtccatcaagtgcttagcacatggtgtggtggcactagatacatgtaactgcagctgttattttctttttctc

SEQ ID NO: 94727 - DNA, 4956 bp, Homo sapiens
aatacatctgtgtctataattagcccaaatttaaaatttcattatgtttttaaatttaaaaaaataatacaagcagaatatttattcttcatacatattcttgtacttgaatcagtttcttaaccatatttgtctctaattctgtgacagtagtattttactaaagaatgtattttttaaaatatgatctaatttttaattttttcataaaattatctgaagtcttgttcacagttgtcatttatggttaatgaatttgaaattgtttatgccttcatttgtttcttctctgcagaacataatatcgttaatggagaaaatactctcagtatagatattgaagtacccagtaagcttaaagaaaattattctaaatggaggctattcccaaatctattttgttttatattgaaatgaaacaatatgtcaaccccaacattttcagaggtactgtcttttacctgtattcagaatattttttcttaagaaatgtttttacataacagacacatcaaatataagttgtctgtataagcttttggagtcttttagcagagtttcagatgttataaaaatcatagccctattcggctcaaaataaagggatggaggaagatctaccaagcgaatggaaaacaaaaaaaggcaggggttgcaatcctagtctctaataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagagacttagactcccacacaataataatgggagactttaacatcccactgtcaacattagacagatcaacgagacagaaagttaacaaggatatctaggaattaaactcagctctgcaccaagcggacctaatagacatctacagaactctccaccccaaatcaacagaacatacattcttctcaagaccacacctcacttattccaaaattgaccacatagttggaagtaaagcactcctcagcaaatgtaaaagaacagaaattgtaaaaaactgtctctctgaccacagtgcaatcaaactagaactcaggattaaaaaactcactcaaaaccgctcaactacatggaaactgaacaacctgctcctgaatgactactgggtacataatgaaatgaaggcagaaataaagatgttctttgaaaccaacgagaacaaagacacaacatgccagaatctctgggacacatttaaagcagtgcttagagggaaatttatagcactaaatgtccacaagaggaagcaggaaagatctaaaattgacaccctaacatcacaattaaaagaactagagaagcaagagcaaacacattcaaaagctagcagaaggcaagaaataactaagatcagagaagaactgaaggagatagagacacaaaaaaacccttcaaaaaatcagtgaatccaggagctggttttttgaaaagatcaacaaaattgatagaccactagcaagactaataaagaagaaaagagagaagaatcaaatagacacaataaaaaatgataaaggggatatcaccactgatcccacagaaatacaaactaccatgagagaatactataaacacctctacgcaaataaactagaaaatctagaagaaatggataagttcctcgacacatacaccctcccaagactaaaccaggaagaagttgaatcctgaatagaccaataataggctctgaaattgaggcaataattaatagcttaccaaccaaaaaagtccaggaccagatggattcacagccaaattctaccagaggtataaggtggagctggtaccattccttctgaaactattccaatcaacagaaaaagagggaatcctccctaactcattttatgaggccagcatcatcctgataccaaagcctggcagagacacaacaaaaaagagaattttagaccaatatccctgatgaatatcgatggaaaaattctcaataaaatactggcaaatcgaatccagtagcacatccaaaagcttatccaccatgatcaagtgggcttcagccctgggatgcaaggctggttcaacatacacaaatcaataaacgtaatccagcatataaacagaaccagagacaaaaaccacatgattatctcaatagatgcagaaaagatgttgaattttgacaaaattcaacagcccttcatgctaaaaactctcaataaaataggtattgatgggatgtatctaaaaataataagagctatttataacaaacccacagccaatatcatactgaatgggcaaaaactggaagcattccctttgaaaactgacacaagacagggatgccctctctcaccactcctattcaacatagtgttggaagttctggccagggcaatcaggcaggagaaagaaataaagggtattcaattaggaaaagaggaagtcaaattttccctgtttgcagatgacatgattctatatctagaaaaccccattgtctcaacccaaaatctccttaagctgataagcaacttcagcaaagtctcaggatacaagatcaatgtgcaagaatcacaagcatttttatatacaaataacagaaaaacagagagccaaataatgagtgaactcccattcacaattgcttcaaagagaataaaatacctaggaatccaacttacaagggatgtgaaggacctcttcaaggagaactacaaaccactgcacaacaaaataaaaggacacaaacaaatggaagaacattccatgctcatggataggaagaatcaatatcgtgaaaatggccatactgcccaaggtaatttgtagattcaatgccatccccatcaagctaccaatgactttcttcacagaattggaaaaaacaactttaaagttcatatggaaccaacaaagagcctgcattgccaagtcaatcctaagccaaaagaacaaagctggaggcatcacactacctgacttcaaactatactacaaggctacagtaaccaaaacagcatggtactcttaccaaaacatagatatagaccaatggaacagaacagagccctcagaaataataccacacatctacaactatctgatctttgacaaatctgacaaaaacaagaaatgggaaaaggattccctgtttaacaaatggtgctgggaaaaactggatcccttccttacaccttatacaaaaataaattcaagatggattaaagacttaaatgatagacctaaaaccataaaaaccctagaagaaaacctaggcaatacctttcaggacataggcatgggcaagaacttcatgtctaaaacaccaaaagcaatggcaatgaaagccaaaattgacaaataggatctaattaaactaaagggcttctgcacagcaaaagaaacaaccatcagagtgaacaggaaacctacagaatgggggaaaatttttgcaatctactcatctgacaaagggctaatatccagaatctacaaagaactcaaacaaatttacacgaaaaagcaaccccatcaaaaagtgggcgaaggatatgaacagacacttctcaaaagaagacatttatgcagccaacagacacatgaaaaactgctcatcatcactggccatcagagaaatgcaaatcaacaccacaatgagatatcatctcacaccagttagaatggtgatcattaaaaagtcaggaaacaacagatgctggagaggatgtggagaaacaggaacacttttacactgttggtgggactgtaaactagatcaaccattgtggaagacagtgtggcgattcctcagggatctagaactagaaataccatttgacccagccatcccattactaggtatatacccgaaggaatataactcatgctgctataaacacacatgcacatgtatgtttattgcagcactactcacaataccaaagacttggaactaacccaaatgtccaacaatgatagactggattaagaaaatgtggcacatatacaccatggaatactatgcagccataaaaaaggatgagttcatgtcctttgcagggacatggatgaagctggaaaccatcattctcagcaaactaccgcaaggacaaaaaaccaaacaccacatgttctcactcataggtgggaattgaacagtgagaatacttggatgcaggaaggggaacatcacacactgggacctgttgtagggttgggggagtggggagggatagcattaggagatatacctaatgtaaatgacgagttaatgggtgcagcacaccaacatagcacatgtatacatatgtaacaaacctgcacattgtgcacatgtacactagaacttaaagtataatttaaaaatatatatatatatatataaatcataggcccattcaatttcatttcattccagcacagggtatacaattatctaattataagtaggagctccatcagaaaattcttttctcaggaaccaaaaagctataagacatacagaaaacaattaacaaaatagcagtagtaaattcttccctatccgtaattatattaaatgtaagtggttaaactctccaaccaaaatacatagattggctgaatgaataacaaaccatgattctactatatgctctctcactttagagacaaaaaagactcattttagatttaaggacatgcataggttgaaattaaacacacggaaaaaatattccttgcaaattgtaaccaaaagtgatggaatagcatactactactatcacacagaatagactttaagtcaaagactgttacaagagagaaaaagaacattgttaatgataaaaagattaatttaccaagaggatataacaattataaatatatatgcaccaaca

SEQ ID NO: 94728 - DNA, 1049 bp, Homo sapiens
tatgctacaatgccagtttattaagacgtgcaggaagtgtgtcatttattcatttatttatccaatatttatttaatgcctactatgtgccaggctagtcattgtgaatataataagtaaaaacaaacccagtccttctccttgtagagtttataatctaagaagacagtgaccaaacaataaaaaaaaaacactgtaaattataaactaggataagttatctaaaggatggcagtttacattaaaatgtgcatggatatagagatatttcattggtcaaatcaccagcacttaggtggcagaactcatattggatttggagagtgacagagagagcaaggctaacttaaacgttcaggtttttgtcttagacaactgaacagatgtaaatggtcggtagatacttaaccatccttgacaccagcatacttcaaaccccatacatctttaaaccagaatttgccctttacaacaaataagacaccaaggaacatgctctgaaagactttctgaaatatgtgtgaaagcaaaagacacctataccatcaagggataaaagagattggtccattataaacacacaaaaaagttctccaacaggaaatggccaagtaaataaagattggttgtttattaaagcaagaagcagagcaagtagaaaaaagaaatgccgtgcctatgataagggagggattccttataactctgtgcagatattcacagttctgtaaagattcttgagaaatctctgcataaactgagaacttcatgacaaaggacattagatttttagaatttgaaaaaataaactcttctatacaacccggactggtccacagtggatttcactttaaatatatcaaacagctcctgtaacttggcaaagttcttgtacatccgctgcctctcttactcgtcctcccaccaataatccaatgagatgtacaaaagtcaacttaccagaaacaacacatgacaattatttagctctttatggatttcaaacatacttttccatctattttctctttgaaatctgtccaaaagtt

SEQ ID NO: 94729 - DNA, 1068 bp, Homo sapiens
actcaattaactaacccttctgactctcagtttctcaaaatgtaaataatctctctctcagagggttgtagaagcatcaaatgagatcgtgggtatatgatgttagaaaaaatcaacatgcatgcacctgtgtgtatagatatgcatatgtgtatatgtgtgtgtatctatacacacacacaaattcactaaagcttttcatttccctattaattcctgatgtctacaaagatgttaatttggtaaagtgatatcattaagcaatcaggcattttgaacattttaatgtttaatccctctgattttaaaccatacatccatgtagtctattttaaaggtgtggaggcccatgtaataaagaagaataacatctactgaatgctcaagtgctaagtatcatgctttgtacttgaatgcgatattattgactccccacacaatgtcatcaccactgtttatagatggagaatgtgtgtccctagtcacacactagtaagaaaagggctcagatttgagtcggtgtgatctgaaatatcctctgcccctctctgtcccctcggtatgcagcttgagggatgcctagctcccaagtctggggcgtttagcactctgagataatgatactcattggcccccaaatcctgataaatccccaaatccttatcaagcttgtcagactcctatagacagatgccttgggtaaacctatgtcataggtacacacagaattctaaaatatctttggtaatggacaaaagaaatttatatttcaagatcatctaagaattacatttggctaggcccagtggctcacacctgtaatcccagcattttgggaggctgaagcaggcagatagtttgagcccaggagttccagagctgcctgggcaacataggggaccttgtctctacaaaaaaaaaaaaaaaatttaattagccaggtgtggcactgcactcctgtgatgcagtgactagggtggggtgggtgagggggacaaggtagggggatcacttaaagcacagaagattgaggctgcagtgagccgtgattgcaccactgcacggcag

SEQ ID NO: 94730 - DNA, 1143 bp, Homo sapiens
ttccagggatttcatggaccccctgaaatggtaataaaaaacgtgtgagcctgtgcataaatgtgaatgtatactttcattaggaaagggatgtatcacttccataaaattctcaaatgttaagaactctgtgggcaatgaagagctattaaaaagttcatgggcaggcaaatctatcagaatatcattttagggtttagagccataagtggctccaactgcagtgtagaagatggaattcctggcagtaatactggtggtggagaaaccaataaagagatcattgcaataatccaggaaagaaagaatgagatcctaagtctgttcaatggtattagagatgaagtagacaggggcagatttgagaagtatttagatcagaggatcaggatatactgatggcacgtgtcatattggggaaggaagagagggaggaaaaggcacctgaggttgacttccaagttttcaacttgggctgataagtagtgccatcaaatgagaggagaaaatcacgcagctttgaaaaggaaaacagtgagttcagtgtgaacggttgagtttgacatatcaataggacctactggacaattgaatggtcctgaatacaaccctgaagaatggggagagatctaggctagagatgaagacttaactcatccatatctagatgagagtttaaactatgggaggaaatgagacaacccatcgagagttttagaaagaaaactggccatggacaagaatggatccatcagtcgcacaatatcataaatgtacttaatgccactgaattgtacatttaaaaataacaaaatggtgtatatatctccacaatttttaaagaggaggaaaaagatgacctcctagggcatgctgacctttaaaggtcaggtacaagaagaagcccatgaggaaagtggaaaggaacggtcagagataagagggagattgggagagtcacagatgccagaggaatagaatttcaaaaacatgcagggcagagtgggcggatgagttagatcatccctaaggtgcctaccagaaataacagaatatataaactctgggagagagagaatttagatctctaggcttgcccatctagaactgctcagcagtaataaaatggcttaaatttcatct

SEQ ID NO: 94731 - DNA, 1046 bp, Homo sapiens
ggcacatttatttgagctaacctctgagcgtgcaggaagtcatcatttgtggaaaaaaaaaaatccattactattgactgacaatgcagcagactccacagcaaaagaaaaacaaaaattcctggaaaaaatagaatagaagttgccttaaatgcatagccaggctcatgagaaaataggagatgtttccagggcccaaataaagcaggatctggaaatcagatggtcatctgaccctaaagcagtggcttcctgcctgagattttcttatctcagtaacctagatgtttggcttaatagcctttcatgggcccataaaagtttgggagttgaaattgagtcttctgcctaaagctgcctaaagccttgagtgaaagatgggctatgggtttgatgtgggtgtgtatgtttgtgtccctaagaattcataacctctgagaggtctagagttcaaacttacactacttgaggttttgtaaattggaagctgagaaaaagtttggaaatgcttagggatctgcaagaggaaacctgaaacctctggcaggttcgtccctcaacccaggcctcatagaatttccataggtaaatgcctactacacatgagctcacaatcccaaattaccaaaaacccaaggaatattatttattacttgggcccttgggattttatgatacacatggaaagcacaaaagaccagagaaaggatgaggaagtcagtccctgtcagcactattccctttgctctgtccaaagttaacaataattgttaaatagcagatacactgaaaattctctgtgtatcaccatttctcctgtaacatgaaatgtgttcctgaagatatgactgcattatggaattttggcccatgaaaataataggactaatgggggaaatgggttcagagcagaacattcaaaactgtgcgatcttacaaaataatatattaggttggcgcaaaagtaattgcggtttttgccattgaaaggaatgacaaaactgcaattacttttgtgccaacctaacgctaaaaaataataaact

SEQ ID NO: 94732 - DNA, 1050 bp, Homo sapiens
caaattgctgaaaacctccttgaggtctggtggggatatggattgtaaggcagacggatggagagataggagggacagcctttcactgtgcgtttccatgtcttgcccaccgtgagtcagagcaggtcacacatcagctcaaacgtcctcgtgatttcttttctcactggaataaaatccaaagttcgtacctgaacctgcaaggtctttgcatgtgctgtccccgctgcctggacaattcctccctaaatatccacccatgtggctcagctctctgctcctttggtcctccccttttctctttttccacagtttccctcttccctggccctcaaaacccaaaggaatccagggttgggtagcattcacattgcaactcatgcatgtatttgtcattctcattctcgaggggcagcatattttgtcatttcatttcattgtattttgtttattttaggttcgttggggagaaaagggctccacagaagaaggtgctaagttggaaaaggcaaagaatgcaagagtcaagatgccggagcaggaatatgaattccctgagccgcgaaatctcaacaacaatatgcgtcggccttcttccccccggaagtggtactctccaatcaaggtgtgtctctttactcaaaaaatctatcatcagtcctgataaaacacttacatagtgaagaatcaaaatctttccacatgataaaatcccaacctaaaacccagcttatcacaggggaacaattatctaaaattatggacttgaaagtactagtaattactttgtcaatttccacataatctgggttgaaaactaggctttttaaaaatcaccgtggtgctcacttctgcagcacatatagtaaaactggaacaatatagagaagattagcatgacccctgggcaaggatgacatgcaaattcgtgaagtgttccatattaaaaaaaaaaaaaaaatcaccatggcaaggtactggaaaaagcatggactgtgagtcaagtaacttgggtagtaaccccagagagtgactataaatttccatagc

SEQ ID NO: 94733 - DNA, 1077 bp, Homo sapiens
tcatcatcatcattttgtagcttctttcaatttcaacttgtaggactttcaacttcagattgtctcatctcccaaacagctgcaacaacagaaggtcgagtcctggaatcaggttgcaaatagcaaacagagaagtaaatgctaaggctgaaccagacagggatgggaataaagcaaccctgttcaaattctccgacctcattttttcccttccaaacaaaatcaggattgagggaggtagggattagctctagggtcagaattttacccaagtgtgtaatattttaggaggtttgctactttgtctaagcatgatgatcatgtctagccacttggcttctgcgggcctgctcctccagctgatggcaccaaaaaagatcatctcgagggacattcagcatctccgtgatgggcctcaattaagaatcatcagaatccatgctggtgggaagttctgttctggccagaaagtattgggttagattatagatggcaaaatctgacctaggaaataggcttttgaacagtgtggggaagagccagcctgctataaaacatccacacacacccatcttcgttcagcatctccatgaccaccccaactcaacctgaccctcagtctcggagttggactggcagttcctcataatcccagacccttcattttagaggcaccaaagctgaggtctggaaaggtggtctggagagattcccgagccctcccaggtccattatcttatctgttccccatcaccttcttactttatcctctttttaatataggaaagatgaggctcagataagatctctgctcttttcaaggtcacaaagagtgttggtggaaatggcaagactggaaacccaccagctcgacactgcctggctctccttgagtcctcaccccaggccatgagaggaggataagcatccagactcagccttatctcttgaggagaaggcagagttagtccttgccgcccaatcccttcccttcctgtcctcctacctcttcccacctcccagtacctttccatttttatatcctgcccaagatgacatacccattgatatcctccc

SEQ ID NO: 94734 - DNA, 1053 bp, Homo sapiens
tttatgtcacactcatttagcttttgatagctggcttctacctctatctctaataccttgcatatggtagaattagtaaattctttattaaagaagaagaaaaacaggaaggagataaaagaggagaatcacaaagaaagaagtaggggaggggaggaggaggatgggaggagtagagaaagagaggagaaaaccagggaggtgacagtgggaaagagaatttcacaggaccttggacgtggtactttgattgagtgtaggtaagaggcaaagcccagggagcgcagccttgagtacttagtggaaaagaagatccatgaggttctgcgtatatgaccatccaaggcagctcccaggaggtgttcctggcaccatgccacacttagctgcagggcagtgcccattcataaggtgtcagctctaaccagtgagtgcaatacctaagagcaggcgcagactgtgaccccttaacctaacctatgctttatgataaaatagatacatatttatatttgtactattcagaaaacagcatatgtatccatttcttgggggttttcttgtaaacaacataatacaatatccagttagtactgaggtgtttttgagacaaggtcttgctccatcactcaggctggagtgcagtagagtgatcacagctcactctagccttgacctctgggactcaagtgatcctcctacctctgcctcccaagtagctgggatcacaggtgcatgccaccaagcctagctaactttttttaacatggggtctcactatattgcccaggccagagtgcagtggtgaacatagctcactgcagcctcaaattcctgagctcaagtgaccctctcacctcagcctcctaagtagctaagactacatgtgcacatcacctttttttttttttttttttttttttggtagagagagggtctcactatggtgtccagtctggtctcaaactcctggcctcaagcaaccctcctgcctcagcttctcagaatgctggtatgacagacatgagccaccaccacacctggctattactg

SEQ ID NO: 94735 - DNA, 1049 bp, Homo sapiens
aattaatagtcttcgatatctggccatgggtaacctcattgtaactatcatcagaatgggcagagatgatcttgaagtgtcacatacactaaagtccaaacactatgtcagatgggggtaaaatccattaaagaacaggaaaaaataattataagatgataagcaaatgtttcagcccaatgtcaacccagttaaaaaaaaaattaatgctgtgtaaaatggttgaattagtttgcaaactatataaagacatatgcagtaaaaagtctgttaatgcacatcctgtgggaatggagtgttctaaccaattgccttttcttgttatctgagctctcctatattatcatactcagataaccaaattaaaagaattagaatatgatttttaatacacttaacattaaactcttctaactttcttctttctgtgataattcagaagatagttatggatcttcaatgcctctgagtcattgttataaaaaatcagttatcactataccatgctataggagactgggcaaaacctgtacaatgacaaccctggaagttgctttttttaaaaaaataataaatttcttaaatcaactcttttttctggttgtctgtttgttataaagtgcaacgtattcaagtcctcaatatcctgatcataataccatgctataggagactgggcaaaacctgtacaatgacaaccctggaagttgcttttttaaaaaaaataataaatttcttaaatcaactcttttttctggttatttgtctgtttgttataaagtgcgacgtattcaagttctcaatatcctgatcataatacagtggttgctgtgctatacattaaattacatttctcaaatgatttcatgccttccactaatttctctactgtctggattactgtcatttcttccttagctgtcagacattcaaaatattttttatttctcataacaaatttcaaattaaaaatgtaatccatgctaagagaaaataagtaaaaagtgaaaacagaacacacaggaaaaatatactgcatcagttaggat

SEQ ID NO: 94736 - DNA, 1327 bp, Homo sapiens
ttttccccttttaaaaaaattagcatataccatagcaataaaagaactaatgttaactattgtatgctacaacttaagtgatttttctaaagaagcacaatgtcattgaaagtattattgaaaaggatcatagtcacattgaatttgtgaaggccaaagaaattgaagggagtgatattttcattttatgatattcacatatttagtaaattttgtgtacaagaataccaggcagagtgttttacccatggaaacaggtttcagattactttatttttactgttagagtctcaagtttagaaatgctaacacttaaatcagtttttttctcactatacttgaagattgttaatattttgatatcttcctagcttgatgaatttaaacatatcttcagatctgtgacagtgacagccaataggactgataatattagcttcaaaccaataatatccagggttaaaataaaaatcatagtgaaagtacgattgtaaaattatgctatattaacttttaagtctgtaataacttgacatcaaaatgttatgtaattaccataaataatggctagcgagaacatctttggaaattctcaaattacctttcttactacactgtttgcagaatgaatgtagaaatgatcctgttagctttctgaatgttctgtggttgaatgtgtttttgcttaaataaagcttttggtatttgtttaaattacacttcttgagaagtggaaattttaggatcatctttgctttgtttcagttttgtgatttttgaaatgaatgtttagtttactgagccagttggtcatttcttcctcatgtcgttaagtccagtgagtaagcctgaactgtgaataaattaccaaaaacttgcttagaatttcattttgaagcaatttgctaatatttgaagtgtatacacatttgtagttatgttagaaattgtattgtactaagaatgtaatcaatgtctactttagttgtaaacatttctgatgtcaaaactttattcattactgttgattttaagaataagaaatcactgcctaaatattaccaaaagccactgtctctacccgaacttcccagtttgggaaagaatcgttagataaaacaaaggctctgccctttctgataccaaactccacagatactttctcacatcttttaaaacattttgcaataacatattgtttataggaagtttacggggtatgcaatgattaaaacttttaagtgaattgatagttgcaaaagaaaggataatatttaaggtcagtgagtagcaagacaatctaaagtttctgtaatatctggctctc

SEQ ID NO: 94737 - DNA, 1125 bp, Homo sapiens
atgttgggtatcctactactttgtgttttcatctcctaaaagtggtttttatttccttgtatctgtagtcttttattttttaaatgactgctgaatgacatattttatcttgttctttaaaatcacaacacagagctgctattaaattaatattgatatattcagtattctcttcaactttgtcacgaggaagaatttcctgtagttaattttaactttccttcattacattgttgcataaaactagtcccttagtgccagtttggaagttacttgcaattgtttggaagatttgcaggtcgctgacctcatcatttcactctaagtatatgtggtaggctaagctcagaaaaaggtatgtatgctttacactgataggcaccaaatttagtattgtatcctaagtatttttcctcttctgtattttctgtgctctacccctgaaatatatttaggaataaagaagatataaataaagtgatattggggtatgttcagcttgtaagtgtcagaaatggaagttgacaatttggattaaaatatttaaagtagaatgttattatttgatacccccaaaattgtgagtaataatttcttaatggagcttttctggccagatcttcagggctataggagagtgtgtttgtttttggtgaagtccttctttttcaaaggtttttacttttaaattgtgaagataagctatttagcacaattatttaagtaagctgttttttcctttcttttctttcttttcttgttttaacttctgggtgaggttaagattttctaatagttattgttgttgccagagaagcatagaattctgcttgtgtcttagggttagagaaagatttgttatattttgaggtaatttggaaggactttcatacatggtgactagaaacctgatctttttaagaataaaatagggtcactatttacattatatataatatatggctattatagctatattaatctactttaattgtttctaagattattttgtgtaagtcagctagcgtgtgtatagtgtcatttcttatgttttgtatattaacgttttacaaacacaatttgtgtgggtttgtagcatttcttatagtttaaagtatgattcag

SEQ ID NO: 94738 - DNA, 1025 bp, Homo sapiens
ttgcagtgagcctacatcatgccactccactccagcctgggtgacagagcaagactccgtctcaaaaaaaaaaaagcttgtctcattcacttgttgtaactgcacatttcaagtatgaagttaattaaaagtgacttttactgttatttttttccacagagtaaaatatgttcacccaatcttttaggcagtcatgtctattgcatgaacttttgttatattttatttaccaagattatattaaaggaaacttttagttgtgtacaaattcttttatttgatttgtttttgttttaattatgtgatttctattactataggcaacttcagttcatttatgcagaaggaaatatttgagcagccagagtctgtcgtgaacacaatgagaggaagagtcaactttgatgactatactggtaattacatatgaattattttattatttcagtgtctctgacagtaggaggtgccattaacaacctgaaagttcattgcccttaatagccttgtagaacaactacagctgccagccatcagtggagcccagccatcttggaaaaagttctttagtgtgtgattctacctatataagatatctagaatagtcagattcacagaaagagaaagtagattaatggttaccaagggctgtggggaggggaaatggggagtcactgtttaaagggtacagagtttcagttgtgggatgatgaaattacagaaatggattgtagtgatggttgcacaataatgtgaatgtgcttaatgccactgaattgtacatttaaacatagttaaaatggtaaattttatgtgtaggtcacccactgtgtaccagggactgtcctaggtactgtgaattctaagaagaataagacctggtcccgttgctgggcagcttatgtgtatctgcctggcctaggtttcctttctgagtgtataaataagtaaaagtgtgaacttccccagaggtctttcagttatttgcctgatgcctttggataacctgtaccctcctgcatttt

SEQ ID NO: 94739 - DNA, 1010 bp, Homo sapiens
ccagattcaagcgattctcctgcctcagcctcccaagtagctgggtttacaggcacgtgccaccacgcctggctaatgttttgtatttttagtagagacagggtttcgccatgttgaacaggatggtctcaaactcctgacctcaggtggtctgcccatctcgacctcttaaagtgctgggattacaggcatgagccaccgtgctcagccggattggtagtttttatgtaccagcagtcgctacaaataatgatattgtcaactcttgattatctgttcttacagttttcaaaattagttaaaaaagatgaaaattatcccgagatcatgtctattttctcttggaatgatattttaacatttatgtttctgacattctatgacttatttggatctcaaacaagtaaatttaactatggaactgattggtttttcttagcaaattccttagttctagttcttaaattcatttagtgtaaatcagattattgttttagtttgaaaggacttctctttaaacttttactcaagaatgaatgaacagagaaataagaagaatatttagttcagctctctcattttgcaaatgaggcaacagacccaataaacttgctcctttcacatgggtaacatttgattactagtttagccacaactgaaattgttatctctagacttcctgtttatttccctactgtacccacctcccctgcactgtttgcttcagctatgccacataaacaatgctgctgatctacctgatgataatctggtaaatgagaagtagatgtaattatgttataaataacataaatagtatatagcatgttaaaaatttttgacttgagaaaaatccagttagagtaatagctattttagatttatcatacttctaacttttttgtcttcaacacttttacctcttttagaatttatcgttattcacaatggaatcatcaccaactacaaagacttgaaaaagtttttggtaagtaaggtgacctcaaaag

SEQ ID NO: 94740 - DNA, 1065 bp, Homo sapiens
ttcctaagtcttttttttttttttttgagatggagtctcgctctgttgcccaggctggagtgcagtggcatgatctcagctcactgcaacctctgcctcctgggttcaggcgaatatcctgcctctgcctccggagtagccaggactacaggcgcgtgccaccatgcctggccaatttttgtatttttagtagagatggggtttccccatgttggccagactggtcttgaactcctgacctcaggtgatccacctgcctcggcctcccacagtgctgggattacgggcgtgagccactgcaccctgcctcctaagtcttttaatcactattttgaatatgcctgatctttagtttcagtgattgtatattccaagagagcagcattgtaataattgtatttaaatatagcttatagcattatctctgcagcatgatttaatattgaaatttttcttttcatattcttcagagcaacaagatatggatttggatatagaatttgatgtacaccttggaatagctcatacccgttgggcaacacatggagaacccagtcctgtcaatagccacccccagcgctctgataaaaataatggtatggaaagattttttgtgctttggaatgattgtggaaacctaataatgggggcagaatgaaggcttttagattttcattattttaataatttttcatctggaaaatttcaaacattcagaagtagtagagagcatatggagctgagagtgctggctcatgcctgtaatcccagcactttgggagcctgagttgggaggattgcttgagtccaggagttcacgatcagccgtggcaacatagtgagaccctgtctctacaaaaaataaaaaaataagttaggcattgtggtgcatgcttgtagtctcagctactcgggagactgaggtgggaggatcgtttaagcccaggaggtagaggctgcagtgagccgtggtcacacctcatgccattgccctccaacctggacaacagaatgagaccctgtctgtccaccatgcctggctaatttttgtatttttagtagaga

SEQ ID NO: 94741 - DNA, 1058 bp, Homo sapiens
gaatcattcaacaagtccttcaagccattcaacaagtcctttgaggtattccacacttctcctgctttctcacttacattcagtcagttccacttttcaatatcatttatttctgtctgcattaccactgtttagttcaggtcctcttcatttttgctttgctgtagctgtagcttttgacagctggtttcttccttccgtttctctccctccagttctttccctacacttgtttctagaagggctttgctaaacatttttgccgaatcacttctctgcttaaaggacagtgttttcccagtatcttcagggtagctttttcaaattccttagcaacttaaggagactcttaagagatgtattctgtgaccttctttccttagctaccttctgaggtgggtgcccatcttttgcatttctccattgtatcccaattgtaacctgtagtatttttattataattcataatcacgctgaattattttttccttgtctgtcttctcgatagacttagaaatttgaggacaggaatggagttatttttgtttttgtgtctagcagctatcctggttcttgacacacaataggttttcagtaggtaattgaattaatacattagtgaattaattagatgagaatgtattttttaattaaaaattttgcctcacattaataattttatcagtagccagtttctaaattttgcttttttacctcatgatggtttaggtgtgggatttgatggaggcaatgataaagattgggaagccaatgcctgcaaaatccagcttattaagaagaaaggaaaagttaaggcactggatgaagaagttcacagtaacgtacttaatttgatttttgtcccctttccccttctcttccttttcccctccccattctcctctaagttactccctccccccatattttgggaccaattttaatgataatggtctgtaacattgaagggaggaaagaaaagtagttttgttactgtctggactagttttaaaatgtacctgagcctgaaaaataatcattgcaactagggaaggaaa

SEQ ID NO: 94742 - DNA, 1013 bp, Homo sapiens
ttacatctatatttagtatggctggcattttgaaaaccagtaaattgagaaactgaagatgtaacttaacttacaaagtaggtgtgcctttttgtctcaaagtttccatcaaaatcagtttcttttctctgatactttcaatccttgagaacagagaatgtctgcatatttactggcttaaaatttcataccctaacatcattagcatatcaagatgttttagtgtactcatctttatcaccagatgttgagttgattggtattccctaatttttcttcagataatcaaatgaatgtttctgtcatcaatttcccaaaatatatctccataccaagttacatgttctttctatagttttatgtttttaatgaaccatgtagttaaaatcattctgttttaatactcgtacttgcatggctataaaatttctactcttgatgtttttatatgtaattatttctaggatctgaagaagatgatgaagttgtggcaatgattaaggaattgttagatactagaatacggtacgtgctcctctctctacctgaattcaagtgctttggaggcatttttcattatagcaatatagttttagttggccatgagattatagtagattttcaaaataagtgcaagttaatgtaaaccacaacaggtagccgtgacaattgaatttaaagcctgtatcttctctacatttactcaaaattttaaaacatccaatttatttaaacatattcaatgaagaaatgtattcttcacagtctcaatttagatttgatattgttataataccaaatttcttaaaaagaaaaaaaaaagacttaatgtttggcaaggttgtgaagagagaatgagtacctattttcagtatattgcccatacagaataaatgttaagtgagtggagaacagcaggcttctacttttgcttgtagcagaccaatagtcatgctgagaactcccagaaaagctggataaagtacaataaaaagaatttgtttgaaagcatt

SEQ ID NO: 94743 - DNA, 1420 bp, Homo sapiens
ttgcaaggatattgtccaatagatctatgaaatctcagtatgttgtataacatatcccctgcaacacaagagttgctcaataaatgatttccaaaatgaaaatactgtagaagttaaaatctgactgggtgtggtggctcatgcctgtaatcccagtactttgagaggctgaggcaggttgatcgcttgagcccaggagtttgagaccagcctgggcaacacagcaaaaccctgtctctacaaaaaatacaaaaaattagctgggcatggtggcgcacacgtgtagtcccagctgcttgggaggctgaggtgggagaatccctttagcccaggagttcaagcttgcagtgagccgtgatcacaccactgtgctccagcctgggtgacaaagtgggaccctgtctcaaaaagaagtttcaaatggggattgtgtttcaaagaattctatgtatttaaagctactgctgtcctttttttggataagaatacccttaaaattagtaaatttctggctttcatccagaccttagaacacaggattttgaatgtagtaaaaaactacattcaaaaaaaagaaagaaaagcttttttgtcaaaattaattactatggttttgttaataatcttgattgttaacgagatatatactttaattttctttaatttgggaaatagatatgatttaaaataatttgaagtgtgatgactgtaatgtagagttagggaagtttaaggggagagggtatgtgtgtctgcatgtgtgtatgtatgtaaatgtatacctatatgtgttatggagctgtaagcatataaattcagcctctcctttccattgctagcttgaacacattcctgtggccatactctggctgattctggctaagggcgtgagttaaatcagggtagaccttaccccttctgtagccaggggccagaagaggaacactttcctgcaggcttgcctgactgcttggatcacagaatagcttagatataaatattgtaaatactgagtaactcagctgattaaaccactttaattggacttttaaactttgtaggactgaaatatgtggtcatataggcttttcaaataggaaacccattaattttagtcattgatattgactttaagcaccactaatctgtattttgggggagtttacatctacctccttaggtacctattagtaccaagcataataggaaaaaataggctggcatggtggctcatgcctataatcccaacactttgagaggctgaggcgggcagatcccttgagcccaagaagttcaagaccagcctcagcaacatggtcaaaccctgtctttacaaaaaaatacaaaaattatctgggcttggtggtgcatgcctgtagtcccagctactcaggaggctgaggtgggagaatcacttgag

SEQ ID NO: 94744 - DNA, 1842 bp, Homo sapiens
tgccccacttaatgatgagggagacattcagagaaatgcatccttaggtgattttgtcattgtgtgaacatcacagagtgtacttaacacaaacctagatggcacggcctactacctacctaggctatatggtccagcctgttgctcctgggctacaaacctgtacagcatgttactgtactgaatactgtaggcagttgtaacacaatggtaagtatttctgtatccaaacattttagacatagaaaaggtacagtaaaaatatggtataatcttatgggaccatcatggtatatgtggtccatcattgatggaatcgtttttatgcagcacatgactgtatataatcaacaaacaactctactttcttgttttcgtttgttgtgtttttgctttacacatttgatagggaacatagaagttgtgacctttcatttcagtggaaagcattgagccagaatatatttattcctaaaccatcgagccacacatgcattgatgaaccctgaaagaatccacagtaattgactaacaggcagtactgaatgaaagatgtcatatgtggtgaaaaatatttaatatatcagtttcttgggctcacatacagccctttagttccaagtgcttggttagattagaaaatgggatgaacacaatttgatgctgaagcagctgctgagcagcacccagggagtctaggtcatacgccctatattgttttcggcccacttattgttgagttgaaaagtctcatatttgtagactagagtgtatgtgtttagaggctcatgttgtatctgagttttctctggcaactaagatctctttctaaacgttctagaaagatactggtatcttactggcccattatttagtaagttttagaatacatgtacatcagtgttttcaactgcttggtggacatttcactgatgcataatcaaagtagcagattataatcatcagagtgatctgacaaggaaattctgtatttgcttccataaagaaaaataatcaaaacatatatcagatataatatatatgcagtatatcacataggaaattttattgtaggaaattagagaaggatgctactcaattcattctctagcaggaagaatacagcttaaaaatcacttgggtccctttaataaagaaaagtgtgattctgtgttgtgtgtttggaactgaaattggagaacacgtgccagtcgactgtgaaatggttgctggataaaaccacagatgtggttttatccgagaaatgtgggactgaaattattttgatgagaggtacataagagagctgcagaaaagactgtagcttctgaggaggcaggagtaccttgttaatatccaaaccacccctgagttctaatgttccaactccacctaaacgaggaattggaaactttaaatggaattatctaatttaaattcttagttttttctttgtctttctcagctgatacttgtagttttgttttgttttttaaccaccaagaacacttgcaagtttgttactgaaaacatcactaaaggaaaagaagagtttcaaaatgcttgaaaagtagtatgtggttgggaattgtttttgttcaagtccctggaagtcctcttggcttagctcccttgttcctgttcccacttcatttccttacttaacattcccctattttgagcatgtcaataagtgcatgatgaatggcacagttgaatgatcatgttaactttaattgcttcctttgttgctgtaaacagtttcttgttaagtttcagccaagtctgtgacaatctcaccaaataagaatgaaatgggcggggtgtggtggctcacacttg

SEQ ID NO: 94745 - DNA, 1006 bp, Homo sapiens
cgccactgcactctggcctgggcgacagagcgagtctaaaaaataaaattaaataaaataatgaaaaaaattagctgggtatggtgacatatgcctgtagctactcaggaggctgagctggaaggatcacttgagcccaggagtttgaggctgcagtgagttgtgagtccagcctgggtgacagagtgagacactgtctccaaaaatataataataaaaataaagcctgtatctcaatgggaagatttctgctaaggcagttcaactcactggaaagaactgctgcattaggtttcaactttaatgctttctgttacttctagtaaaggttaagtgatttttccattagctgtagaagtttggagagctatttaccaagccagatcaatgatttaaaaattattggaaattcatctaagaatcaagtctgaatgcccaattctattgcggttgattaggtgtgatattctttaaagttcaggaatattggcagtaaaaaatgagcagctacttttcaatactttgtccttttttggtggtctctgcctatttcaaatgtcctgatcaaaagataaataattggcactgtgccaaggtttggttttccaactaaggtttcaactgtgccagaaacctatgtccttcactttggtggatgctaaatgttattctaagaatatgctttttcccaattctcctttctgatttttatgtattagtggatgcaaaattgtctttctagttgaatgaataatttcggctaatgcacgtggaactttgcaccccagattcttcccatggtcattatcaagtgaagccctcaaaaacatgagcgaagagcctagaaatactcagggagatttctcaccccaactcagaaattttttttttttttttcaagacggcgtcttgctctgtcgctcaggcgggagtgcagtggtgtgatctcggctcactgcaacctccattttccgagttcaagcgattctgcctcagcctcccgagt

SEQ ID NO: 94746 - DNA, 1039 bp, Homo sapiens
gaaagaagctgtctcaggccccatggctggcaaaccattccgcccccagtccttatccaagtattcccgtcactatagcccagaagacgagccaagtccagaagcccagcccattgctgcctacaaaattgtttcacaaaccaacaagcagtcgatagctgggtctgtttctatcacatccctttcctccaggactacggagctgccagctgctgatccatttgctctagcacccttcccttcaaaatcaggcaagaaaccctaggagcaaaacctgagcctcaagcctcttgtctctatcccaccctcaatacccgccatggcactcccagcttagccttctgaagaagaaatattatcagttcttatatttcaattccctgcgtcagagcagaatttcttgagtcaacaaactcagttgcagtgatatttagttgaagcccctttaagttatgttcatttttgtttgtttgtttgtttgtttatattgatttctggacttggaggcattttcatctccttcacagaggtcatccacttccaccaagaactctgctttccccccgccccacccacagaaactgtttaaatcctgaaatacttcttcaccccaatcccaaaggggccctattgttgctagttttaattcctgtagctcctgttctaagtcatgcccatcgaagaatcaagattagtccctccactaaatcaagatttagtactcttgaaaaggggagatgtctggaaagaagagcaagataaaaaccctgcacatcaacaggaagtataatcctgcagttactaataattcctgtagaagcagcagctctaggagtctccagatctgattctcagtctgtgtgcaagccaggctggctctcgtgcatgactgtctatgggtgtggaatgtacgtcagagcctgtgtagagatacaggcagatgggctaactcctcatgtctagtcatgctggcagggctttccccacatccatgcttttgaaattagtgtgagtgtacaggtttgtgtgtgcatgtata

SEQ ID NO: 94747 - DNA, 1051 bp, Homo sapiens
tccctctgcatgtggcgcggatgaccacatgccagattctgaattgagtcatccccagacagtgtttctacataatccaaaactgtcatggtatatgtggagatgaatgactgggtttgttttcattccataatgagccagtgccaggtagagcaggtgtccgtgcctggccctgtgtgtaggagcattgcatagttacgctgaatgtctgtgtgcctaacatcttcatctcctttcctgtacgtcgtgcctatcatgttccaaaacgtgagacagtggttgattgtgttccagtttgtgtgcagtttccttgcctgacttttatttttatgtttttcctgttgcattttcaacatctattatttggtcccacaatgtttttgccgcgggttgaccattaaatgttccaaatagagttgaattgacctacacattaattctgcattttatgcttttctagatctccagagggagtccaatccctgtcctgtaataactgtagagcactttaaagaatcactgggtgttaaaggccttccgctgtatccagacccctccagagtacctggcacaaagactcagaacaacttagaatctgactacttggccagagatggcccttcaagcaacagctcattccacagcagcgaagaggaagggactgaccttgaaggagacatgctggactgcagtgggtctcggcctctccttatggagtctgaagaagaagatgagagctgcagaccccccccggggaagctgggaggagccgttccattcgctccaccagaagtctctcctgagcaagcaaagacagtgcaaggtggaagaaagaaccagtttcaagccttcacacagccagccactgatgggctcagtgagccagatgtttttgccatagctcccttcaggagctcaagggttccaaatgatgacatggacattttctccaaagccccatttgtctccaagagcagtatggctccttcccagccagaggagtcagacgtgtttttgagagctcctttcactaagaagaaaagcatggagg

SEQ ID NO: 94748 - DNA, 1102 bp, Homo sapiens
cattttttttccctaagagatattttgctctcctgcagaacaagcttaataacatcaactttcaaggtagttttggaagatgagaaattgtgcttttgttttggcaactgaaaactttgtccaactgatactatgtgaggaaggtggttcaaggagttttagggccctcttgtccttctttaaggctctgcaaaccttattttggaaaacttatttttctcccttttatttgaatttcctcccagaaattatcatcttggtatcactgagacaaatctaatatcaatttacttgcctgagaaattaggattatgtctgtccacataaatcgcaaggaagaaggtattctgtttatttcctgtccactgactgatgctttcgtatcaccatgtagctgcacatactaaaattataatacaaggaaaaatttattcttttcaaaatcttattcttcaaatactattctgaaagccatttggcaccagtacagaatttaacttaacgccccaatctggaattcactgaacgcattcaaactgttagaaaggaaaataaaaatggaggacaaacacatttttgttctgtttctgaaaacaatatttaaggtcagaactgtttaaaaagaagcactgctaaaaagttataggattcagagaaacatagtatttttgtacagtatcttataaaatgttcagacctctctctacattctctttacaatgtaatgtctctaagtgactggtttcccaataaactgattttaatgcctcttctgctgtggtctgtgtgcttaattcatgcagaaactttagcaggggataatttttggcagaaatttctgctagctaatggtttgcataggaggggagagggtcagtatgggaaggggatcattgagttccatctctacagaggttctgggtcatctatggctccaaatcattgtatctaatattcttatcctggtgggttgggaaactccagtagtatctctttactgagcccatgatgaaatgatacctttacccccaaccaccctttctctggattcttcttgcttagttacatatgcctttttcctgccctcttgctaacatgtgcc

SEQ ID NO: 94749 - DNA, 1055 bp, Homo sapiens
cgaagggctctctgtggttggatagcagtgaaaataggacttggtttacccctttatggacaggaaaattgctgcaggtcagaattgtattctctttcctggacatagaaagaatgtataaattaatgaaggaaatgtttatttttaaataagaataatgtttgagttctatgttttcatatttgatttttttcgtatatacatgttagaaatataatgaaatatctagtttctcaatttaattgaaactatgaagagtacagtttagaaattaggtatctctaaattgttcttttcatatattacccataattacattgaaatatattatctagtcatttggctcagtaaagcttaatggaggcagttaatgaaaatgagcagactagaagccagagacggcagtagaagcctaagggagataatgacaagaaattgtcttgggcttatttagagtaaggcctcctcaaaggggagaactatttttctgttaaggaacacatatgagtgctttggtaaacggagccttccttggtttagagcatcatccctgagctgaaagagtttatttgagttgagcatagtgtcctggtacctgtggaatcatagcctgagctacaaagggacctttgagaccatcctctagtccaccatcctcttcattttacaggtgtgggacctgagctggattgaacagggtcgggggagaagaggcctgggcaggacaggccacctgggatctcatcctggcccttgccagccactggctgagtgaccttcagcaggcacttcacctctcagagttgctgttccttagagttatacgatgggtttggactagatggtctttaagattatagaagtatagggtcctaagtatatattattatattgagaagggctatgaaggatttatataatcctgatgttcttcagttatcttctgtagttcctgctattacggtagcagtgtttacattttaaagaattataatgggcttttactaacttgctctttcttgattatctgaatagaagcctaaatcataatctta

SEQ ID NO: 94750 - DNA, 1033 bp, Homo sapiens
tgtagggacagaaagcagatctgttgttaccagggtctgtggtgagaggaaggcactgactgtaaagggttatgaaggaattttctcaggttttggaaatgttctgtatcatttcagtggtaatgatatgaatgtatacatttgtccagactaaccacattgtacacttaaaatgggcgacttttattgtatgcaaattacacctcaaataaaaacaagcagacgcacccaggacagcatcttgaatgccttacaaagtgactacttcacttgaggaagtaatcatttttaaacttccaattttgaaaacctgttgttaacaagatattaatagcattcatttttatggtgaacctgtaccaaatattgacccctaaaatgtgtttgcttaaagaatagtgaatgatccgctggctttaatatcttactacatttttgctttctttttgtctctctgcccaacgtagaaaaactaattgagggactcaaatctcctgacacttctcttctgctccctgacctcttgcctatgacagatccttttggtagcacttctgatgctgtaattggtaaagtcatcatctctgtttcttcagtcatgcatgatatgtgtgcctgtttcaagaatgacaagtacctagttaaccaatccctggggaatagccctgccaccccagaagccaaggctatttaatctcacttgtatcactccaaatgaagtgttttccttgcttttcgggggtacaacgtctattttttgcctttcttgatatctggagatttctagagtggatctcttatgaatgaggaggaatgtggaaagtttcacatttagttagaagaactttaaaaaattggtttctaactagactacctttactgaacttaatgaaatttagcagattcttcttttttttttttttgtttgagacagagtttcactcttgttgcctaggctggagtgcaatggcaagatctcagctcactgcaacctccatctcccgggttcaagcaattctcctgcctcagcctc

SEQ ID NO: 94751 - DNA, 1221 bp, Homo sapiens
caggaggatccttgagcccaggagtttgaggctgcaatgagctatgatcacactactacactctagcctgggtgtgacagagtgagaccctgtctcttaaaaagtgtgtgtgtgtgtgtgtgtgtgggtacacacacatagatatattttagaaagattgaggaattttctctgaaaactggggacaatatttttaaatcattcttttaaattgtagtaaaatgtacataatgagatttaccattttaaccatttctaagtgtacagttcagtggcattaagtatattctcattgttttgcagccatcactaccatccatccacccaccttttttcaacttgtgaaactgaaactctgtacccattaaacaacaactctctatttcccctccccccagcccctggcaaccaccactctattttctgtctctatgaattttactactctaggaaccgaatgtaagtggaatcatacagtatttgtccttttgtgactggcttatttcatttagtatcatatccttaaggttcattcatgttgtaggatatgtcagaattttcttcctttctcaggctaagtaatattccattgtatgtatataccacattttctttctcctttcatctgttaatggacacttgggttgcttccatcttttgtcttttgtgagagatgcctctgtgaacattgagtgcacaaatttctcttccagatcctgctttcaattctcttgggtatatacccagaaatggaattgctggatcatatgctaattctatttttaactttttgaggaccactgttttccatagaggctgcatcattttacattcccaccaacaatgcccaaggatttgaggaaacgatctttataacaagtctgcagtactgatctcggcgttccacagactaagcaagaagacattcgttgccccatcagtgctgcttcttagaattaaaaacttttttaaaaaagtgcctcttggtttatggcaattcatcatctcttgagaagttaagcaagagaagctgtgttttctcaaaagtttatagtcaagacgggcattcttctcataacttttggcctggcctcttcctcatttccaactgctgtctcgtgatactgagaagtccaaggttgatcataatatgtgtttttactctggaaagcttatctttctgcagatttaattctctaaaatgaacttggaatggggcat

SEQ ID NO: 94752 - DNA, 1016 bp, Homo sapiens
tagcagattcaagccccagtaagacaacagccaaaggttcagacaaccccacctcctgccgtccaggggcagaaagttggatctctcactccaccctcatcccccaaaacccaacgtgctgggcacaggcgtattctcagtgacgtaacccacagtgcagtctttggggtccctgccagcaaatcaacccagctgctccaggcagctgcagctgaggccagtctcaataagtccaagtatgtggtgcttcctctttgttgttcttacctctgtgggcaaagtctgcctgcggctgttagtgtgtgattctttgcataagtgtgtagatgtgtgtaatgcaaatacagtggtgtgtacttgtgtttgtttatttttctggtttgtttatttttctggctcatttcatcttgcatgtacttgtgtttaatgagcagctgtgaatttgtctttagtgcatgggccatactaatcttaagaaatcttttcctacttggcccactgttctcattctctcacctgttccatgctctacagtgtgttttctgaactctcgatctgaccgagtctctccacgctgaaaagtctttcactggctcctcatgatagctgagcacactgcttaacatagcagggcctgttgtgtttcacaggcagacttgccattcttcaccttcccgagccctttgttcctcctgtgccctctcctgggactgctatgctcctccttgcccacctagggaatgttcatttattcatcaagatccatgtcagaggttgacttttccttgacccttcctctgatatgatgtataatttttgtctgaacatttttttgagcttatatgacattgtgttgtcgttaattatttgtatgtctgaccgaactggtttgtgagttctccaagacaatgaccatgtcttagtcaacctttggaaatccagtgactggttctgtgcctgacaagtagattttgatgagtgttgagtaaatgcagtttcagacccttaactgtctt

SEQ ID NO: 94753 - DNA, 1082 bp, Homo sapiens
aacattgtgagactgtgtctctacaaaaaataagaaaaaaaattagccaggcatggtagtgtgcacctgtgataccaggtacttaggaggctgaggtggaatgatcacttgagcccaggaggtcaagggtgcagtgagccgagattgcttgcaccactacatcccagcctgggcaacacagcaagacactatctcaaacaaacaaacaaaaggaagcgtcatagagcacactggctattttgaatgtttaaggaagtttaataaaaatggagctcttgggaaataatttttagtaagacttgagatgagtcttaatagttgagttaacatttaggttattcttttcagtgtcatcattgcttcatcctgttcaggtagggaagcattttaatcttggctacttcaaatccctttataagaaggattacctctatgattaggagatcgtttattagctcctgctatactctagcttatggagtcacatgatgtttagtcagatagcttcccttaggcaaggcccagaaacccacttggaaggccagtctgtagtgcaggaggcagcctggtgcaatggatggagcctagcagtgtaagggactgctgctgtgttgtattttaattccctgaggtctctatcatgagattttaggcctagcctcaagacttttctacttgcccttgcctttggctttagcactggtcttcattgtttttgagacatttgtcttttgtgactattattctgggacaggcccttattcatctcctcatttcttgctcagtttcaggcagtacatccagcaacccagaaaccagcaattgctcagttccctgtggtgtcccaaggaggctctcaacagcagctaatgcagaatttctaccagcagcagcagcagcagcaacaacaacagcaacagcaacagctggccacagccctgcatcaacaacagctgatgactcagcaggctgccttgcagcaaaagcccactatggcagcaggacagcagccccagccacagccagctgcagccccacagccagcccctgcccaggagccagcggtaagaatcaaccagagc

SEQ ID NO: 94754 - DNA, 1010 bp, Homo sapiens
ccgaggtcagttcgatttcgagaccagcctggccaacatgatgaaaccctgtttttcaaaaaaaaaagtacaaaaaattagccaggcattgtggtgtgcgcctgtagtcccagctactggggaggctgaggcaggagaatcgcttgaacctgggaggcagaggttgcagtgagccaagaccgtgccattgcactccagcctgggtgacgagtgaaactccgcttcaaaaaaaaaaaaaaaaaaagaaaagaattgtatcgcaaatggctggcaaaaggagaggcctccttgaattctgagatggatctccaaaaccactaaagccctttgtcgctttttctagacttggccctgatttttgcagtttggaaccttatcctccctctttatttcatatatttccctttgcctttaaagaaataagactcttccaaagtgttgagttcagtccagggcagcttccctgttctgttaattaaactttgggacattgaaatgggctaggggagatgattgggtagaaagcattattttattcatttgcctcccagcctacaaaaatgcctgcttgggtctaatacatcaacagttaaagatgcctggaagagacaggactaaagaggctgaagagcttggactagcagacaacttactttcaattttaggaagtttggggtctgatgggctgagatacaaagaaactgagttattttcatacatgcctaaaaaaaaaatagaaacaagactcctctcttttgacattcacagaagaatattgtttctttaatgctttgtctcttgaagtatctaacaccccctcatgttttggcattctgtttctaatgaaataagtaagctttgtttcataaaaaggattgatccaaaatatcgagtaactgaaccctaccaggaagctgcttttggtgaatttggtggccatctacttatagccacgcatccagactgggataagctacatgtagaacaccagggaatgatgttgtcatgct

SEQ ID NO: 94755 - DNA, 1015 bp, Homo sapiens
tcattaaccagatggtagaataagtaatctttaaagaaaaaaaaaagaataatatttgcacaaagcccctatactaaaatgctaaagaagcagagatttttatcatctttccacattggtcaagactcttaacatctaagttttaactgttatggattgattataaatcctgagtaacccatttgggtcctgcatggggatacactggaaaaaatagaagcagcaaatgtgggtggagcatctgacatttgttgagggcctacttatacctcatttaattcttaaaatcctttatgtattaagtgtaattattcccattatgcaaatgaggaaactgaaactgagaaaatgtaggtaacttatccacttaacatagatacagcttttaaggtgctgcccattccattgtgccagttttgtcaatcagcctcttccatttattaacaaaaaaaggaggaatatttaaagggctggattatgacatttaataattgttggattgttttaagagataaagcattatgtccatgttagaattccaggtatgtaagtgagattggtaggaaatatgggaaaatggccaactttgatattagactagtattattttttgataatttttaaaacatttatgcagtaaattcatattgggaaatacaactctttatgaatgtctataccatggacatctttcccaaactgcttgcaaaccatttggcaactccactatcaccctaaacgcacagatctaaaattaagtttatcatcattagccctccttccttctttttaccctcaatacccagttcgcctgtcctcttttcagtttctctcagtggtatcaccattgaagcctggaagaatgaaatttaagatttctttggatccagctagcaagagaggaaaggttcagtcgtgtactcggccatattccttttttggagtttctactgttttcattacattctttatatgaacatcactgtcaccatagtatatacagactctgtcagct

SEQ ID NO: 94756 - DNA, 1300 bp, Homo sapiens
agtgacttaatcactctgagcctcattttctccatctgtgagagaaggataataatcatattgggattatgaggatgtagtgggataatccatgtaaaatgctgagtacagtagtactggcaataataaagctcagaaaatgatggctgttatttttataacctctaaattagattgaaaacattagcgttgttttgttggaattattttaaattcctaaagtgtgtatatgctcaggaagcttgactgtgtcactttgtgtaaatagattaaactggtgagctttataaaaaagacatagatgatggaaatatttgcgtgcctcagccttatctcaaaggaatgaatctctcctaatctttcataaccctatgcttaagaattgttcatcatagaacatacctgtgcaggttgatggctgtagttcaaactacctatgtggctggaaattccaaggtcaaaattatagattaaagtgattccagggtagtagtgcccccagctacaccagtatatcctctctggaagaacaatagactttaaacccagatcttacaagctttttacagattaagttccaaggaatgtaagttaacaaaaacaaaaagctcctcacaacaccaccataagcaaggtttagtaggagtaagaaacaataaactgcagaatcagttggcagcagagacttcaaatattggaattggcagatacagactataaaatatacttaatgtaattcttagaagaattaaaagaaagtatagaaacaagtatagaaattagagactattataattgaccagttgtttttaaaagaatcagtagtagtacagtagtacggcctggatatttggtggctcctatcttgcgcctgacacaccaggtttgcacacacatacacacacctacacagtgttttttggtttattccattcaacatacattttttataccaagcattgtgttaggcactaggtagagaagaccaagaatatgattataagaagatgcttatctttaaggagcttatctttcagagtagactattttatagtctactcttgcctttgttttccaaaggtgatcagtctttggaaggctgaaggcaaaagacaatggagactacagtcttaatggcctaacaagattttttggctgccattttactgcccacacatagccaggtctgtcctccggcatactagtcagctcagttcacctagacccaaaatcagtacaccttgagtacatagtgcccactattttggagttgtcatttcatttgtagagtcctttgata

SEQ ID NO: 94757 - DNA, 1054 bp, Homo sapiens
tgaatatgtattgacactactcctagttgcctttaacaatgagtaaaatttttgtttaaatcctgttagcatgtatttcagaacaggcagtggtaccaaaacttaaggacctgacccctggccttgctgcctgccttggagaagagtgtgagaggcatagaaataggggagaaatgtggctggtgggcaccgctcttatgatccatgtgaccttttgcctctctgtagcccccgttctgcaccccttccatgtcaaatggggttagagttcatcctgtgaactctgactctgcaccaccgtgtgactcatactgacggaattacaagtgctgtgagaggtgagcataggcagcttcctccgtattgccaaatgcagagaacattttccagtccctgtcttattccccctgtggcttctggctcctttgtgactgtctctcccttgacctctatgatggtgtcttctccccagctcctcctttccaggctccttggctttcttctcaaatcactagcctctccgagcctgagtttcatcatctgtaaagtggagctaacagtgcctgctctgttagggtggtggtgaggttgaatgagggagtgcttgtcaatctctaggcgcacatccctggcatggtaaatgcctgaaagggctcagaggtgaggacaagggaaagagcagagggacacagaggatccttttagaaagtaatattcccatgttctcagagtcttcctttatattaactttgttttttgtttttttttgagatgaagtcttgctctcttgcccaggctgtagtgcagtggcacaatctcagctcactacagctgtcacttcctgggttcaaacgattctcatgcctcagcctcccgagtagctgggattactggtgcccgccaccacgcgtggctaatttttgtatttttagtagagacggggtttcaccatgttagcaagactggtcttgaactcttgacctcaagtgatccgcctgccttggcctcccaaagtgctgggattataggcatgggccaccatgcccagccctct

SEQ ID NO: 94758 - DNA, 1687 bp, Homo sapiens
atcttatatcccagttggttggcttgaaaggcctgattatgaacaaaatgcttaggtctggatgctattgtagtcccttcaagactttgtaaatagcttttttttttttggtagatttcccaaaaggaaaaaaacagtacgaactatttaaaagtcaagttaaattcatttttgcccctacaaccaggaaaaacatcaattttatttttcttaattagaagttcacatatttaagtagttcacacggtctctctactctttaccccctgcagtgtttctggagaggggagtctttgcttctagtttacgtggagcattgatgcagtaagcaagtaggcactctgtgcatttgactctagaatttaggttctggagtgtgctctggtttagtagggttatggaattgctattgaagatctagcagtgaatctcagggaccactggaaacctgttcttgactttgctccttagtcttctctgtcaacactgtatcatctctgtatttaaattatctgtgctaatggaactgactggctaattctgtcctattggcatctgaaactaacaatatatttctcctctcttgttcacagagggatctttcagggcacaagaatattgtgggttacattgattctagtatcaacaacgtgagtagcggtgatgtatgggaagtgctcattctgatggacttttgtagaggtatgtatatgaaccattcccttaagctgtcatttctctagcattttgattgtcatggttagggtggtcatttcacttaatgtgcactgcactctatgatatgttctggtttgacagatgagaaaactaaaagatacagtctgctgtcaactcttagttattcttataacggtacaaacgtagataatatagaactccatttttgttaggtttgggaaggtttggtgtttgtatataaatgaagatgtgtaagaatgagaatgaatatgttctttgtgatgctttataacaaatgatgaaggcacataataaaggctgaactccagatggatgaaagaaacagtgcagcttccccaactccctcacttgtgtgttctctttcccactcatgccatcattcatgtgttacggggtaaaagcatcctttttgtctaatggaagtgaccctcctgtccctactctaaggctataattcctagtaaggtgaggctatattcaaatgatgcagctgttaacagtggagtaaagtcattgaaagcttcaagtttcaaaaaaacatttatcttgggaaattcagactgtagcatgaatttttttcagagttaattgcattttatataaccattgtttggaggtttggcttaggtcagtgccttactgtttggtgctgtgttttgtaatcacccttagttccattaacattttccttacgcttaagatactatccataggccgggcgcggtggctcatgcctgtaatcccagcactttgggaggccaaggcgggtggatcatgaggtcaagagatcgagactatcttggttaacatggtaaaaccctatttctactaaaaatacaaaaattagctgggcatggtggtgcgcacctgtaatcccagctactcgggaggctgaggcagcagaatcacttgaacccaggaggtggaggttgcagtgagctgagatcacgccactacactctagcct

SEQ ID NO: 94759 - DNA, 1022 bp, Homo sapiens
tggaggtgtatgagctaggttggagagagaccacatcactctgggaattgcgggccttggtcagtatttggagttttattctaagaggggtgagaagccattgcgaagtttcaaatgatattaagtttctgatgtctttcagcatatctctctacatttgccagatagctaactctgtggcagcagtacggcaaaggtgggggcgggtagcttgtggaaaggccctttcttggttagccttagctgatagcccaggcccaatgtgctgtggttctaggtgcagtaatcaaaaagtctctggtatatgtgaaccaacttgatttcttaaactcttcccttttgttccaggcaagtatttttcctggaaaattaatttttgagaggaggagggagactcttgccaaacccctaaaaagaacctcctgagctggagatcctccccaatcaatcataacagtcctggagagaaagaaccaatagccaggccagtgtgccatgttcagcctgggctgtggcctcgattgggttctgttgatgtttctgtaccacctccacaaccaccaccgtttgccagtctctgattttgtgcccacagcttgagtggggagagagggagttgaaaacctcaagtcatcccccatctgggtgttctatctgcttggggaaaggactgctttgacatgttctccagaaggagctggcacatgatgatttttaattgaggcaagtgaggagagattgacattaaaaaaacaaaccccaagcccccactgaaatcagtgttgacacatgctttgcattgaccttttctcctggaaaaagctttgctgtgctccttgccatctgttctagagttttgaaaacttttgttccttccgaagcttttggcaaagttgtcttcaatgtaagttgtggatgggtgttgatcagcctcttgggggtcattccttgtgggagctcacagatgctgtggatagagcacccaagttctcaccatggagaggacactctcccacttgaat

SEQ ID NO: 94760 - DNA, 1103 bp, Homo sapiens
cttaagaatatctcctggctgggcgcagtggctcacacctgtagtcccaatactttgggaggccgggccaggaggattgcttgaagccagggatttgaaaccagcctgggcaacaaagtgagaccccatctctacaaaaaattaatttaaaaaagaatatctcttatatgttatgccaattggagattatagatctctccttttcatagaatagtctcttcttataatcctcgattaaagcttgaatttttatgtagtttttttggataacacttatctggacctcagtttttgaatctacaaaatgataatttgggtttattgtgatgaggaaatgggaacatgtatgtagatgacttttcttcactgtagactattcatacagatatgagatgggtatgagacccaggatccctaaaaacagattggtaagaaaggcagtgtagttgttgggcaaagggaacagtgatttttagagtgtggaaagctctaggagaaggagggagaccagagtggggatgctgcactggaagtgaggtggaaggctttagatttcctggtgagtaatcgaggtctctgagtgcctggggttgaaggttgagggagttcaaagacttgatgctgacctgggatcttactgagaccagtcgctgcctgtgtgcgtgaggataccaccttgtgcaatctagttcaatggtgtgtcaccaagagcctgacctgacacctaaatgtgacgtagtgtcccttagaaatcatgtcatgtgatgtaacgtttagcttgagtcctgtattagaaccagtgcaactggggattggcttgaggcaagttcccaacttgaaacaagttgggaaaccaaggcaccaagagaaaaagttacccctacaagtctggactattcaaaactgaagctgaaagcaaccttctgactctgactttcttatactcttaccccatttcttttcttttatcaaaacatggtattaccaagttcccaagagcgaattataattaaagtaaccacagtgtaaagctcatcaacccagagtctcggaatgaggtggagagaagctagttagagaagaggtattatgtaatgacctaa

SEQ ID NO: 94761 - DNA, 1175 bp, Homo sapiens
tttctaggtcttgactctctgcctcgttgcttgaccgctacccggcttcagagtccaataattatattttcaactttgtcctgtatatgctccacttcttggctggaactctgttcagtttatttcctgactttgaactatctccacgtagtgccaccttgtttcctgatctaaggactgtgcaactcctctccagtcggccacatctctgaccaagggattcagtgaaaactctggtttctcacctgaactttgatctttaaccccagctgacactagtaatggcctttgtgatcaggctctgaaagaagactgacttcatgtgaaccatgtgagcatattgttcatatatccctcaaggtggattccttcttttctaaaaggcatctaaaaagcaacggaagttcttttgaaaatcagaggctgcctttttggtagcagttctttcatttattctgtagaggatccagattgagctctttataaaatattctcctacataatgtactgggatagtcctaacaatagtaaaccttgatccacagatcacatgtgccattggataaaaataaataatgcagaggaactcaataagaccagcctgtttaaaggagacatcataaaaacctccattaaaaaaagaaaaaaaaaatcatgtagctgtggtagcaagtataaaacaaatgtaagaactgaggagtaacaaaatgatgcaattagcttagcacccacagatggtttcagatacactcagatgtcacaggcatccaggactaggcctgctttgatcatttggagggcaggatttctggatacctgcgtcacctgtagccatctactgctgaaacaaaccgttataacagagagggagttcttagttaagggaatgggtttactcttctttcttactataagggatggggaaactgatgtccgtgacaaatactgaaagtggagcatgtcctatatcagcaaaagttcccataactagagtttttctgaaggtgcaggtgatgtcaggtacccacctgatgggccttacttaggaaagaagggggtggaggagacagggatgaacatttgttaagagcttctgtgtttagatgtgtgccgggtgctttatgatgctgtctcacataatcttcacaataacctctgtggaacaggggatggtt

SEQ ID NO: 94762 - DNA, 1006 bp, Homo sapiens
gtctccctggttgagtgcaagctccatgagggcagatatttgtgtcagttttgtttactgctgtatctccaatacctagagaggtgcttgtcatgcagtagtcactttgtaagcatttattgagtgatcaatgattggtggcttctagtgtcattcagcggcagcaggacgatgtatgtctgttctagatcactgagtcttaaaatgttttcaagtgacctacagatttttatcattcattcattcattcattcaagaagttgctgtgtgtatcctcagtgaatcagacattgaggtactagcctggaagtctcatcaggggatatttatctttgtatctccagcactaagtgcagcaagtgccaggtagtacaagagaaggatttgtgaaagtctgtgggatcaaactgctgaggtcttgtgaagacaaaagtgaataatacacatccttgtgttcaattggatcgtggtcaagtggggaagacatggacacccaataatcctgtgacttgagtgctataagagagggattacagagatgagaaaaaacagttgcttggggatggtagaaatcaggaagcagctttttgtaaatatgatatttatgctgaaccttaaagatggttcttctgagtgaacaagcagggagagaaggttagacataggaacaacatgagcaaagatacaaaggcaggaaagtgcaaagcatgttcctaggacagtgaattgtcctgtgtagctggaatagtgagttcatgggggtggaggggaggaatgggctgaacagtagctctggatcacatcctgaaggccttgaatgccacagatgaggtctgtgaaccttctgtaggcagtgggacactgttaaaagtgtccatagaagagatggaaaacacattagtggttaccaggaattaggggcagtgtgggggcagggggaaggtaggagcggaggatgactataaagaggcagcataagggatctttttggtgatggaacagttct

SEQ ID NO: 94763 - DNA, 1340 bp, Homo sapiens
gttataggtgtttttctcctagagcttacagtctagtggggaaggcagacattgaactcccaccagtaagttttcaagtccgggaagtgaatttagctgtaaaagtataggagttgaagccagtgcagtaggattgactgtcacagtttcttgctttccactttctttctgtgtgagtacagtttctttcatataagagcaaattcatagccaaaaagaaacagggaaggaagaaatgaagaaaataaatgagagaaagcaagacccaggagcgaggaggagggaggattggggaggtcctcccaggaaatcccgtgtttcaggttcttctagaaactcctcaggccagttcttaaaacatcttccactgtggtctgtctttatcttttgagtcatatagatgggaatggtatttccatttggttaaatggtactgggttaaaaagcaaaataacataccctgcctcccatcctctgtgtctctcataaggatcagagcccaagtgacatgaggtcagctgagtgcccagcaggactgaactattctggcctgcggggcttctctgcgaagtcccgagaagtggctaagctgaggtcgaagtccacatggaaaggacagcaccaatgggcatgcagtttccttggtagactatgtaagtgaaaaccctagaaggaaggtttttgatggtgcccatgaggaaagaggacagcaacatgttttgtttttttcctcgtggttggggtcatattaatttcttagggccacagtaacaaatgaccacaaactgggtggcttacaccagtagagattaattaaccttctcacagttctggaggccagaagtgagaaatcaatgtgttgacagggccgtgctccctcaaaagctccaggggagaatcatttcttgcctattctggcttctcgtggctccaggcattccttggtttgtggctccatcactccagtccctgtctcagtttttgcatgaccttctcctcttctgtgtgtctctcctctgagtgtctcttctaaggacacttatcattagatttagggtctgccagcataatccaggatgacccccatcttgagatctttcaattaattacacctacaaagactctttttctatataaggtcacatttacaggtttctgggcttaggacatggacctttcttttgggggaaccattattcaacctaccagagtggtgaaggagacagggtgttgggagcaaaggtttttgtttttgtttttgttttcctggttgggagagaaggaagcaaaatgccgtggagagtgccatgactaaatccctcacctgggaccctgcactg

SEQ ID NO: 94764 - DNA, 1117 bp, Homo sapiens
tttgctgcatcttacaataacgatttatttatcagtcttctaagctgttctcccttcatccctgacccaacttggactccttgagggtatggttaggttctcactcatctttttgtatgcttttaataagtaggtatttaggaagtaggtattaaattaatgcattaaacttagaattcaaacagcctaactcacagatcttgcaaaggagaaactatgcccagaggattaaatggcctgtccgaaactacacagctaggttcaattgggattagaatccatttctcctctcaagcttgtggggtcttctgaaagattaatgtcaaagcaactcgatgtgaattgattgtgttccttaaagttagagataattgaattccttgaaaattcacttatatcttctagggataggggctttcaacctttcatttcacctgttaccctgtttgggggtggtgtgatggtttggaattttgttgttcttgactgagattagagaatgagggcctaggcacagggaggctctgttctgcttgtcaaaccagtaggtttgctttttccttgacctataccttaaggacatccttctatcttgtaggtgctagtggagctatgttaccatacactggggataggatgagggcccctggataatctgtggcctggcaagtgacacaggcagaaagcagcatgtccaggtccctcgtgggtggcttgggggaacttggggttagaaaaagggcattataaccaggtgctagaagttcacagataggtcatttgtggctggtaggattggcaggaaacaatgagtcacactggtaggtatacaagggatagaaaaagaagaaatttttgataattgctagagagccctttttccatttagaccagtaggtctcaattgtggctgttttgccccccaggagacacttggcaatatctagagacatttttgattgtcacacctaggaaagggctattacaggcatcaaacgaatggaggtcagggatgctggtgaatatcctgtagtgcatgggatggggatggcccccataacagggaattatacagtccaaagtcatgagcgtccaggttgagaatccctgatttaca

SEQ ID NO: 94765 - DNA, 1015 bp, Homo sapiens
tctgctgtggactggacactggatgactaagcttgttagaactgtgtgtgacaataaagaggctcttagtgagagttcgaaggtcttgtctgagatcaagatacgtgggttttatatctcttgttggcacagaaaccatttttttatgtctcacattctataaaggttgagtttggaagagataacggcttaccatttgacacttactgttaatgaaatgtgtttataaccatttttctgaagagttgagtagcaatgctcagggacttaacttatttctgttttcttttttgcttgcaatcccttcccttactcttccaaccctcccttctcagtctctgccccacacattcaatgtaaggcattgttctaggcactgttataatattgtttcggttattccatttctatttatggaagccacagagagggttccaggattgtaactcactgttcagtgctggatgtgcttatatctcagtagggctctgctggagactctcagatgaggtttagtgttggggactaggaaacttgaagcaatgaaatgaatactggttccatatactgtataatctttggttgatatggaagaaagcaatcaagaagtcttaaaattattttggacatgcaaattaatctattatgatagtggaatgattagaagataaagccagacaaaaatagaaagtgttacccatagtcccatagattgtcattgttaatattttgatattatattcttcttcaagactttgcaaaaataagaatatattccacatcatcccctgtaatctgctttctcacttagcaatagattgcagctctctttctgtgttaaaggtctgcatcatcaattttagtccattgtttggagatgttgcaatttacttaaccaatttcctatttttagacatttatgttattttatagatattacaaaacagctgcaacgaattttttttaagcctttgagtacttgttctattacttctttagaattaatttctggaca

SEQ ID NO: 94766 - DNA, 1048 bp, Homo sapiens
attattttacaggtttgttagacttgtttaatctcccctgggatagcccacccctgttccacaggcctttgttctctgctgtttttagaagccttggaatcttggtattggaggggaagggggcagcactggaagaaataatttcattgggctttttggctgtagagaaaaatcttggcttgaccaggtgtaactcagtaatgattatggaaaacctgatatccaatactgtctttcctccccttcccccctggaataaagggagtgctatgatgttctccttaggagaagactttcaaggttagtactgtgtgtgatggtttaaaagcatgagaattgaaggtaaatagcccttggctggaatcctggacatgtccctgtgatgttaggaaaagttaactaagatctagtcttctcatctataaaatgtagatttgtaaaatgcaaaagcatgggttgttgtaagaattaaatgatgtatgcaaagcacttcacacagtgactggtgtatgttagttagcagtttgtaaatggtaactcttagtattgaggtgcatgaattttgtttttatcaggccatatttgtatcactatgtatataacctggtggagttagagttttggaaatacacacaggaggtctctctctctccctccccctccctctccctccccctccccccccaccccccgccccactcagagtattcacaaacccccagatgaggaatagggagaagagaaagagaaatattgtagtttgatttttgttttttaaactctcacctcttgaaagctacctgtgtgtcagggagtttttcttaacctatcaagtttttataagtatgatgggcctctctacctgccaggaatgcctggcacctgctgcctatccaatttaaatgcttgtgtgctaatgccgcaggtctgctgcttccaccaggcctgcgccctcctcaccatctttgtaccgtggatttagttctttccagttctttactcatggtgttccccgcagctgggatatttcctccttccccacccgcct

SEQ ID NO: 94767 - DNA, 1047 bp, Homo sapiens
ttgcaccctttcaaggatgcatgccttctgagcctacttatgaggtaactgtgacatccgcatctgaaagagaaaaaaatgataataatagaaacgtattgtctattaaagtagcatctagcactgtgagctagcagagacttgcctccggtctattttatggagccatattttggtgtggtggaaagaacactgcattatgaattgggagatcaaggtttgtcagttcattcactcccttattcagtaaatgttactgagcattcattatgtgccaggcatcatgcggagataaatgagacatggctgtgccttgaggacctcacagtcataggatttcagatatgtgagcaaatagctgcagatgctgcgctggagtcatgtaaaagagctggggaacagacccaaggcaacaattttgtgggttggggagtagtcagggaaagctaaagaaaggtgacatttgaggtgtgtcttcaaaaatgagaacttattgctagatggacaaggtagaagaacattctaggcagagagaataacatggccaaagacacaaaagcagaaaaataactgcttactggggagctgtatgttttgagatagcgataatctactagtggcccagggctgtgctgttcaataaagtagcccactagccacatatggctatttaaattatctaaaataggccgggtgcagtggctcatgcctgtaatcccaacactttgggaggctgaggcagatggatcacctgaggtcaggagtttgagaccagcctggccaacatggtgaaacctcgtctctagtaaacacacaaaaattagccgggcgtggtggcggctacctgtaattccagctacttgggaggctaaggcagcagaatcgcttgaatccgggaggcagaggttgcagtgagccaagatcctgccactgtactccagcctgggtgacagagtgagtctccgtctcaaaaaaaaaaaagaaaaagaaaaaataaattatctaaaatagcagttcatcagatgcactagccacattttgattgct

SEQ ID NO: 94768 - DNA, 3582 bp, Homo sapiens
acttccggcggcggttcacttcctggttgggtggatggagccgggcgggagcgcgcgcgggggaggggcggcgggtcagtctccgcccggcgctcccgggatcagctggcgggcgggcgggagccgagcgcggccccggctctcgctgcagcgccgcctcttctctgcgtcgcaggccggcccggcggccgtgacaatgtcgcggggctggtagcagggcgccggccgccgagccgtctcaagtgggtgctgccaggatgccgcctcgaggggcggcggggagacccgggaggagcgggaggcagtgcccgggagggtcggcgctgccggagcagctcggatccctcctttctccgagctcccggctcgggggtcccgggttctggggccggggtcgcgttttcagccccacggtttttctcgccgggaaaatacatgaagcgtttccccaggatgatggcttttgctccccctaggactcagcggttgaatttttaagcgtgttactgattcatcctctctttcttcctctgtcatcacaggtttaaacttacacgaatcgctttctggaggaggaggggacccgctgcgcgattgacacgcatattcctataggcatcctccctcagcccccacccccacggccggattcgggtggctcctctccgaggtgaaatctgagaagaaatccttggatctcttttcttaaaaaaaaaaaaaaaaaaaaaaaatctagaaaccatcggtattttgctttgctgctccctattcgcaagatgaagaagtttttcgactcccggcgagagcagggcggctctggcctgggctccggctccagcggaggagggggcagcacctcgggcctgggcagtggctacatcggaagagtcttcggcatcgggcgacagcaggtcacagtggacgaggtgttggcggaaggtacggtggggctcaatgcgccgtaaattaaaatcttgtgctgatgcggcaatactgtggtttctagttgttgcatgtatgaatgggctttgaccagttgaccctcccttcccccttcacttgccctgtgagtcattgtccttgagagatttaaaattgagatttgaaagtgactgggcttatgggggtgtggggaggttgccgaaattgtttacgttagtggccttttatttttatttttttaatattgagaagccaaattttgaggatcacacaagaaaacgtatgtgtgaaagtgtaaagctttatgccaaaggcagggtgatgggcttgtcatcctcctaaaacttaaaatcttgatgtgaaggctgaagggtggggggacttttaagaagagaggggtttctccttctcctacccaactttcccacttccatgagcaggcattggaaggaagagaggattttcggagaacgtgaacgtgtttttccaagggccaaggctcttggtggatttcactagtagatttgtttcctgacccaactgtaatcaggtccccaggttatagcaaagataacagaaattacataaaacaaatgtggttattttgaactcagtctagtaggcccctcttccttctcgctttaggttttgttttttgtttttttaatcaaaagaaaaattacttgagagtggctctgattttgttttttcgctatcagagaggatgttatttagatctgctgcataaattccctctgtgtttcatctgtgtgtctatactcacgtagatatacatcttgattcccccaggctttcgggaaatctttgcatgtctcttttggtaaccttaacctcgaccttcataattatgccagactcatacttttcacagcccttcgcctgcctagtgtgcttttatttttaataaaagcagcaatttccttggcatgaagcaattcagactgattggatggggccaacctgctgtaggttgtgttatagaccgagaggggttggaagaagggagaggtctctcttactgcaacatggtgatggtagggaacagttttattagcaagggaagagagaaagctaagaggcctctttaaaaaggggccttttgcaagctaaagttgaagcaagggtcctgacctgggcctgggaaatgcttaccatggtggatgttgcgggctggtgggtgggtttggaagaggaagaagctgtgtttggctctcagcttgtgtaagcactggattcagcagggcccagttttctgggaatagagttgaagtctgtactttaaaaacatgatttttaaaaaagatctctgacagttaatgtccatgtgaaattattgctcttccaatctcagtactgttctagctgcgctttatctggggccagagtcactgtccccttggatctttcccgtggactttggtgcaggctaggagatgcttctgtgcccgctgccagatccgcacccttgagtctgatctgtctctttcatccctgtgccaaagcccttaactgcagtggggtggagaaacagtgaaaaggagagtgtgtcagagagaaatcaggagaaacgaagggccacagaacactttcctcccctctgaatggcctctgctgaccttatagcccacgagcgttttgttcagctaggatgttgtctcatcacggatgatgctgccctaagcggtgcatgttctccaagtgtgagagaagtgatagggaaaagaaaaggcaaaattggtctttgttacctaggctgccttcctcttctctgggattcatctttgagaactgcgcatcacgtattgtgatatttttacacagaatttaggacttgtagctctgcatttattcattcaacagtttatggagttgcctgtgaagtgccaggtgctgtgctaggctctgggggtatactgttaaactagatgctagcttttaccaactgctttaagagatggaaaatagccagttatagtggattggtaaatgccatcatagagataaacttagggtgcagtggcccccagttttagggagcccaggatttctgaaggaagtgactgaagagtgagtaggagttagtgtggtggcaccatgggcaaagacagagtagcgagagagaatgtcacgtaaaactgggtctggctatgcgccctttttgtgttctttggcttaagttgagtttgaatttgtggctcttagaagtatgtagatatgtaggagccagtatacaaagtatttatgtagcacctaccaagtccaaagaccctatgaagttctgagatggatgagggaggtctatagtgtgattgacatctgcctttaaggatctgccaatgaatttgggaagatgaggcatacattcacacatacagtagcatggttaccagcactgtctgtagagtcagacagatctaggttcaaattctggatctgttctttactagctgtggaactgtaggcaagacattccaaaccactcttgaatctctgtttccctgtggcagtggttctcaaagtggggcatacttatcacctgcgagcttgttggaaatggagattctcaggcctcactctgtaggctgtgggtgtggggcttaataagttcctggagagatt

SEQ ID NO: 94769 - DNA, 1082 bp, Homo sapiens
aatatgccaaagaataaatagtgtaggctagttaaaaatgctcattctctccataaattttagtttcctctgttttttcttcccaataatactattttgttattgtctgcagtgtttgatgaatacaaaaggatatcacagaaggatattgaacagagtattaaatctgaaacatctggtagctttgaagatgctctgctggctataggtaagctggtagggggagtagagaaacaaatgtttatagattttccttctcattatcagtttgcaatatggggatatagaattatttttagagataaaagttgtttatcatgaatcactcatgttacattccagatttttaaacaagaaatattatatacaacctgattgctattgtgccatgtggtttatatattttatatcttctgtgcctttgtatgtcctatgtgaaaggtaataatgtgcagatatacaggctgcagcttgcaagtctgtgaatggttagaactagtaactgtctcatatggcagatacagtaatccttattttgaaatgaaataccaccctttgctttgatagactttatcaattacttctccaggaacttgatgataaattgagggtactttctatctgtgaaaatacatagagcatcgcctatgttcatgaaacattgcttggctaaaatttccctggcaaagcaaatattgataccttgtagaaacagaggaaacaactgtcacttttcttttttcatgggtcttatctgtaatcttttcatttcttctttttttttctttgacagtaaagtgcatgaggaacaaatctgcatattttgctgaaaagctctataaatcgatgaaggtaaatggccttattttcagcatctaaatgaatttgagttatcttgtgtccaccttcttaagcttacttatatcccctatccaaactttgctctgaaagatccaattcaattcatcaaatacttcagtgagtgcctgctaataataatactaggtgatatttactgagtacttaggatgtatggatcactgtttttaatagattaattatatccccacaacagctctatc

SEQ ID NO: 94770 - DNA, 1460 bp, Homo sapiens
aaaaaaaaaaaaaaaaaaaaaccacaaacaaaaatgaacaaaatagggaaataggctatattgttaagtgaaaaagcagaacacagaatactactgttctatcacattgggtatctagatacatagaaaaaagactggaaggacattcacacatcaaaacggtaagaatagtagtctctagatgatggaataatggttgatttttgtgttcttttttgtctttattttctacactgaataagtattaccttcgtaataaaaaataacaaaaaaaatttaaagctaagaaaaatccagccaagcttgaaaaagttggcttagatgactttgaactgtgtgtttcattttaaaatctatttatctaactttgcttccctatcgaacagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaagaacgtggaaaaataattttaatttaaaaatggtgtttttaggccgggggcgggggctcacgccagta

SEQ ID NO: 94771 - DNA, 1011 bp, Homo sapiens
gctcgccgtacgcatgcgccctccgtcccgcgctttgttgcgaaagcgagggggcgaggtgctgcggtgctagagcgcggcgcgaccggacgctgcgggcggggaagaggatggagactgtggcgtccgctgcaacggttggggctgcgcgtgagaaggtggcggtgtaggcacctgcgctcggggaaggctggcggcggcggccgagccatggcgggagacccccttctctgggctccctgaagtctcggggagccgtgacccatgggatcgttgagcagccgggtgctgcgccagccaagaccagcccttgcccagcaggcgcagggtgccagggcggggggctcggcccggaggccggacactggagacgatgcggcgggccacggattctgttactgtgcgggcagccacaagcgcaagcggagcagcgggtccttctgctactgtcaccctgactcggagacggacgaggatgaggaggagggggacgagcagcagcggctcctcaacacccctcgaaggtacgtgggggcacgcacccgcgcggacccggacccgcacctgttgggcctggggccgagccggcgcctcgtgcgcttgcggggtgcagcgctccccagcctatggagaggggacgtgcccttgacagggtgaatgtggaagccggcccgatgcggggcggactggggagcgccttgggagacgccaggtgttccgcattttcaaccacagacgcttccagggtgttgttacagccccaagatgaggatgagaaacgccaagcccgagctcgcgtctcgttaaaccttagagacgcccggctggctggccttcccagtccacctttgccctctcaagtgggtagccgcagagtaagttgttttgcatccggttgccttagtacagacactaaatgtaatctctgaaataggcactcttattgtcgcccactcagtggagggtaagtaattgcacacaggagttcttgttaattgtaaaggtgaagtt

SEQ ID NO: 94772 - DNA, 1061 bp, Homo sapiens
tgagcctaccctcaccttttcctggtgtggacttattccttttttgtactcttaatctttaatgtaatttggggagggatgggaagccaacatgtgtacattctgccgtcaggaactggaaactacattgtctcttgatttcgcatcataacgagtgaagtggatactattaatgtcctctttttacagctgtgataactgagcagctgggactcaaacccaagtctgttaccactaagacatgtgctgtttttattgtcggctaggaagaggtgttaagtacacaggtgttaaattcgccaattcaggatgtcatctgaaacaattacttcatttttaaaaagagattgaaggttttatgtgctaggaaagctttcagaattggtcaggaatttaagatattgatcagcctctgcctaaggccttttcttagttactggatcattttgagcaatgattttcaaactttatttttttagtcaagtcttcctttaaattaaatctgtgcagaaatccagtatgtttacagatagaataggtgatgctgctctggttgaagttagatgggatgctcacagttcactccttagctctccttggtggcccctaagacttctcctttgagcagttttaaaaacctttcatctaaaataaataaataaataattttaaaaaacaaataggaaaagaaaagaaaacctttgatctaaggttgcaaaccgtttgtccagtggctggaaaacattttaagtagtttaagaataggttggtaccaaaataagattaaatgtaaattattttaaaattacttgggtaggtgaaatgtttactcttgttctccatttcctacttgcagattattgcgctatttgagctccttcatagtgctggtttctaaataaggaaataagcaaaaaatcaacatgctaacttcttaatctattgaatgggtaattaaattagtccaaaattgctaaaacatgtgtagtgaaaagtctgcctcccatgctgcccccctttctccactatctctcccgtgcatagaggaccccagagataac

SEQ ID NO: 94773 - DNA, 1234 bp, Homo sapiens
ttaaaacctatataaacattttaggttaaaactttaatgttaatcatttgaaataataatatacttgttttaagtctatctcttagatattgtagttattttaaacttgatcactttctgctaatgcatactgttagtttagtcccatcacatggttaactgactatgtagacttcttaatttaaaaagaaatggcaaaacagacaaaatgctgctaaagaaatttgcaaaggtctcagacaggggaagaatagaaaagaaaaagaatagcagtattcattctctaccttactactcccccccaccttccattttcaaattccaagtatttagttgaatacttgctgaacttttttcagtatttttattggacttgttaaaaaaaaaaaaaaaaacttaggtttgctgcacttaatgagttttctttcttttctttcttctttttttttttcttttactttttaatatgtaaaagctgtcagagctaatttttcccacgtgaaatgggcctttccagtgcttatttatatttacaggacggtttaatacagcagtgtggtgagacaatgaaggaaacagttaatgtgaaaactgtatgtggctattacacatcagcagggacctatggattagattctgtaaagaaaaagtgagttgcctttcttgtttttcttcctatcccacttttaggaatttggttgctttagtttcttaagagaatgtatagctataagaaagaaagaattaaggaaaaataggatagggggatggaattttattaaataaaaagccccttttaacttttggactaattagtaaattcctcaaaagtgtcgtctttgtaagtgaccataggtgggttatatacatgcttataaaaaccatggtcaccttggtcgggtgtggtggctaacacctgtaatcccagtggtttgggaggccaaggcagaaagatcacttgggcccaggagattaagaccagcctgagcaatgtagggagaccccatctctacaaaaaattttaaaaattagccaggcatggtggcatgcacctgtggtccccactattctggaggctgaggtcagaggattctttgagcccaggaggttcaagactgcaatgagccgtgatcatgccactgcactttatagtatattttctattaaaattgtttaagaagtaggcctgatagactgacagtccttctaactcttgagagttgcagtacctgtt

SEQ ID NO: 94774 - DNA, 1060 bp, Homo sapiens
ccttcaacttgtgccttcttggaatggatctttaaaacagcttttgacagaaacagatgtctggttttctaaacagaggaaaggtaggcctgaagtttttgagaacttgtcttttaaaaggaaatttgttaaaatcaggccccatgagaacagaaaataaataaattaattaattaaatgaaatcaggccctgacttgtttatagacttaattttagagcttggagaagaccttagcaattatctacttcacccctcatttacagtgagaaaatcaaggctagataagaaaaataccttaactatcattatctgaattgttactccttgaactgtcatcatactcttgatcgccaaaaactattgtttttcccattttatcactaacagatcttgttgattgcatttgtcttgaccacactgagttttctctaacaagctataccccgtcaggcaaccattcttaacataggggccatagataggctttcatgtgtcactgactcccaaaagtgggtacagaatttgatatgtgtgtgtgctgctgcatacatttgtgagaggagagcttccataccttccgtcagattcttagtggagactgatctaaaattggttaagatcaactgctataaggtcttatctgtgcaaaggagggcatgcaatataaaaaaaatacatgtgtatactaagttaaaatgtatgtatgttattttttactttgctaaaacatatctagaaaaagtattttttacggctgtcaggtgcaaagaactggataaatccttagttcgtgattttcttagtttatggccacctttttggtttatttttaatacgttgagcctttgtgacctaatctttgagtactagaacatcagtaacttcagtcttaactcatgtgcttcttttctattgtgtccctctgacttttcctaaccactatcttgaacttcatgtttattcttttgctttataaatatatattattgcaccatgtatatacgtcttaacatatattacatagtggtgtgctaataagctgactctgaaaaaataat

SEQ ID NO: 94775 - DNA, 1031 bp, Homo sapiens
ctgataaaattttacagccattttctattaatattgattttgcatagttacactatatgaaaaatggtttgcatgtgaaacaagtaatattaagtggtaggtgatatcaagtcacatcttatttacagaaataatagattttagcttattttacttgtagttagacttttacttttttttttttttttttttttggcaaatagaatttttcaggttttttttcctctactctggtttggctgagccctaataaaagtagtccagaagtcagggcaataagtgaaacatagaagatattaaatcttttttatctagcaaaaataatggactaaatttaatcaacactttcttatttttatctgtaccacaaaaacttatttttaaatctggtagcaagattttctgttcttaactcatagttcttttttaattattagttgcatattttctatgaacgttcatattttatgtatatttttaggcctcaagaaatcaataaagaagaactagagggaaacagcatgaggtgtggtagaaagcttgccaaagatggtgaagtaagtatgggttgtgactgttaatattcttatacaaattgtattatcagcacatcctgcacctgtaagtagtaatcatgacacctgtcatacctcagaagagcttgtttgatacactttctgtagcatgatctgctgggaaagtagttacagccaccacactcagtagtgattgattacttggccttgtatgagaatgctgaacttaaattttgagttcagataagacatacaagaagagggtcccttagcaatccagaaattaagataaagaagaaattgtgagggatctgttacatagtcttaaaagtgattctgtgttacagttgtcctaaatcaaagacattcaaatccattgattgttacccacattaggaattaccttttcttggccaggtgcggtggctcacgcctataatcccagcactttggaaggctgagatgggcggatcacttgaggccaggagttcaaga

SEQ ID NO: 94776 - DNA, 1034 bp, Homo sapiens
ttttaatcctagattacgtttggcttcttttgatagtagtggaaaactaatatgtagtagaacaactggctatcaaatacttacacttgaaaaggatcaggtatgttcgattatcttctggtatgtcatcataatatttgtcttttgaatcctcttttgaaaattcttaagtagaattaacattaaagtgatggcattttgacctaaaagttggtttaaaagtcttttgaaggtaaagatgaaagtaccacattcacttatgcataattgaccccatcccaatggaagcataattaggagaaaaaaagaaaacactgtttgaggggcagggaaacactgattataaggaaataattgtttatcctgaatatcagcagcactaaaattcattcctaaaattttaggaatcttaagtgctttatccattgtgtacatagtgcatttatttatacattcacagcaggcatcttaaagacaatcctgtatgtctccatagctccgaatatcataagagcattattctctagcccattaggttcgtaagatggcaaactctgcaatgttccccagattatctccaaagccatttatttattcatacatcacacacatggagaagtttcaaagtgtcatgatgagaaagtagaccatttttaaaagtaaaactgaaagctgttaaaatattgaggaactttatttctattaaaagtaatcatcattccaaagggcataatgttttattaaaggattcaaagcctgttatagtttacataaattatgagaagttagtagttttcctcagactgaagagactatcatagaacatccttagcattgcaagtaaccccggaagtgatcattgtaacctcacatgccctatatgagaacttcttttaacagcattcttacagagggggtcatccacccattgttgaaactctaactgacccccatcttacatgaaaggtaatatgtaggaatgtccatttcaaggcaggtatataatgagaaagtccaaatctgcctccatcaga

SEQ ID NO: 94777 - DNA, 1990 bp, Homo sapiens
tgggctctgagtcttttttttggtttgttttttttttttttgagagagagggtctccctgtgttgcccaggctggtcttgaattcctaggctcaagcaatcctcctgcctctgctttccaaagtgctggaattagtagcgtgagccaccaagccccacctggctctgagtcttaataaccatcaattgctgtttaagtcagcttttttgtatatttgtgtgtggttgttagaaacttttaatttacatttttctgccttccagaaagctttctagccctagttgtactgaatgcaactgatgattaagcagtaaactacattaaaaaatttttttgttaacaatcaaggccttggcagaacctttttcctcactttgctatacggaatgactcgtggttctgtggagctcacctcatgtatatctgtgctgattgatacaaagttgatatgtctgtctgtttctaacatctttgcttataaatattagatctccaagacgacatagatccacatctccttccccttctcgactgaaagaaagaagagatgaggaaaagaaagaaacaaaagaaacaaagagcaaagaacggcagattactggtaatgttattagataaataactgtaggaaaagtacagtgatgataaaattataaaagtttaatcttgaacatttaaatgttaagccttttatagtattcattgcatatggttttgagttttttttggtttttttttttttgagatagagtttcattcttgtcactcagactggagtgcaatggcacaatcttggctcactgcaacctccgcctcctgggtttaagcaattcttgtgcctcagcgtcccagagtagttgggattacaggcacccgccactatgcccggctaatttttgtatttttagtagagacgggttctcaccatgttagccaggctggtctcaaactcctgacctcaggtgatcctcccgcctcggcctcccaaagtgctgggattatagacgtgaaccaccgtgcccagcctgagattttgttttaattgcaccctagcaagttgctggttatctatggtgctcctgatatagaacgatagttaaaaacatgagaatattctattttggaagtgtcttcagaactatatagtgtcatgcctgatattaaaggtagtccttaatatgaaacccaggtttttttttaaaaggtaatcctgtctaaaggcttcaaggagaggactttttttttgtaccataagttacattctgtccaaatgtaagaggaattttttcattagactcatcttcagctaattgttttgtgtgttctctgctagtgaggtggaatgactattaatctgttaccacctctctttttatttatgtatatatttgaaatgatagagaggtcacaaaattattcttttttgcagaggaagacttagagggcaaaacagaggaagaaatagaaatgatgaagttaatgggatttgcctcctttgactccacaaaagtaagtaaaacgtgcaacattctcatttgaattaatatgttatgactgtcctatctttccatgttcttttccatttatacaaatttatttggttataagacaataactatctgtttgaagggctttgagaatacaaaggaggaaacagtgaactgccattggaattcagggagtggttgccagggacgatgtttgaattagattttaaaggacaagtagaagtgatcagacaaagaagaggaagaagattatttcaggtagagggaagagctcatgaaaatgccatgtaggtgtaaaggagcatagtgtattgtgggaatttcagattcgaccagggataaaggggtgctgatgggctagtgacttaggctagaaatagaggtaggaggcaaatcacagagggcttttgatgcccttagtcatgctaaggaattcagagtttattcttttggtgttgaggagaggaagtagtgatttttaa

SEQ ID NO: 94778 - DNA, 1040 bp, Homo sapiens
cagagcgagattttgtctctaaattaattaattaattaaatgtgcaactagtcatattgctcctggctccagtgatttttttaaatcatttagaataaagtccagtcctcagtgtggtctacagggcctccatatgacctagaccctggctttctacagcctcactcttgctcactgcactgagctacactggccggcctccttgctgttctttcaaaacaggcttgtgtctactcccagagtcttctcacttgctctttcttccttctggaatgttcccccacctccccgatttgcacgagtagcttctttacattgttcagatctctgctcaaactaaggtcattcctgatcaccctatccaaaataggaaactttcttccctgtctctgtactctgctttactctttttttttttaacatttaaaaagttgagataaaatttatatgccataaaatttacccttctaaagcttacaattcagtggtttttaatatactcagagttatgcatccatcattcctaattccagaatgttttcataaccccagaaagaaacctcatatccattaataatcactcctcatccccctacccctagaatccactaatgtacttcctgtctctacagatgtacctattttgaacatttcatataaatggaataatacaacatgtagccttttgtgtctggcttctctcatttagcataatgttttcaaagttcctctgtgttgtagcatgtatcagtacatccatcattcttttttgtctgcaaataatattccattctatagttataccacatttttgtttataattcatcagttgatgggcatgtgagttgttttcacttattgactattaagaaataatggtgccatggctgggtgtggtggcttatgccagtaatcccagcactttgggaggccgaggtgggcagatcacttgaggtcaggagttcaagaccagcctggccaacatagtgaaaccctgtctctactaaaaatacaaaaattagccagacatggtggcgtgt

SEQ ID NO: 94779 - DNA, 1428 bp, Homo sapiens
actctggggtgctctctgaagcggcatctccggcagagaactccatagtgtgtgatgagcctgctgcttgctcagtattggcatttacctcttaatatactgtcctatgcccatctggagtataagcctcccagaggagactgggcagagattaacttggcagtaaagattatctgacaagtctaatattttatgtctttgtaattccccattttcaagtatatatctcaattagtttatcttgatatgtgctcaaagatataaactattgtcatcccatgtttatgctattacacataactttttatttaaagttctggtcataaaattctggttcaaacattctagaattcccagcttctatttctggagctgtgactctcagtcagtcaatgcttaggccatgcctttgaggcactaggtattgaaagtcaccacttcttcattatcttaggattctcagttctttcttcaaaacttatactttcaggttttcttaattaactggtcattccatacatctgtgtaaaataatttctaggaaaactccgaatctcaaaacctttgttttatacttactacttcatttccagtagatggcaccaaacaccctttgaaggtcttcattatactaatccctagttggtgttgctggctaattgataatttcatccaccaccaaggaacgaacatggtctattcttcagctgattctctaatttttatataatgtagtatttttgtttggagtctaagctagacttgttggcatttaaattatttgctgtttctggctcagatttcaaccttttttccccctttttaagacaaaaataagtgtgactttctggtcagggtgattgtagaggaagggtcatgatactgaaataggacttggttaaaataaagagttgagagtaagagactaaagacatatgccaaatgtttgtaataaaattaaagagaaaatataaatatatacaaaatccaaaatgtcaggataatgaaatcaaagcatttttagtattatcactttgggtactttagtagaattgcactcgtttatgattttgaagtttgttttacaaataacatccaatttaaaaatactcttttaaaacttagatccttttatagttcataaacatagtaattaggtgttcccattgcatgtatgagatgtgcctcccaaagagcttgttacagcgttagtacattacctgtctgatatggagaaaaaaaactgttatatttctaccttcatttccaactttgtattgtgctttgaaaacctttaccttcagtatgtgtatttcattagtattttcataaagaatcagtttttagatccagttaaccactgaaaccagaatatgcctatatgtcaggcatgatttactacatgtttattctatttattgagttgat

SEQ ID NO: 94780 - DNA, 1051 bp, Homo sapiens
gtttttgaacccaagaatttttcctggttatctcagatacgccgtaatttggcttagtttttttttattagagtgtatttttaaatggtgaaatttgacctttatcagtgattccagagttatccattgttttccataatcacatggaaaatagttttgacacaaggtatcagtgtgttcttacagtgctttaattaaaaacgtaaatgtttacccatcaatggaggtggctggcagtctcggaactgatcatttttgaaagggctgctttttattaataactcagtttcagtaaactagatgcacttcagtaatgctctagccattaagtacaagtccccctttaaaaagcaccatgtgtttaacactcgagtaatcaaataaaatctgtagttttaaaaattttgttcaaattttggaagaagttgtgcttcctatggagtttgtttaaaagtttattttggggattcagaattttgcataagtatataactctatttattagtttatatattttcaaagaatccagaaatattttggtaagaatttcctgtgtgctgttattttctactctcttctcaacctattcactttcctctcctccacctacaaggggtggtccttgtctacagttaaagagggtaatctcaaccaactgttggcatatactttcatccattttattttatttatttatttatttttagacagtctcgctctgttgcctaagctagaatgcagtggcaccatctcgacttactacaacctctacctcctgggttcaagtgattctcctgcctcagcctcccgagtagctgggattacaggcgtatgtgaccatgcctggctaatttttgtatttttagtaaagacggggtttcgccaggttagccaggctggtctcgaactcctgacctcaagtgatccacccacctcagcctcccaaagtgctgggatcccactatgcccatctactttcatccatttaaaaaaatctgtcaggctttgaacttactagtcccggttaaagttaaaatgccacgtgctttag

SEQ ID NO: 94781 - DNA, 1029 bp, Homo sapiens
agggttgatattttgggaaggagaatttattttatttatttatttttttggagacggagtctctctgtcgcccaggctggagtgcagtggcacggcctcagctcactgcaccctccgcctcctgggttcaaatgattctcctgcctcagcctcccgagtagctgggactacaggctcgtgccaccacgcctggctattttttgttgcgtcatcccatggtggaatgtagaagggcaagaaagtatacatgcgcaagggaggagggggccagacttatccttttatcaggaacccagtcttgtgactatgacatgaatctatttgtgagagcacagccctcatgacctaatcacctcttaaagatcctacctctcaacactgatgcattggggattaagtttccaacacatgaactttggtggatgcattcaaaccacagcaccagggttcctactatgtcacctccagaggcacccagagaggaaggttttgagttaatcacatcataatttatagcccttgagccatcagagagcccatgcagagagcaccctatttcctaggtctcaggtggcatggaggggtgagtacgttgaagaaggtgcttgctaatttccaaagactcagcgcaaataagttcagtggggttcatgggagagagacctgaaatgaatcaattgtgggtaatactagaaagttgtcttctcgtcattacttccatctatttccacacctaccccatcacactccgttctcagtatcttcatctgtattggggtggaaaagagtgccaacagctcagaataatgctggttctagctgcacccagcctcacccaatgtggcccaacctagtggaactgcagtgaaaggaagcgagagttctaattatgggttttaggtatcatttcactagatatgttggaggatctgaggacctttcttagggacctttaattacagtaccctggactgggaagtgcccatgatgtggcacctctttcttaccctgtagggttttcttgactac

SEQ ID NO: 94782 - DNA, 1033 bp, Homo sapiens
agaaccagactgaggaagggatagggaggagaaggcactgtgcccctagttgcagggacaagaaggagacaccaatgagtttgagataaaggccttgaagagagatgctgggtctctaaagaaatacttggtttccttcacagttttgtctgagaaaagacaagcagctgacagtgctggttatggaggcccatgaccccaaaagaggttgtgctgagtagatagcccaccagcatgttcggatggaggcacaatgttgtctggagagcagctgacagctataatgtaaccaggagtgctggacctttgggtctgtggtttactgtgatgtactgagacaaagactgtcacagatcttagaagggggaggcacagcttccaagaaatgatgcaaaatggtggcgcaaaagaggccaccagtggcaacaagggcagggcatttcctttgtggctggtggtcacggacaacttctggtctcaatttcccaatgagctatgctaagaaatttaccagaaagcaaaataagccatgcaaaaagcgatgacaaagcacttggggtatccatgcaaaggtgcagttcccccttgtccactaattttgtggagccaaaagagctgatccagaagctgcaaagatagtccctgtgattaagacatacaacttttttttttttaaatgcgagactctgtcttactctgccacccaggctggagtgcagtagagcaatcttggctcactgcaacttccacctcctgggttcaagtgattttcctgccttagcgtcccaagtagctgggattacaggcgcgcaccaccacgcccagctaatttttgtatttttagtggagatggggtttcaccatgttggccaggctggtcttgaactcctgacctcaggtgatacacccgcctcggcctcccaaagaaggcatacagcttttttggcctgagttcttccaaagagagacccttcctagttgacttggcatcatctttcattcaccagtgttctctaactgcctttatgattag

SEQ ID NO: 94783 - DNA, 1055 bp, Homo sapiens
tctttagtttggaaccagcttttggattatagaaaggatcagatagttgacatacaaggatttgagtgagagtgtatattactttctctgtattttatgggctctttactttaaaatgaaatccccagaaatcctaccttaacttttcccccacctaaatttctgctgccaagagcctatccattcttttaaatatgtcaggttcaactcccttatctttgaaacaagttgcatgtacagaagcctgcagtagtcctggagcttccttcagacagggtgaagggagtgagctctcttcaggctacctcctcccactgaaccaggcataggagctggcctcagcagccttaggagttcaggactctgttcaacatgaatctgtggaatttctctctgaattttggggagagagtattctgtagaatatagtacgggactctgtcagtgaggcatagcaaaaagtactggaagactggctggatgtgtgtgaatggtgggatccgaaggtatgtaggagtgggcatcaaggtttctgacctggctcttaaattttgacagcgttagggggcactcatgtgccaagtagagagtcttgaggggtagcgctagtccctggcccttagaggtgttctgaatgtttttgtatgtagctcagagctcttttgcaggctgatggggattcatgaagatagagtacttactgaggaacggtgtgttctgttttgaagattggatggagtggttatgtgcacagactgggcagtctatggcctggtcatctagtctctgtgaggtgaggcacctgcatttccttcctagggccatgctgggaaaaccaacctaagagagctggagatcatgactattgttagtgatttccctgagactgctaactgtctttgcttgctccttctgttctcttaagtcccatggctgtaatgtcctgccttctattttctgctttgggaccttcaaattccataattcattcagacttctctttctagagacaaggtctcgctatgttgcccaagctggagtgtggtggctgttca

SEQ ID NO: 94784 - DNA, 1409 bp, Homo sapiens
aaagaaagaaaaatttttgtagagactgggtctcgctatgttgcctgggttggtcttggactcctgacctcaatcagtcctcccgccttggcctcccaaagtgctgggattacaggcatgagccactgtgccctgctgaaaattatttcttgttttgaattgaaatctaattgagacttctcattaatttaatttttgtttttatttatttatatttgagacggagtcccactctgtcacccaggctggagtgcagtggcacgatatcggctcactgcaacctccacctcctgggttcaagtgattcttctgccttggcctcctgagtagctgggattacaggtgtgtgccactacgcctggctaatttttatatttttagtagagatggggtttcaccatgttggccaagctggtctggaactcctgacctcaggtgatcctcccacctcagcctcccaaagtgctgggattacaggcgtgaggcactgtgcccggcctaattttagaccagtaccccggaactatacagaataaatgtaatacatcttccacatgcaaactcatgaacctttgaagacagtcttcctatgtgtaagacatatttgcagtttatcctaatacctaaacttgctttcagttcagatcattctgcacagaaacaatttctacttctccctactttgtaaatgcagtctgacaaatctgtgcttcacttaggattatttagttacaaggtgagtatgctttcctttcctccttgaagaatgaattgatggtgagctaagtctttacaattgtctgtgagtttggagggtttgcagtctcctactcttgtaatcattaggaggtcaggctgctgccctgctgcatacgccatcagagctcacaaaatggctggaagtttatccgggcacttgacaaactgcatttacttcatcaggccactaggtgatgaacaactcacaaacccagactgccagggactgtggtgtacagggcagtttctgtttatacttggaaaggccattcgaagtcatctggtccaaactcattaaaaggtttttgttggggaggggaaacatgttttttatatagtttgtctttcctggctttgttacagttaaatgttaattgcctgggacatttcctttttttttttttttttttttttttgatacggagtctcactctgtcacccaggctggagtgcaatggcacaatctcggctcactgcagcctccgcctcccgggttcaagcgattctcctgcctcagcctcctacaggcgtgcgccactgtgcccagctaatttttgtattttatttttttagtagagacaggattttgcactgttaggctggtctcgacctactgacctcatgatcgcccgccttgacctcccaaagtg

SEQ ID NO: 94785 - DNA, 1731 bp, Homo sapiens
aggctgagctatgatgtttggtaggctaagtgtatcaaatatgtttttgacttacggtattcgagatgtaacctcatcataagtcaaggaacatctgtatttgtacaatgaggataatgataatacctgcctcctaagatggtggtgacggttaaatgccatcagctatgtaaagtgcttagcatagtgcttggcacatagaaagtgcttaccaaatgtcagctattatcataaaaattaaaatagttgttattctcatttaaaagatggataaacaaaggcttagagaaataaggtaaataaagtaatttgtgtaagtcacacagcatataaatgacggaattagtttgcacccaggcagtcaaactccagagcttttgctaaccattacgctgcatcaccttagtaggttgagaggaagactgggcaaaaactgcatcttgtcaaacttgagtgtaggggtaaaggtcaggcttgagttctgacttacctaaccttcattgtgatcttaagcatcttatcagtgtagcatgtgcctcgattattctctgaattgattcttccctagatccaaagacatgaatgataggttagttatattcttctcctgctgagggattgggtgttccctggaccgggaaatggagctaaacaaacacctatgtctcagtgctttttggaccataagtaagagcttgtccggcctctcttgttattatgcttgtttattttttcacatgactggtaatgatgagaagcagaacagcatacacattgagaattttcttttttttttttctttgagacggagttttgctcttgttgcccaggctggaatgcaatggcgtgatctcacctcaccgcaacctccgcctcccgggttcaggcaattctcctgcctcagcctcccaagtagtagctgggattacgggcatgtgacaccaagcccggctaattttgtatttttagtagagacagggtttctcgatgttcctcaggctggtcttgaactcccagcctcaggtgatctgcctgcctcagcctccctaagtgctgggattacaggcgtgagccactgtgcctggccacacgttgagaattttctacatgctatgtactctacatggattatctcatttaatccttaaaaataacctcatggtgactcttatccccgttttatagagttgaagagaggttagaaaacttgcttcaagttgcacagttaataagtagtagagcagggatttaaataaggcagtccatcctgagttcatgcttgctttttttttttttttttttttgagatgttgtcttgctctgaccattctggctaacacggtgaaaccgtgtctctactaaaaatacaaaaaaaatcagctgggcatagtggcaggcgcctgtagtcccagctactcgggaggctgaggcaggagaatggcgtgaacccgggaggcggagattgcagtgagccgagatcgcgccactgcactccagcctgggcgacagagcgagactctgtttcaaaaaaaaaaaaagatgttatcttgctctgtggccaggctggagtgcaggggcgcaatcttggctcactgcaaccacctccatctcctgggttcaagcgattctcctgcctcagcctcccatgtagctgggactacaggtgcatgccagcatgcccagctaatttttctattttttagtagagacagggtttcaccatgttggcca

SEQ ID NO: 94786 - DNA, 1005 bp, Homo sapiens
tattgtagatagtaacaatttgacctcatatgctggtgaccctgcactgctgttaggagatcacttcttggttctctgagaaatgtaagaaatgtgttggggttggtatagctgggtgtggtggctcacacctgtaatccctgcactttgggcgcagaggcaggaggattgtttgagcctacgaattcaagacaagcccgggcaacatagggagcccctgtgtctaccaaaacagttagcccagctgctgggcaggttgaggtaaggagtttcaaactagcagactgcaaagtggaggacagggaagggtattccaggcagaggaagcaaaggcctgaagtcaaagaaagcacagtcaattgagaagttgtagtcatttcagaaagatatgaatgaaggatgtttacattatccagtttttggtgactattgttttgctacttcactagtgtatattattgagatttgactatacttgctagagcacagaaagttaaaggctttattttatagcaataattctcttttaaggtgaagacatcagaaattatacttcctgtccagagattctaaggagaaaatgtaaattaaacctgacctttgagttagcaaatgattgataactctctgtcctataaaaaaaagaaggggtggccgggcacagtggctcacgcctgtaatcccagcactttgggcggccgaggcgggcagatcacctgaggtcaggagttcgagaccagcctggccaacgtggtgaaaccctgtctctactaaaaatacaaaaattagctgagtgtggtggcacatgcctacaatcccagctacttgggtggctgaggtaggagaattgcttgaacctgggaggcggaggttgcagtgacccaagatggtgccattgcacttcagcccaggcaacaagagtgaaactgtctcaaaaaaaaaaaaacagaaggggcagggcacagcctactcctttctctctaacttctgaatcttaccatgttt

SEQ ID NO: 94787 - DNA, 1048 bp, Homo sapiens
agatgaagtgcttaattcaaggtcacacaatgtcggggatggacctccagatttccttactggtgagcacattttccaggtttttctgtaaatcagggttttggaatttaaatactatttaaaacgtttaggtgagcttgtcatttaaatgagcccttcaggtaatcttttgttgtgcagtcagcccctttttgtatcaggcagctcccagcttttcctgataagagctacacctgtaacgggcgggcgggctgaaatgctgtcttatgcagtgtctggtgaggatagggagggggaagtgattcagcctgcccagaggctcaggtgtctgtcggtctggccctgtctgtggcacatttgagcctacctgcctctgggggagcaaatggttttttgtatgactgacttgcttccgtcagctccccatgggcttgactcttgcctcccccaccccagcaccccaaccaggtaaaaataaattcgctctggcaccaagcctccatttctctgcagagattgacagagcatgacagagtgttaggtcagtctgtggactcttcagttcaatgcaacacgtagctagtgggccaagcaacaaactggtgcctgagcagggctctgattgtgtgtggatatgagagacaaagagaagggctttttgcctttaacttatgttactatcagatatattttccaaagtggtttcatgttagtttatataactctacgaacatttaataggtacataacagcaacgatgacagttacagcactaggtgcttactgtgtgctgggcattgttctaagccttattttatgtattcagtgtctcacatttttaaaaaaaccactaagaaacaaattttacattatgatttaagacatttatgcacacatatgtaacaaaatttttgcaaaacaatatttgttactacatgcagtatatgtacttgggtaatttctattctttatatataaaaaggacacattataaagtgattaaaaacccattaataagttgtgaccgcttatacacatttaatcctca

SEQ ID NO: 94788 - DNA, 1070 bp, Homo sapiens
atgcttcctacttcctttccgtgcataagaagccgaatggtgagagtcacatttagtccactttcagtcacaccggcatccatggcgagcggcgggcggcgttcgggggagttgggctcgttacgtggtcaagtctttggcggctggcggggggaggggaggtgtaggcccaaaactgccggcgcgaggcgagcgagggccgcgggagcgagcgggagcgggcgggaggccgcagcgtagtcgcaggggcgggcggcggcggcggagggggcgagcggggccgggagcggcgggcgggcgggtgggcgagggcgcggcggtggcgactccggcggcagcctcggcggtctgggcggggcgggaagcccgctttcaaccccgcgtaccctctgaccccggaagtgcttgctgcgcaggaccccttgaaaaaaaatgaggacccgtcttttttaggtcacaagattgcgccaacccttacatggtccttaaaaaaaaaaccttctgacactgcagtagtgaaaatgaagcgcacgatgggcggaagctgtgagtccggcaaagttttaaaatgatgacgtattttattaactctaacggcactggcgggtgactgaaaatactagtgctgtgtatgcgggatagacattattttcctgccctacatgaggggctcgtgcgcggaacgacatgggcagccccggcggaaactgcaggcacaagccgggacgccgcgggtttaaaacatgcgcgtgaggtgaccagagcgcgtgcgcgagggtgtggggggatgggaggggcagcagccctcttccgggggggaggggcggcgaggcgaggcctgcggagcgggtgcgcgcgggcgggcacgtggggccctttcgtccccggcgtccgggcgccctgcatggatcccccaccccagctcctgctccccggcggcggccggtgggcagaaagaccgaaacccactcacggccgcctgccgaatcgcggctctgctgtttgtggggcgtgctagaaacgtggtcctaaaaagaatggcgtccatttacataatgctttgtttgcgt

SEQ ID NO: 94789 - DNA, 2395 bp, Homo sapiens
cagtcacccgccagtgccgttagagttaataaaatacgtcatcattttaaaactttgccggactcacagcttccgcccatcgtgcgcttcattttcactactgcagtgtcagaaggttttttttttaaggaccatgtaagggttggcgcaatcttgtgacctaaaaaagacgggtcctcattttttttcaaggggtcctgcgcagcaagcacttccggggtcagagggtacgcggggttgaaagcgggcttcccgccccgcccagaccgccgaggctgccgccggagtcgccaccgccgcgccctcgcccacccgcccgcccgccgctcccggccccgctcgccccctccgccgccgccgcccgcccctgcgactacgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaatgcttcatatttgaaaaagctgggaattgctgtcttaaactctttgttggtgccttttttttccctccccttttagcctgaggtgtttggagggaggagggagaagggtgggcccgtccttggtattctctcaagctcttctcaccttatcggtaagattccattccctctgtgccccaacaaaggaacatggcaggctgggcctgctttgggatgtttccagggacagagaggttcaagttccagagagaggcctctgcccatttctctggtagaaacaaggttttctcgaggggaaaaggtgtgcccactcagtaggacctctaaatggcagagcgtcctctccatctaaccagttcccccacccccacctcacaggataaacttaggaacaaaaaaatattctggggtgggaggagcctggggaaggggtgtgggggcagg

SEQ ID NO: 94790 - DNA, 1028 bp, Homo sapiens
ttttttttttttttttttttttgagacagggtcttgctctgtcactcaggctggagtgcagtggtgcaatcacggctcactgcagtctcaacctcctgggctcaagcaatcctccctcctcagcctcccaagtaactggtactactggcgtgtgccaccatgcccagttaatttttgtatgttttgtacagacagggtcttatgttactcaggctagtcttgaactcctaggctcaaccaatcctccagctttggccttccaaagtgttggaataacaggtactgttattccgagtaactggtactactggcgtgcgccaccatgcccagctaatttttgtattttttgtagagacaaggtcttactatgttacccaggctattctcgaactcctaggctcaaccaatcctccagctttggccttccaaagtgctggaataacaggtgtgggccactgtgcctggccactgcaaattcttgggagcctgctgtctctcttagccaggttacaatggatactatctgttaacactagtattcctactatcccatattcaatctttactcctcaatcacaaactttttttttttttttttttgagacagagtctcatgctgtcccccaggctggagagcagtggcgcagtctcggctcactgcaagctccgcctgccaggttcacaccatcctcctgcctcagcctcccgagcagctgggactatagttgcccgccaccacacccggctaatttttttgtatttttagtagagatggggtttcaccacgttagccaggatggtctcagtctcctgacctcgtgatccacccacctcggcctcccaaagtgctgggattacaggcgtgagccaccgcatcctgccctcaaccacaaacttttatttccttctgctattctatcccatgattctcataaaccatcaaaatgtcttcagaatgccaattttttgtgtgttccgatttcatctctggcatgataaactttatagctctgaaactcttggttcaa

SEQ ID NO: 94791 - DNA, 3013 bp, Homo sapiens
taaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaatacaaagtcatctgctcttgtttttcaagaattttgagacacaaagttgtatgtaaaggaatatattaatttgccgttttctaggtagatttgctcaaaaagagtgaatcaacttaatatgtacaaatgatagctgtgaaactgtagaatatctttgtgtcaggcttggagttcattgtgacctccaaattttgcctgaaggaccagctgggcaaagcatcttttaaatgttcagaggccaaaagataaacaaaaaaaaaaccttaaaatcctacctctttaaacagccttcagataagagaatcctcagtgcaatcattattttgattcgtttggtacctgttttcctggagttcccgattttattattttggggtggctccaagcattaagaggtttaatctttgatggcattgttctagttttgaaatttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcagggcatgcaaccaaaagcagcttaaatgaaatattttaaaataaaatatcaggaagctatttttagatttcttctggcttatgtttctactttaggaccctcattgttctcttattaaaaaaaattatttcctgtgcatctcatggactgcagggtaaattatttgggcataaataatttaaatagttttctttcattttgactatctccagtaataacagtttttattatccagcatattggcttattgcacaaatcttaaaatgtacattgactactttctgagaagaaagtggtatcagtactcatgatgaaaaggttactactgaacaaattcacatttcaggaacacctctatctttggtttaaatcttactcttagtttttccgtctaaaaatcatactggtattagtatcaggtaaggaaattaaagtttttaaaatggtttcattctctgcaatatgcaaaatttagattttactttctggtactgtaaagaacctgaagtgatttacacttaatgggtgattaatccagtattctttaccctgaatgtttggatattaaagttcctttatgttttctataacctgtgggatcttcttgcagtgattattgtgtgtgagattttttttctttttggtctatccatattgttatattcactcaggtattttttttttaatcttattccagaatcagtggtttatattgggttactgtttaacaccaaatggaattggcattctgcagatttaattaattatgaaaccagggtctcattttccttgctgatacttgttgaaaatgagattcacattctagtctttattttcctcctgttttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaaatcagtttttttctctcaaataatgttctttatttcacgaaatcgtcaatcttaagcatgagcagggataaacaac

SEQ ID NO: 94792 - DNA, 1050 bp, Homo sapiens
gaggcagagcttgcagtgagccgagatcacgccattacactccagcctgggccacagagcgagacttaaaaaagaaaaaaaaaagaagaagaagttcgagaccagcctggccaatatggcgaaaccccatctctactacaaatacaaaaattagccaggcatggtggcagatgcctgtaatccccgctactcaggaggctgaggcaggagaatcgcttgaacccagttggcggaggttgcagtgacccaagatcacaccactgcactccatcctgggtgacagagcgagactctatctgaaaaaataaataaaataaaatttaaaaatataaaaagcaccattgcattttaggaaagctatcatatgttgtgtatttcatagagcattttcacttaaacatttgtgaaaagcaccaagttttctctactgctaagagttgtttaacatcaactaatagtgacttctttattgtttctaatgttgtacggaacaggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatgtacttagttttcatttttgtaattataaataatattatttctaatgtcaagtctcctattaaatagaaaatactgggtaattttttagacattcgtgggggaggtttaattctgaactgaagtataatatgtgtaatataagcattttgatcaaggttaatgttacctttacagtagtgtagtgaatgctacttttctctttctgcacattttatttaatgaattaaagacataaaccttttctctcaccagcaaataccaaacagctatcatatgatgaggttgtaaatcagtctagtccaagcaactgtac

SEQ ID NO: 94793 - DNA, 1979 bp, Homo sapiens
gcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagccattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggtgagctcagtgagaagtgcatggataatgcttaaagagtaaagaatggaaacactccgttttaattactaatctttttttcgtctgctgtttattttactgatgattaaaataaaccctcactagaagatttcttctgttttgtctgtttaacatttattggcacctgaggcatgcagagtactgataagatgttttcagaatgtagaaagtaaagttgtttaaattatcagccaaaggtagatgttgaaaatctcatttatggatttaattcattatctccctagtttatattcccatggtagtttaaaagtagctaataaaatactgtgaggaggccggacgcagtggctcacacctgtaatcccaacactttgggaggctgaggcgggtggatcacctgaggtcaggactttgagaacagccaggtcaacctggtgaaaccctgtttctactaaaaatacaaaaattatccgggcgtggtggcaggcgcctgtagtcccagctactcgggaagctgaggcaggaggatcacttgaacccaggaggcacaggttgcagtgagccgagatcatgccacagca

SEQ ID NO: 94794 - DNA, 1068 bp, Homo sapiens
aattagcttagaaaacttcttcagggtttctgcttgctctgttatttttccacctagaagaatagtaaaaaggaagtgctagctgtggtttggtttgaacagaccaacagcagagatgagatgaggagactggaaagtaaatgccagtagtattggtgaattttaggagctttcgtttgaagagttatcgttccttgattaggggatgtgaccaaggaattaccaactttaaaggtggtcacagaattagggcttataaatggacttctttcagatgacatttttctttgtgagacctgatcaggaaaataagtacagctttcatttcttgattgtccttcttaataatatcttagagtttcaataataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaagga

SEQ ID NO: 94795 - DNA, 1218 bp, Homo sapiens
ggttaattgaatgataacagacacataaagattaggatttgtcaacattatttgcctaaatgtaggtcagaagattaagtgttgaaacttgaccagagctggtatctccttcagtgtttcatcttaaacagatatcttcctatgtgtttatagatacaaatgtgattttgggctttatttttgtgaagtataaatgtagaaattttttttttttaggaagtcaaagtgaattgggcaacaacccctagcagtcaaaagaaagatacaagcagtaagtatattttatgctctttgaacatttgtttttattgtacccagtagttttattgtaaagcctataaacatcatacatgtttgcagtaatgttttgatcgttatcctaagatatgattgaatgtgtttgtgttaataaatttaagaacaaatctaatctttgtcatcaggtagtaccgttgtcagcacacagcgttcacaaggtaattgtatcttcttaaacataaaatgaaatctcttgaaagggtattcactaaccacctgaagtttttttgtttgatatttgggggaggggggcgggaggagatattatttctatttgtctctctagcaatacttttctcccttctcagtgttgaccaagtataacttgtccgctactttggtgctagttcaagctttctgacccgtttggtagcagctgatgccttagaactactttcaccaactaaggggcaaaataccctcctttcttgaggtcaccatttgggcttcatacccagatcttccaaatgcttgagttgctcctcaaattttgtttcccaaagagcaatccaaaatgttgtttaaggcctgtcaaatatgggtaacttttctttccaaatatgctttgtcaaattgatgtatgtgtccattttaaagtgttggtccaacaattttgcatttttaaagtgtttctttttttgataattgtcttttttaaaaacttcagatatgggttggttatttctctccaatgcttttttaatggttctgatataaagtgaagggattactgttttcattctgttgccttcagtcttagttcacttgcacatggattcacataaactgaatggtgtaatgtctgggcaaccaaaactgttggcttttgagaaaactgtcaaatactttaacatcaaactgttgcaatgcaaggtatttctttgattgttcttcacaaaa

SEQ ID NO: 94796 - DNA, 1031 bp, Homo sapiens
tcactgcacactgcaagctccgtctcctgggttcacgccattctcctgccttagcctcctgagtagctgggactacaggcgcccgccaccaggcccggctaattttttgtatttttagtagagacggggtttcaccgtgctagccaggatggtgtcgatctcctgacctcatgatccgcctgcctcggcctctcgaagtgctgggattacaggcatgagccactgcgcctggcgggaagataattttttaaaggcttctgagcaagcaaaaaattgatgtcagaaagttcacattctaaaacttattctaaaattttacttaccagagaatctcttcagttttcagagcctatttacctatattttaaaacaggtttaagaaggttggctaagattttctgctactcagcaagctagtagcagcaaggagcaatgtacatttgtagcagtaaaaagtaacttataacagggaggggatagaaaaatcataaaaagccgaagtgagacttcagaacttaggagttcagtcaaacttaatctgtgtagcttgaacaaatggttatatgatgatggggtatgtgtagctatatatccagttaggatacctagtcattaatattaaattatagtactatagtataacctgttgaagaaaatagctatgtataaaagcagtgtgattttaagtgtttgcttttttttttttactttttaattattttagagacaggatcttgctgtgttgcccaggctggattcaaactcctgggctcaagcattcctcccacctcagcctcctaaagtagctgggactacaggagctggctgtttacttttttgtttgtttgtttttgagacggagtcttgctctgtcgcccaggctggagtgcagtggcgcagtctcagcttactgcaacctccacctcccgggttcaagcaattctcctgcctcagcctcccgagtaggtgggattacaggagcctgccaccatgcctggttaatttttgtatttttttttaatagagacagg

SEQ ID NO: 94797 - DNA, 1020 bp, Homo sapiens
ccctcccgcccccctttaaagttgtgttcttcggtatcattaacctatctacattgaatctagacacaacaaagctaggcataaatggccgtcactttattaaaaatgcgtgctggaaaggtccacctctaatgtgcccgtgagttgggcatctggaagggtgtgcaggccccttggttcctccataaagacctgtgagaatctttgggcatctggaaaaaaaatcgagttaatgtcaatatgttaattaatctactgcttttgtctgggaacagtgtctgtccagattcagggagttagaccttcgctgcaggtgtcactcttcccccaccaaattgttggtaatagctttgagtaacaacctctgctattgatggtctttcaaaaacaaaacaactcacagagctggtaaaaggggaaaatataatcttctgtttttttccctcatagcgattattggagccggaattggtggcacttcagcagcctattacctgcggcagaaatttgggaaagatgtgaagatagacctgtttgaaagagaagaggtcgggggccgcctggctaccatgatggtgcaggggcaagaatacgaggcaggaggttctgtcatccatcctttaaatctgcacatgaaacgttttgtcaaagacctgggtatgtaattttggtcttggagctcaccagattactgtgtgacatccccggatatttttatcagatggagaactgaaatttctgccttgttaattgccttacagagacgttggtaaaactgttttcctcactttcttgttagttggtactgcctgagttaggagcagttctgctgtaatgggacactagttgtctgtatcttcagttatctggaattacagccatggggtgggggtgggaatggctgccattgtctttttttttcttttgaggagtttcgctcttgtcgctcaggctggagtgcaatggtgcgatcttggctcactgcaacctctgcctcccgggttcaagcgattctcctgc

SEQ ID NO: 94798 - DNA, 1023 bp, Homo sapiens
gccacgaagatgcatgtctgacatctttgtttttaaattgaattcagttggtactctggcttttttcctttgactatccagtttttttagacttttagtctaaaaatagccaggtaaaaatatatctacttttgatatattaatatttacatgatcatctgacccatcgcctagcaaatctgcttttggacagtgtagtgaaagtatagtgtttcacactgttccaaagatagagctcctttatgtgtctcctgagaactgagggaagccccaaattcactcagattacgttctttcatttgatcagcatagacaccactgacttagctgtgctttatgtttttgcaggtctctctgctgttcaggcctctggtggcctactggggatatataatggagagactctggtatttgaggagagcaactggttcataattaacgtgattaaattagtttggcgctatggatttcaatccctccgtatgcacatgtgggtagaggacgtgttagacaagttcatgaggtaattttttttccttccatttaacctaagatcttttaatttaggttaaattaaacttgatgaactttaggaattatgatttcttgtaagcattttctacctcacagcaaggcctgtttataacattgttaggcaaaatgttttgtagaaactatgcagactatttgcttggatattgaaaggttggtttatttttgcttctgaagtgtattttgcaaatgcttctttagtgttgccagatactgttagatgccttgaattcttatgacaacttactctggtaggtactgtttttagcttctttaaacagatgcagaaggtggcggtgtagagaggttttaaaaggcaagttcacccacatagtaagtggtatagctggagttgccacccaggcagtctggcctttgagtcttcactcttaatctctatgctgtgctggtgttgtgtatatgaattgagataatgtgtacaagagcttgtagaaaggatcagaaaactta

SEQ ID NO: 94799 - DNA, 1026 bp, Homo sapiens
gagctaggattacaggcatgaaaccaccgcgcctggccttacttctactttttatttttcctttttcttcttctttctttcttccttagtttcttttctttttttttttctttttttttttttaagagacactgtcactgtctggcccaggctggagtgcagcggcattatcacagttcactgcggccttgaattccggggctcaagcagtcctcctgcctcagcctcccaagtagctgggaccacaggcatacaccactatgcctggttaatttttgtatttttagtaaagctggggttttgccatgttggccaggctggtcttgaactcctgacctcaggtgacctgcccacctctgcctcccaaagtgtggggattataggcgtgagccactgcacctagatgtcagtttgattcttatgacgccacttcccttctttatacatccccttccccacatcttgtttggtatttaatggatttctcttcttttccaaaggatctaccgctaccagtctcatgactatgccttcagtagtgtcgaaaaattacttcatgctctaggaggagatgacttccttggaatgcttaatcgaacacttcttgaaaccttgcaaaaggccggcttttctgagaagttcctcaatgaaatgattgctcctgttatgagggtcaattatggccaaagcacggacatcaatgcctttgtgggtaagccagggcttgaaacagtggtggacattagttcacagaggggcttacctgatgctatggtggttcctgactttaggctgtggattggaggctacttttctctgtgaacctcagacattgttagcaaaattgtgcgtatgtagatgtgcatttttagggggagagggtctttagctttcattagttcagtaattcttaactgggggagattttgctcccaggggccatttagcaatgtctagagacatttggagtagaacatgtaattgggaagggagagtgggtagagagcctcttacaaaaagtcagaa

SEQ ID NO: 94800 - DNA, 1585 bp, Homo sapiens
aggcgcctgcctcagcgtcccgagtagctgggactataggcgcctgccaccgcgctcggctaattttttgtatttttagtagagacggggtttcaccatgttagccaggatggtctcgatctcctgacctcgtgatccacccacctcggcctcccaaagtgctgagattacaggtgtgagccaccatgcccggccgaaagataatcttaccttcaaaagtaaaaattctgtattttgtacttactgacattctgaataagaaattggcctcaatgtaataaaaatgcaagggacaactatcttaagggatataacttcttcaattctttagaattatagagaaattatgaagaaggtatacaattatttttagaaggtatgttagaaacactaaacaaatatatgcctccttatttcctctaggaaatccaacaaagatgtatgaagtggtctaccaaattggaactgagactcgttcagacttctatgacatcgtcttggtggccactccgttgaatcgaaaaatgtcgaatattacttttctcaactttgatcctccaattgaggaattccatcaatattatcaacatatagtgacaactttagttaagggggaattgaatacatctatctttagctctagacccatagataaatttggccttaatacagttttaaccactgataattcagatttgttcattaacagtattgggattgtgccctctgtgagagaaaaggaagatcctgagccatcaacagatggaacatatgtttggaagatcttttcccaagaaactcttactaaagcacaaattttaaagctctttctgtcctatgattatgctgtgaagaagccatggcttgcatatcctcactataagcccccggagaaatgcccctctatcattctccatgatcgactttattacctcaatggcatagagtgtgcagcaagtgccatggagatgagtgccattgcagcccacaacgctgcactccttgcctatcaccgctggaacgggcacacagacatgattgatcaggatggcttatatgagaaacttaaaactgaactatgaagtgacacactcctttttcccctcctagttccaaatgactatcagtggcaaaaaagaacaaaatctgagcagagatgattttgaaccagatattttgccattatcattgtttaataaaagtaatccctgctggtcataggaaaacacacggttctaattaagtgtgaaggtatagctattgcacttatgccatctccaaaatttcttaagtattctttcactatccattaggagtttttcttaaacttgtctgataataagaatcacctggagttaggaggtggtggttgcagtgagccaatctcaccattgcacttcagcctgagcaacacgagcaaaactccgtctcaaaagtaaataaaaataatcacctggagtttgttaaaccatatggattctcaagctcctctcttgaagattctgattcagtaggtctgggagtggcgcgctggattttgatcaaaattgtagagcattttaaggtgagtacctgagggagaact

SEQ ID NO: 94801 - DNA, 1816 bp, Homo sapiens
gcccatgcctaaagccttgactttcagaatgttgtcttttgattcttctgtcttgatttgattaggggtgaaatttagaagtcttagtaatgtaacttgaagatgttaaacaaaaatctcaagtaaaatgaaaagcaaatatgggctactgaattaagaaactggcattctagtattaaatcctcacttcaggagcttttaaaaatactgagacccccccataaccagagattcagattcaaagactgaggataggaccttagcattgtagctatttaaagtttctaatgtgcacccagggttgggaatcaccaatgtgggtgtgaaaatgcctacaaagggttttagtgccttagaagtcctaagaagcccaatctgtatcaaagcagatccattttgcaaggatctttcttttagaactttctcagttctcttagtaagaactttagaagtaatcttgataataagcacagacagcctaacagcagaggcaacttaaataactcctgagcagttggcactagaacagaatacttggaatgacaccaaagttaaccaagtccagcatatgtccaaagagttaagtgtttcatttactgtagcattctgggtgagaaattggttgctgaaatcttaagacagtggtctcaaccttggctgcacattggaatcacctgtagggttttaaagcatccaaatggtaattaacaggcagcaaaacttcagaactagttctgcatctactgtgcaaagatcatgattaactgtcaagacactggtagaacagaacaagcaaaagattaagagttcaaaagtaaatgcaaccaatttaacatgtagtgttattaaaaaattacaaaggcctagaccagcctgggcaacatggtgaaaccccatctctacaaaaaatttttaaaaagttggccaggcatggtaatgcgcgcctgtggtcccagctgctcgggaggctgaggtgggaggatcacttgagccttggaggtcaaggctgcagtgaatcatgatcatgccactgtactccagcctgggcaacagagaccatcttaaaaaaaaaaaatccttccattgaatagaaacttcaaagtccttcatcagatcatggcattagctactttagcaaaatagtgtaaactttggttctgagtaaaaatgacttcttccctaccacagttgtgaatgttaatatgctgataaaactgccaagatatatttgataggtaggggattaaactcatggtttgtcaaaagagtgtttttttctagttttattcttaacagatatgttgaggtattcatatttgtttccttttgtggttttaatgaagacaatttgtaaagtaatactgttatgtatatgctaaatgttggtaaatactaattaatttccatcatttgtagacttgttttgcaatgggatatatttttacttataataccaatttaggctgggcgcagtggctcacgcctgtaatcccagcactttgggaggccaaggcaaacggatcacgaggtcaggagatcaagaccatcctggccaacatggtgaaaccccatctctactgaatacacaaaaattggctggacatggtggcgcatgtctgtaatcccagctactgtaatctcagctacttgggaggctgaggcaggagaattgcctcaaccgggaggcggaggttgcagtgagccaagatcgcaccactgcactccagcctggcaacagagcgagactctgtctcagaaaaaaaaaacaaaaaccagtttaggctgggtatggtggctcaccagcactttgggaggc

SEQ ID NO: 94802 - DNA, 1026 bp, Homo sapiens
taccaaaaatataaaaattagctgggcgtggtcagggctcctgtaatcctagctacttgggaggctgaagcaggattgcttgaacctgggtggcagaggctgcagtgagccgagattgcgccactacactctagcctgggcaacagagtgagactgtctcaaaaaaaaaggtgaaattagtcattggagacttggcattagaatctcataaagcaaattgttagccttaaatccaaaagatgtctgtcgtataaagggcttagagttgtttggtgtccctgtggcttgaacaaagctttgcaaaccgacatgtaatattaaaaaaccattaatgatttggtgaaaattcttaaatcatcatagttatgtctgttacctgagttgttcttttcaaatttatttttctctttcttaggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaatgctttctcagatgttctgaatatagaatatcagctctcattccagttttttctaacatgaattttcctggttgacattgatttcaaagggttttatgcattaaagtgaaagaatcttattaaatgtgaaacatggcaaggattccttctgtccatcatctttcaacactgaacagataaagaagttacaaacatgagtgagtttcttctaaaacactaattttcaaaacttgtaagaatagtaactttgatctagcctgactttcccaagtacatctacattccaaatatagtacaacagaagcaaaagacaagaagtaatgatgtagttgtttattttgaatataatcatgaagtggggaaaaattttaatacaagagtagaaagaggattccagagaaaaacattccagtgtatcatggttctttgt

SEQ ID NO: 94803 - DNA, 1035 bp, Homo sapiens
ttttattgcctttcctcttcccaaattactttgcttcctagaatgtctaatttaggtaaccctttacgcccccactctttttttcccctgagacagtttcgctctattgcccaagctggagtgcagtggcgcaatcatggctcactgcagcctcaacgtggcaggctccagtgattctccgacctcagcctcccaagtagctggaaccataggcatgtgccaccacccccagctaatttttgtatttttggtagagatggggtttcaccatgttgcccaggctggtctcaactcctgagctcaagcagtccacccgcctcagccccctaaagtgctgggattacaggcgtgagctacctcgccctactccctcactctttacagcaatacattatttttactattttagatttcattattcccattgtataaattttagcaaattatcttaactatacctatttacttgtttatgcttaaatttttttaattggttatataatctttacccttttcctttttcagatttatggacaagaagttatcatgtaagtttgttgttgttttggggttttttttaattatttaattgctttttacatgtgtcttagcaatgtttggagcaactttataaaaatttaaagcagccaggcgcgatggctcacggctgtaatcccagcactttgggaggccgaggcaggcggatcgtgagatcaggagatcaagaccatcctggctaacacggtgaaaccccgtctctactaaaaatacaaaaaaaaattagccgggtgcagtggcgggcgcctgtagtcccagttactcgggaggctgagtcaggagaatggcatgaacccaggaggcggagtttgcagtgagccaagatggcggtactgcactccagcctgggctatagagctagactccgtctcaaaaaaaaaaaatttaaagcacacaggacctctaattcacatccgttagttaagcagattacttaatcctaactagacaattttatttacctaatttctgataatt

SEQ ID NO: 94804 - DNA, 1610 bp, Homo sapiens
atattccctaacattaaaagagtgcctggcacatagtagatgctcaataaatatttgttgaattgaatgttttcctgtagaaagaacagactttaaagaatcagtggctcacacctataatcccagcactttgggaggctgacgcgggtggatcacctgaggttgggagtttgagaccagcctgaccaacatggagaaaccccgtctctactaaaaatacaaaaaaagttagccaggcatggtggcgcatgcctgtaatcctagctactcaggaggctgaggcaggagaatcacttgaacccgggaggtggaggttgtggtgagccgagattgtgccattgcactccagcttaggcaacaagagcgaaactccgtctcaaaaaaaaaaaaagaatcaagatgtttgtacatcttacaataacctctagggacctctcatttcctggaagaatgttctgcccaatttattctgtcattcacctgctttctagtaatagtttgagccctcctggtgccatcttctgtttgagtcaagacagtcttggaaagccaaacacagtggctcacacctctaatcccaacactttgggaagccaaggagggaggatcacttgagcccaggagttcaagaccagcctgggcaacatagggagatcccatctctacaaaaataatttttaagaaagtattagccaagagtggtggcgtgtgcctgtggtcctagctacttgagagcagaggtggaaagatagcgtgagcctgggacgttgaggctgcagtaagccataattgtgccactgcagcgcagcgctccagcctgggcaacagagtgagactctgctcaaaaaaaaaaaaaaaaaaaaaaacttggccaatcacactaccatgtccctttaattgaccaagataatacatattaaacctgtagcacagggcctaacacataatgagcacgcagtaaatggaggccttactctcagctttttctacgttcttccttcttgccacaggaccgcctggcccggtgcaccatgcattgcaacgacaaagccaaagattcaatagatgctgggagtaaggagcttcaggtgaagcagcagctggacagttgtgtgaccaagtgtgtggatgaccacatgcacctcatcccaactatgaccaagaagatgaaggaggctctcttatcaattggaaaataaaagtatttgccagtggccatcagggctgagggcaagaatatattttttataaggaattgggaattttagtcttttaagcaaagtttacgaatgaagaaatgaaggatggccacaagcgtaaggcatatgtcacttgcctctggacactggttattttatgtttcagtccctaaaaaatgaaatggaaaaaagtggtgctaaatcgagtcagagatattacaggagagttttagagcttattatttcctgtggccagtgcttgtcctggcagtaaggctttcccctgtaacaagccagagccctccaaggtaccagactcttcttactacacaggtactaacaggctggcaggttagagttggtggagtctgaggagagatattttctctttgttgccaacatcctgtttac

SEQ ID NO: 94805 - DNA, 1084 bp, Homo sapiens
gaatcgtgaaatgcccaccagataccaagagagaagcccagcaacaggcttatttcttcatctctgccacctggctcaccttaggaaatttctcctaactccaaccctagcccagggatacataaattatatacgaattagggttagaatgagtggaaacaaagttctccacgatagcccaagggaaatggctggtagcgtctgtggggaactcatctctcactcagtgctttcttttctgttcttttggggctttttttttttcatgcaaagtctgaaaactctccattcctgcccacagagggaggcaggagcctttataaccctgatgcctcaggactccgggtcacacaggtttacagagagggtagatgttccaaaactagagaattttagtcctgaaagcaggattcaaagccattgagatccataactcattcttccatttttttccatgggtcaattcagccatccaagttccttgttctgctactggcaataccagatgaataacctcttcctaaaccctcacagccctgccagctggaggtggccactttatcccagtcctttgtcccaattctgaggccattacacttgtggaattacccacctggttctttatcaagaaagccgagtggaggaccagttctctctgacagctggggaagctggagccaggtcagcttgcagaaacagagcaaatactttagggtagccaacagatgcttttgttgttggccagcatctgccccaaaaaaccactgccctacaatgccctcagccccctatggtgcctgtccctctagaagcccccatggggagctggtttggagctggtttagagctggagctgcccagcaggcccctagggcagatgctgtaccaccctggccctcctaccaggctcctgcccagactgggtcctctgtgtctttgcagctgctgccaggtccgaaaacactgtgagtggtgccgggccctcatctgccggcacgagaagcccagcgccctcctgaagggaagaaccgcttgctgccactcagaaacaggtaaggagactcttctctggtgggagacacta

SEQ ID NO: 94806 - DNA, 1037 bp, Homo sapiens
tatctcatgtggctttcttgtgcattttttttcttttatttttagaaatgagatcttgctatgttgcccaggctggtctcaaattcctggactccagcagtcctcccactttggcctcccaaagtgctgggattacaagcatgagtcaccacgcctggcctttcttgtgcattttggggaaaaaaaaagttctgtgttcttataacttgaccattgctcttggcctttcttcttgacatttcattggtttcttcctgtcttcatttctcttagatccccaaatataaagggcagatgatgccagcgtcataggaaactggcattgtcattagtaaacgcttctcagacaatttgagtgggacagcagagggatgtggtgactgaggctggaggtgagagatcatgggttttgggccatttggtctcagttttttctgagttttctgagggtttttttgagtttttttgtccagtcactgggcaagttagttttctggttcctgtttggatttgtttcctcatctattggacttgaatcagaagtggcctgtgaggtttttcacatgaccacacactgatggattggtagagatgacttggagagccagggtggggagggttataaggctgactgcaggttttaggaagtactgcactgatccattggtgatgctaattgtcataggcccaaggtagggaagtggtagtgtcactgacacgtatttgattttcttggaactagatgcttttttacattcaggttcaaagattctagttgctggaactatacaaaggagcaggctttctctgccttgtcctcaaggagcctcccatgcaggtgagaaaagacagcatgggaacccgtgggggaatgtgtcacaatgatacgggcaaacttggctgactgcttaatgcatgatttagaaaatagttgccatgggagtgaaatcaatagcatggttggggacagagtatttttatcaggttggttgtcaatttgtaaagcatgcagagaaacattagctggaggcaggacg

SEQ ID NO: 94807 - DNA, 1062 bp, Homo sapiens
gggaggcggaggcagaagaatcgcttgaattcggaaggcagaggttgcagtgagccaagatcgtgccactgcactccagcctaggagacagagcgagactcaaaaaaaaaaaaaaaaaaaaacaaacaaacaacaacaaaaaaaactatcaatagtagcagctaccatttgttgcatgtttattgtgtgtcactcaatataccacatttttctcatgtgtctctcgtttaatctctaaacaaccctgtgcaagagttggatatctttatctgcttttacagtgaaggaaactgaggctcaggcaactaaactaaagtcagcagccataagaagttgggtgaggatcctagtagcatgaacccaaggcaccaagttgggagtgccaatttttgtgcagggaaaaggggcagtgctgggcagctggggtcagaggacctgacaggagggaatgggtggagtttaggtggaaacgaggtctaggatcaggttatgcatgctaaatctctactcaggacttggggctgggttctgtctctgcgctgggttctgtgagtggtacagagcccatggagagcttagaggataggagtgatttcattcagcaaggtcagtctagtagtaggagcaaagatttttttttttaagctgttggcaagaaaaccagtctaacaactattttgatagcacagggagagatgatagggcctgaattggggcagtaacagcagggatgcagggggatggataggatggacggtgtggaggctgggtgtgtaggagggcttggcttggatactgggtgaaggagagggaagggctgacaatgactgcctagttatcagtcccgcccagaaccaaggaagaggtggaagacatgagttcaattttgaacacatgatctggggtacaggccttgtggagagtggtggaggttggagatagtgtttgggcatggaagcaggggaagcatctatgggaatatagggtcggtccggtgccttggtgggctgtagtgataacttcaacagcctacacttgtctgcctttgttgaagtagggagg

SEQ ID NO: 94808 - DNA, 1072 bp, Homo sapiens
taacccacctagcaatcttatgagatatggtatctccattttagagatttaaaaaaaaaactgaactgaggcacaaaattgttaggtgacttgcccaagttccctctgccagcaagtagcagaataaggatttgagcccaggacccttgcctgccatcctagccatgctgcttccattctgactctccatatcagcctgtggaaggctgtggatgctgaggtgcctggagttgtttgtgtgtgagagcaccatcgtgtaacagacttgggctaaatgcagccagactttcagacagccactctccgacatatttaccatgatgagagtaattcccacataggtggttgtcatgctggttaaaaagaaatactgcccttcccagtgctaggaaatataaaaaaacaagtatggtagagtggttttttccctccttcagtcaacagttcaggtattcagatgatcacaagaggcatgctatttgacatattttattatgaccaaggaacctctaataataaattcattggtgggggcttgtttgcttttctaccataaattttttttaaaggtgtttgatttgaagagtgatctgttgatgtaggcagtctgtcccccagtgagtgacacgcctggaagtcatggggcacattgagccacagcccctggggcactggcttcacctcctcctcatccccctctacacctccccaccaacatttcccccaaacaatggcagaaggctgcagagtctttaacacttttactttaacacttttagttcttcacagtccaactaaagatagaacctgcgagagcacagttgctaatagctggcttactttcagacttgtccccaccaactttagcgatgacatgaacctacaaaaagcacaggcatttccactgacttgaaggaacagcagatgagaacaaaaatagcatttgctcttttacttgtatgtaagaacttcattcagctggcagcatttttgggtggtctttgtacctccgaatagtggacacttcagtatctggttcgggtctgcatccccaagtgttagagcagggcca

SEQ ID NO: 94809 - DNA, 1043 bp, Homo sapiens
ttctaacatcatttattgaatagtttattctccactcactgatctcaaatctcactttgtcacttgatacattcttaggagtacttgggtctgtctgtcgagtttctgttctgttccattgatctaaggatcatggctataatgaaccactcttatgagttggaatgtgttattgcactagaaaattaaggcagaaaatattcaggaccaagaagataaagtgtattccagtggatacccatcacttctaaccctcataatgagaccttgacttccctcctacctaggtgatgttgaagggaaggattacttaccacgtttctctctctgttctctggccattctctcacttggccagagactggtgggcactgggtcttactgtactgaaaggcatggtgaacctgcttatcctctctcctattgtttctggaacttagtgttttataagaattgggccgggtcatgaggcaggcctgcaatcctccacattctggtgaactgagactgtctattttcatgtccccttctcaaatgggagtactagtgtagagtatgccatggcatatgtggaaccacagaccacacctggcacgggaacaactagagaatgaaaaaggaacttaagtggcaagtcataacattgttttctatattaaaacaaacttagatgtgttaatgaataggatgcaagattgaaatatcaaggttgtctggctgtggtgtctcatacctgtaatcccagcactttgggaggccgaggcgggcagatcacttgaggtcaggagttcaagaccagcctggccaacatgttgaaaccccaactctactaaaaatataaaaattagctgggcataatggcaggtgcctgtaatcccagctacttgagaagctgagacaggagaatcgcttgaacctaggaggcggaggttgcagtgtgctgagattgtgccacttcactccagcctgggcgacagagtgagactccacctcaaacaaacaaacaaaaatatcaaagttaatttttaggataaaagataagg

SEQ ID NO: 94810 - DNA, 1009 bp, Homo sapiens
tggcatatttccaaacataaagaaagccagtgaggagagtggtgagagatgggaatgtgaagataggctccagatcccaaagggttttgttagatgatcaggatatttttcttttcttttaagggtaatgagactcttttgaagcaaaggactagtgggatcaggtttatgttttactctgctgttattcatctaatttctccccacatacccaggaaatgtcctcgggtccctggagttgttacactcatggaaagggtttttgttccttgtagggaggtagctggtggccaaacatgaggcctttgtggtcctggtggttcttgctccagggaaagcaccagagctttccctatcaatcacccactcctgagaaactgaccataggccacaatcacataaaggagccatgcccacatcagggagttgtggcatgagggcagccaggcctctcgtggccagggaagaggaacagttcattttggagtctacagacagaacttaaaagccacagcaggttgttggcggaagttggtggaaatcgacagataagttctcagaacggagactcctctaaggggctggggctcattccttccattttatactggggcctttgcatcttttccctactctgggtctcctgggtagcatttaacagtgtcatactcctagtatctctgtccttccatcccaaacctataggcaaacccctctcttctcctttctggagagcaaggctgggggaaaaccacacacttggatagatcttggccatgggaggaaaacagtggtgccctggcattgtcctttacaggcttacgggagcctattgtgggcctctcttcacaaccgtgtttggtgacatcgtgccaagttgaaatcagctattgtggggatatttacacaatgataactggcaaaaattcaaatcagagttttgtgtctaaacctaagaggccaattttaaacaccaatgaacaattgcgtattccatttgtttaaaatt

SEQ ID NO: 94811 - DNA, 1787 bp, Homo sapiens
ctgagcaggcgtttagtaaggaccacaggactttagtctcaatatctgagtctgttaatagacctgacaaccgaggaccagcccccaaggcagacgtggaaaggtgtaaatggttcatgcaaggaattgcactttgagatttttgtatttgttttattttttggttttagcatttgtagagggtttcttttttgtttgtttgttttcttggagttgctttacgttattttttccttttacttgttttcggcaggaggcccacattcccatagcgtgcctattcctatgccgggccctctcatttgggtcttcttttgtttcccccccttccataacccttacccccacaaacacacactgaagcagaccagcaacccgaaaaatcatcttgtaggtgtgtcttgtgtgcccagttttcattttcagggaacggttcaggaagattagacagctccttccctcctcaggcgatttctgttccccgcctggtctggtagacccaggaacccatggaactgccaccgcatccccttgccccacacacctgcatcttcagggatggtcccccaggtagcttctggggagtccgaggggcaaggaggccaaatcctttggaagcccggacaaggagtgggtacctggggctacaggaaagggaggagatggcagtggcatgcacccgcagtcagtcaaagccaccgggctcaagtcttcctcttttgcgcagcaccggtaaggagagagggtgtctatgcatcacgttggcctgggtgccatttccccaattaccccttggctgcaggctcccttcttgttggctacatttctttgatttctattttaatggtgggaggtggagcatatgaattttgcctatttgctccttgcttaatataaaatcacaaataatgctagacctgactacccttggagagccagtagccggttacctggctgtgcatctgcagattctgtaccccagttcaagatactctgatagaagacaccaacgctgcatgggcctgcccaccaatccctgcggcgagacaggtctaggaggctagttcattcctcatacccccaacccagctcatccgggaaggcagttgggggtttcagtgtcctgggttctcccactgttggtggatgctgactggggacattcagcactgcagaaagaggtagcagccccaggcttggatgtggcctacagagccagggtgaatgcacccggaaagtcagggtgagtgccagactgaaggagtgtgctataaggccctggcggaggcttgggcttgtaaaggctcagggccctccttgaaccatctcccccgtggccttaacatcttttattctttctttttttttcttttcttttccttttttttttttttttttttttttttagatagagtggttgctctgttgcccagactagagtgcaagggtgcaatcatagttcactgtaaccttgaacctctgggctcaagcgatcctccctcatcgacctcccaaagtgctggattacaggactgagctaccgcgcgtttcttgttctttaacttattctacaaacattaatgcgtactcactgtgtgccagactgatcctggctcaagctgctggcacgcagcttcccataaatgtaagctgtttctgcccagctcccacagtcaggccagaaacagctgggtagagacttccccgctgaagtcgagggggcgggctccccgagcctgcttcccttgaagccaggcaaagaccacgtaggaggtggtcactgtgcc

SEQ ID NO: 94812 - DNA, 2477 bp, Homo sapiens
gttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccagggcttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaatgaattgtagtgatgtgtacaaggggatacagggaagccagttaacttcctggaggaagtacaagtgctttcatagactcgaatggaaaccacacatccctcccctcccttgatgtactgcccatgcctccctgaactgcagaaacctcagtagccgctgggaataaggatggcagcccagagtagcagggaagcccatgccagggggacatattagttgccctccaccccattctgggtctcagcttagagcctgcagcaggaagggcttaatctgaacaagaaacagaatttcccagtgggtccttccatcctggaagcctgggcccttagggctgggagggcagtgggggtgccaaaatgtgacaacttttacaatgccaaggtgaagaatagtgtctgaccccccactctcaacctaacttggatttcctggcggcggtgggggggtgccaagagatttatttgcagagaaaagggaggcctggggtctgggcttttgattgggaagggtgactcctcgagcttgggagtgggaagcccataggcacccctccccctttcctcgccacccacaacgtgaattgccacacttcagccttcactgggctgcctcagggggagaggtagccataataactttatgggttggtttgtggggagggcagggtggggagtccttgatgagatcgcacagctgccaggaaggcttcatcgaatgtgtcacgcaggttcatggccagagtgtcggtccagaaggtgttgtcacccaggtgccgcttcctgggcacttccctcatgctgatggggtaaaagccctggggcaccttcattctgtatggccatacacgtgggtacagcatgcgcagcagcacctcaaaaggcagccgcggcacgggcgccacccagtggccgtccactgtgtgcagccgcgcaccgccgtgcccatcaggcctcacctc

SEQ ID NO: 94813 - DNA, 1704 bp, Homo sapiens
acgaggttcatcgtcatgatgctttggattatgtaacatagaagtctcacttttataacatgcaaagagccttcttctaattttactcagaatgccctgtgcagtgggcaggttgaggctcattctcccattttagcagatgggaaacggttctaggcagtagcctactctgagttgagtgtaaagtcaggcctaagactccatggaggctcccaacttctgagggccttttgaagttaaaagtacagctttctgttattccccttaaactgactgactcttcattccctcaacaggactagtggtggtgaatcattacctagcatttcagttttttgcagaagaatattatcccttctcagaggtaagaagtgtccagcacattcagctgttaacagggacagggtagtaaaagggaacttgcatggtttactttataaacttagctatgatttgaaactgaatctgttcaaggattacatgtttgaaaaaaacaaaacatagatggtttgagaaagctgtgtggatggggacagactgtgctcatttggccgaggtggggaggacactgctcttcctcagtgagtcctttgggtccccctcgaggggtcatcctgaggtcaggaaggggtactagggtgaccttctctgacacagtcctcacagggcagggatggactgcacccctgagccccagcttttcccagtggccgccaaggttttcttctcccacgatttctccacaccctgctgctccagtttgaacctctgggaagagcaaggtcacttctttggggggtgtgggtcagtcagtcatggcttagcactttgtctgcctccttcagtccaggggagttgcttgtcctagcgaccaagatatggggtttgtggccacattcagtcattttcagcctccacctttccccacagaaggatttccatgtctgagggtggcgttccctgcttcccaggcctgggccccctttggagatcaggtgtggccccctgtgcactcttgaccaacacgcagtcaccacacccagcccactcttggcacctccggggcaccctcttctcagtctctcttgttgccaggtcctggcctatttcactttctgcctgtggataattccgtttgcgttttttgtgtcactttcggccggggagaacgtcctgccctctaccatgcagccaggaggtgagaagggatttgtaaggggcccaggtgggggcaagccagcaaggcctgggttggcaggggtccactgagggaacctgaatctagccctgtgttggagacacctggactcggggttgggagggccgtgttcacacacatgcgcacacacacacacacactctctctctctctcatattcttgcctgtatctccacagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctg

SEQ ID NO: 94814 - DNA, 1051 bp, Homo sapiens
ctgtgtctctgctgtttcctgagcatacactcttacctccttgccctgaacgctgtcttttgggtctgcactcctgggcccagatcttccctggccgccttccccaagtggcattgtttcactgcaggccttgtgctctagtccttaaggtgacagcgaagtgtacttctctgttgacaagaccgtagatttgactttgcttagctctctcccgctgtctttagccctttgctctgctcacagcatttaaaacttagaggagccataagacagttttgcatatatgttcattgccatctttctaatcggatcaagtgatttgtcctaagatcggcacagcttcgctgccctcgcccttccctggtctcatgggaggcttctcttactgaagacacagtccttgccactgatatcaaagccataggggtgactgctggtggacagacttccttcagctgcaggaaaggctgggggtaggggtgccattggagagaaagcgtccacagcccctcaagtcgcctggtgtcagcagccatgtgcactctgggcatggctgaggttgggagttcacagtggaggcaagactatagccctcagctctggtccagaggcccagcttgtgggtgttggcacagtaattagcccttcattcagccaactgtcatttgctaagcactgacaactgtaggtacttatcagtagtgtttttcaaactgtaggcatgattcattatttggctgtatagtaggtcacaatcagcattttttaaaaaaaggaacataaatagaattgaaatttgagctttgaatcatatatatgtatatatgtgttggggtcacagtgtaaaatgtttttctttttctttttttttttttgagatggagtttcgctcttattacccaggctggagtgcagtggcacaatctcagctcaccgcaacctctgcctcctgggttcaagcgattctcctgcctcagcctcccgagtagctgggattataggcatgtgccaccatgcctggctaattttgtatttttagtagagatggggt

SEQ ID NO: 94815 - DNA, 1034 bp, Homo sapiens
gatctcatcctgcacttttcattctagcctagaatgccatctctttcacctcccagcaggttctagctgcccaagaatgaagtctggctaatcacctgtccccaaaccatcgcttcctcatgactgacaccctcctagaatgcactgccctgtcctagaatgcacctcctagaatgcaccctgtcctcacctatgacttcaccctgcaactcagacccacaactcaccctatttcctgccggtccgcccaggccctcccctgcatccactcttacttggagtgtttcactgccctaccccaggtgcgcatgtttactgggagcaggaggagtacctggaaatagtggaacatggcctgtttgacgtagccgatatcatgaggagccgcctctaggttgtcaatggagtcaaacactattttcactgcttggtgtgcgatccagtaggctgcagggagcagagagggctaagaagatgggagcagtcatcctgagctcacgaggagggaaactcagatccagacaggttagtgatctgcttgaattttatacaaattaggtttcctgattcccagccaggggtggcagggggtgggagaggggggtgggagggtctctatcaaactgtatctgactgaccaagataagggaaagttggagggggaaaacagaataggtgaggctgtgtcacaccagctcctacccaaggataaggcaaggtcagtctgttgtcacaaataccaccggagtcactgccatgaactggacctcaagggcccctatgaaaataaacacacactacctagagagaggtgatgttggaagggcttctacaccctttcccctagcagactggtatggcatctcctggcatctatggccttaccctcagtttcaactcctccctaaggacagcaagtcaacacaggcaggcccctgtgctgagggatgaatctgagtcctgggtgcaagtcactgctggagagcagggtcagcagctcgtccagcatttgcacctctatgatctcagtcatg

SEQ ID NO: 94816 - DNA, 1824 bp, Homo sapiens
aggtattttaattattttaatgcctggtattttaaatctctcttttaaaaaatgtcttctactttttaagtctatttatggtcactgtcattagaaacttttgtaaagttctttaaggagaatgataatattcatcctcctcaaaggtggatccttacatacatttcttttccctttagaaaattctaacatataatattaatgtatttttttgaagtctggattcagtgaccactgtaagtgccaccaaagttagccacaatgtagagtctgctttagaattgatcatgtttgacctcccatgtaacaggaatacagctgttttcactgtcataaggcaattaggagaaacaaatgaaaagactttaaagctttcagtgtacatgctaagtattctttataactcttttctctctttaaaatgctaataacttcttcgttattacaaagtcaatacattttcaattactgtaatttttaagatcttctgaattgcacctgccaacaatttttaaaggaatgtgaagaaatgttagacaagaaaagtccattagagaacatttctatagatgttcatgttcagataactgccttttagaatatcagcaatgacaattatgcatcgatttaatttgctaggacaattctttttatagaaagaatgacataattgttaagccaaatttctttttcttttctttttttttttttttttgagacggagtcttactctgtcgcccaggctgaagtgcagtgtggcgtgatctcggctcactgcaacctctgcctcctgggttcaagtgattctcctgcctcagcctaccaggtagctgggattacaggcatgcgccaccatgcccggctaattgtgtatttttagtagagatgaggtttcaccatgttggtcaggctggtctcaaactcctgacctcaggtgattcacctacgtcagcctctcaaagtgctgggattataggcgtgagccaccttgcctggcctgttaggccaaatttctaatacagaggagaggtcatttgattctagagtgaattcaaggatgtattcagttcattattgcaaacatgtatgagaccctataatgtgtattctgccaagtacttgggatttagcagtgaataagacatgagtcatgtccatagtgaggagggtcagaaatttaaacacccaagtgcaatatactatgataagtagaattgatatatgtgactttgcagtagcacagatgaaggagattgattgctcctggcagattgagttgctgggaaggcctcacagagcataagttacaatgaatgtgaaggaattccctaggtgaacaaaaggagaaagttatttcaggcagagggaattgcatgtggaaaggcatagagttatcataacagctaacacttagtggctgggtgtggtggcttatgcctcgacatggcttggctgtgtccccacccaaatctcatcttgaattcccacatgttgtgggagggaccagtgggaggtaattgaatcatgggggcaggtctttccgtgctgttcttgtgatagtgaataagtttcacaagatctgacagttttataagggggattttccctgcccaatctgtctctctttgcctgctgccatccatgtaagatgtgacttgctcctccttgccttctgccatgagtgtgaggcctccccagccacgtggaactgtaaatcattaaacctgtttcttttgtaaattgcccagtctcgggtatgtctttatcaatagcgtgaaaatggactaatacacacctgtaatcttagcactttgggaggccaag

SEQ ID NO: 94817 - DNA, 1037 bp, Homo sapiens
gttccacagcagctgctgtcacttaggcagagggtgccttccagaagcgccaccgcttagtagcggggattgccttgtgcatgagtcccatttccatccgagagctgtgcgccttgggctctgcaccttccagtatgtgggcgggagagtcgagggaacttgcccggcaggtcaggcagggcagggacagaagtaaatagaagcggatcggtaagttattttaccgcgcaccaataaagagactggggagaaaccagaaaggagagcacgttccgtaaaaacaacaactactagtcggccgaactccaagcgtgaccagctttctgttgggaacactcaaaggtcagtggtgtaaagaatacaaaaggagtggtttttccacgtgcactaatatatttatcgcgtacacagataaaagcatgtggatttggaaactttcttgagttctctcccccttcattttttttaaaatatgtacatagaatcagttatgacagaaataactgtaataattgtcacgttttctgactcactttctcctctttttatcctttttttttttctcttcctccttttatgagagggcaagtatttcccttaatctgagattccctattaggaagaaggtgccaagtggtaatgccccagagttactccgggacattcgtgataaatccttctagcaccagagcccacattcttaaccgtaaggcataccttcctcttaggtgatacacaagataggaacgtaaaactataaataaatgaatatttgggaaaaggcatttttatgtctatttttagaactgcacactttaatgattgacagtttgggaaaaagtatgacttccaacaggtcatatacatactgcaagaactcaatacagataaaggtgcatgtttgttttgtacttacatacacatcttggcataaaggaaaaatgaagacagtgtattccaaagattgcctttgatttgtcctattaagatacttgaagcttaatgtctccacttgtgtgtgtgtgtgtgtggttgaa

SEQ ID NO: 94818 - DNA, 1073 bp, Homo sapiens
ccggtgcccggtattcacctacggcattcgcggctgcagccttcagcacccgcgccattttggaaagcaacccgccacgtcaagactagccacggaggttgagagacgcgcggcagagggcggggcgggaggcagagggggcggggacagaaaggtcaggggcgtggcgaaggtcgctgctttcctgctacaacgggcctactttagctaaaacagaaacgtaaggccaggacgggtcaccctttgtgggcccctgaaaaatacaaaacgaagtttggagagagttgaaaggcgtttgggctgaccatggagatttttgtttcccaccctcctgcgaaagcgctcgcgctgccattggctctggctgagggcgagtccggaacctgtgcgccgcggaactttcggctctgaaatccaagttgcgctgggcgcatctttgccgcgcggtttccgggcggctcccttcccttgcatgctgcattgtgtcgggagttgctgacagccatggcgccgcaggtctggcgtcgacggaccctggagcggtgtctgacggaagtcggcaaagccacgggtcggcccgagtgcttcctcacgtaagtgcgcagatcccgggctcggggtgcgaccggggtctcacgtggacgcgggttgcaggcctccggcaaattgtggagctgggggaaggtaaggggaaacgtaaaatcgcttttccccaaatttcagagtttatgctttcctaggctatcaaaattttaaaaactgttaaaatttgtatagatggatctctcagttgagtgttactgaaatcactctaacctcaattgttaacacctagaagcttcccttgggcttcttacgcccccatccctctacacacagactgttggtttctccttcctcctatgtgctctcaaagcacttagcgcttagcatactttattgaaagtacgaacttgtcacttgtctgtccaccccccatgactaagcttcttcagaaatagaacttccatgtctcttcccaacacaagcgttttatatgtattttgttgaagaatttaaaatgtgatctatga

SEQ ID NO: 94819 - DNA, 1643 bp, Homo sapiens
ttcctcaagctcacctctagaggatttgcatcttagaggatttcttctgcctggaatacatgtttcccaacctttataagactatctccttatctgtaggtttcctctcagatgtgacatctaagagaggttttccttgaccactgtagccaaagcaaatgttgatcattgaatgaataagtgaacaaatgaatggagtggtatataatgtagcagaattgataatttaaggttaattcactatatatctccaagcaaatagatttataatggttttcctgcctaaaatctatacagccgattcacagatacttggttgacaggttttatatatcagtgtagctcatcagcttatatgttgttgggggccagaatctatacttatacttcattcaaattttattttacaaaagagttgggttttttttatttttattaagagtgctgtgaaattattacctgtaattctaaatctcacttaattcctcccaataggattcaagagggattggcatcaaagttcacttctttaacaaaagtgctttatgactttaataaaatattagagaatggtaggatccatggaagccccttgcaaaaacttgtgatagaaaattttgatgatgagcagatttggcaacaactggaattgcaaaatgaaccaattttacaatactttcagaatgcagttagtgaaacaattaatgatgaagatatcagtcttctcccagagagtgaagaacaggaacgtgaagaggatggttcagagatagaggctgatgacaaggaggacctagaagatttagaggaggaggaagtgtccgacatgggtaatgatgatcctgaaatgggtgagagagctgaaaactcaagcaaatctgatctgaggaaaagccccgttttcagtgatgaggattctgaccttgactttgatatcagcaaattggaacagcagagcaaggtgcaaaacaaaggacagggaaaaccaagagaaaagtccatagtagatgataaattcttcaaactctctgaaatggaggcctatttagaaaacatagaaaaagaagaggaacgaaaagatgataatgatgaggaggaggaagatattgatttttttgaagatattgattctgatgaagatgaagggggactgtttggaagtaaaaaacttaaggtaaagttttgagagaagagagagcactttcctcctcaaattagcttttcttctgtttttctaggagagatttaattgtagttagaagatttagtgataagaaatattgtgctctatcttatcagttataaatgaatctgtacttccattcaatttatgttccagttggtcttataattttgtggtagtgttattagttgccattttcacctaataattatttagttattagtttggttattagttattagcttgtagtgttattaagtcagaaagtaatatatacatacaatatacatgcaaatctatatgcatgtgttaatatatttttctatccctaattaatagtttttaatatctttttattttagtcaggtaaaagttccagaaatctgaaatacaaagatttttttgatccagttgaaagtgatgaagacataacaaatgttcatgatgatgagctggattc

SEQ ID NO: 94820 - DNA, 1008 bp, Homo sapiens
aataagacaagatgtccagtattacaattaccactgttgattaacattcttttagacgcataggccagtgtaactacaaaagataaagataagagatgaggaaaactgccaggtgcggtggctcatgcctgtaatcccaacactttgggagaccaaggcaggaggattgcttgagctcaggagttcgagaccagcctgggcaacatggtaagacctcgtctctacaaaaaatacaaaaattagtcaggcgtggttgcacgcgcctgtggtcccagttatttgggagtccaaggtaagaggattgcttgagcctaggaggtggaggttgcagtgagctgagatcacgcaactgctctccagcctaggcaactgagcgagactgtctcaaaaaaaaaaaaaaaaaaaaaagattaggaatactgcagatgtatttatattccactaagagtgaaaaatgaaagtgttggtatttggagaggaaaccgaatggataaactgaattgatattaggaaaataagagaattctgtaaggtagctgaaaaggctggcattttatacactgaagtcatcattgttgtcttttaaaagttagagataatggccaggcatggtggctcacgcctgtaatcccagcacttggtgaaaccccgtctctactaaaaaatacaaaaattagccgggcgtggtggcacacgcctgtaattccagctactcgggaggctgaggcaggagaattgctcaggagacggaggttgcagtgagctgagatcacaccactgcactccagcctaggcgacagagcgagactctgcttcaaaaaaattttaaaaaaagaagttagagtaagaatttgagtttggagtcaaaagggtcagactccatcagatactaatattctaatcaaagaattacttgacttgcgaatagatagatcacttgaatagaatagagcccagaaacaaactcaaaagcttctgggggcgtttagtatattataaacatggcat

SEQ ID NO: 94821 - DNA, 1796 bp, Homo sapiens
agaattgatcctcactagagagatgtttcccttcccttcctctgttccttggtctctgccctctggcctcagtccagttgctgtcattagcagctcagagctgaggctgcctctggcatgtccctgaagcccattggaatctaaatgctgtggagggctggctcctcttgtgctgttaggttgagaacccaactctccatgttgccttcttgtgaattagtttgggaactgaaccgtcactataagagtctgtgcctgtcaaagaatgcatttcaggttttaaagagctgagttaccaacgctcattggaatgcaggtggggattgctctgcatctttgtgcatttggccacagatgcacagcctgcttgctggctaccctgcagtttcttccattccagtttcctagttgttaaacttgatgaatgaatatgttggtggttatttttttaataggagaaaaataaagctggagatataaaaacagctgctgaaaaaacagctacagacaagaaacgagagcgaaggaaaaagaaatatcaaaagcgtatgaaaataaaagagaaggagaagcggagaaaactgcttgaaaagagcagtgtagatcaagcagggaaatacagcaaaacagtagcttcggagaagttaaaacagctgaccaaaactggcaaagcttccttcataaaggtaaggacaagggaaagaaaactgctcaaggggacctttgtgggggaagtggatagcaagtgctgggtgactggaatgtctgagccagctgacagcccacctgcgggatagagatgcatgatgctgactggctggaatcgcaacctttaatgttctagaatttttcatgtagggtcctcacaataacctgggtcctggcagcagcttgtcttccactcctttctctcttagattataagaacattgtagcagtgcagaatacctctatgctaactgattcagttttctgtaattctagtcctttttcatatttatggttgcatacattgttgtaatggtgatgtactatttttggcttttttcacttataagtacattttacagcataagcatgtggtgtttttaattgcaggatgaaggtaaagacaaggccttaaagtcctctcaagcattcttttctaaattacaagatcaagtaaaaatgcaaatcaatgatgcaaagaaaacagaaaagaaaaagaagaaaagacaggatatttctgttcataaattaaagctgtaatatattttgaatataatgtaaatattaatgtgtaagcttatattgtgtcattgttctgttttataataaaattcttgagaaccttcctttgcatcgatgacagatatttgagggttccatagtgtgaaaagacaaacccctaaccatttgcaaagcccttccggttttcactggtatgaagcaggacctggctcctccccaggcccttcctgttcaggcactgcctgagctgatcctgctgtgctcttgccgtggcccaggcctgtgtgaaggccaggccagcttgtccacatgggctggtgagcaagcactggcctgcaggctgtgaagaggacagagccagccaaccccctcacaagcagctgtctacagcagaggtcctcactctttgggctcttgatttccttctcccattgccctgtcatttcataaaacagtagcattttcatgcctgtgccttccttcccctttgggaaatgatctcatgtcatctgaacaaaggtttaatgtaggctgtagagcactatccacaatcagctgcagaggac

SEQ ID NO: 94822 - DNA, 4226 bp, Homo sapiens
gaaggaaacaagagtccaaagaaggaaggagaagatgagcttgctcagggctatgtcaggtgcagttgagataacctagcaataacagcctgagttacaaggaattttctttctctccctaaagctaaggggaaggtactgataatgatggactgggtaagttttaaaatgcagcttgccttaggatttactatctcttggttcttatttcagagcaaaagtaacctgaacccagatgccaaggagtttattccaggagagaagtactgagccgagaaagctttgaggaagacttgtctgtccccacatctggggatagtaatgcacaaaatggtggagctgaagagggggatggggcgggcgaggggtgcacagcgggaaggggagtggtggtctcacaatactgtgactctgagtaactaatatgctcagtcttattctaagcctctgagtatttctattttgttctgctgacttttgtttggggagtttcctgttttgtttttttaaatagctctttcgagttaaggaaattgcattttccccccttcatcagaagtgttccgcggtgtgtatttaaacaaaataagctgactaagaaaaactggatatttaggaaatgcccctctcaccctgctgtatacttatcagggacagtgagcacctggagagctttttgtggaatctattgagttggatgggaaaagggacaagcagaaagagcaggtggtgcaaactggaatttgaggctcagctgccccacccccggggtctcctgcaatgaactcggataaccaatgtgctgtcaagcccttgcctgtttgtcctgaaccccattcaagaaaacacagacttaaagtacttagtttacagtaacttttgatgattgttgaaagttgtaaatcagaaggtagggctgtgatggtggttgtcacttgagtcatttagttactgttgtcctgttcataagcctgtgttcaccaccaccatcagactcaccatttataagtagaagagcactagggttgatctgccacctcatctttcatgaagtctattccccagcctcctttttaagaaaagatactgctaccaaaggcataggggaggcctgctgtgctggcaattagcatgagcctgcagaagtcatccttgaatctgttgtgtcttaattttatttggacagtttttttttccagcctcatcaacacttggtcttcctggtgtcttaattccctcagacaagtttatgcacttttttaaggaaatatttttcaggacactagtaagaagctcagttcacagtttggatatttcttcccacattacagaattatggaaaggaactcaaaatcagcctaggaaagtgagtcctgcttgacccatgtgactgtgtacctgaccttctgggatcttttcagctattaaaacattttactgttcccacatacccagctttgcaagttttgtagattgacctcttagggtgtgtttctttgtctttcctgcctttaacttgctggggtcttttgttgctacccctaaggaactaaactgggtgccaggagctaccttcgtgtatagagatgtagatggcagtgtggggtacaggagagccatccaggccattctcccagggatgaggaattggagagccctgaagataatagtggcttctttctgattgctactgtgctgtgtgataggcctaatagggaaaagatatgtaacttgaaacaaagttggtataaattcagtatgtggctgtgggacagaggttggaaggaaaggactagggtatggaaagctgaagaaattctccttatgagctctcgttgactttttgaacagtgataagctaatgccagatttaaaatacacattttttcctatttgagtctttaggattatatcatttgaaaaaattgccttccttgttaggtcacatgtcataggagagtagcttagagaacttgcattaccagacagacacattaattcccaaagcctctatgttgagagaatgaaactgttaactctttttcagagaggactatgaataaagaaacttctttattcaagcttcagctttcagctgggttgtttcctctaaaagggaaagggcattgcaagtgcatagaggaaatctctcccttctgggactgcttttcctccttcatcctcgtgagcctgtccaagctcagaattccgaaggctgttagaaatgcgttgggattgcagagagaaaggagcttgtctttccttctgctgtgctggtctgttttggatgtcagtcttcaggactatgaaaacttcctgccagtttagcatggacactgagggctggcatttctagtcttcttcagacactgaacatactgactccaggtataggaagcagctagcaaattgattcttttttaaatgcataggactctgcttccggcggttcctcttgtagtccaactctttttgccatctatttatgttgggaggtaggggcacaattgtcactcacaacacaggctagttagagtttgctaccttcttagcagaaaatgcatgtgtgtcttgttggaccttcactggggaaaggctgggagcctctggctgtcagtgacttttctcacagaagaagaaccagcaagccagactggacacctttaccctttaatggtaagacttgtatttataaggggtaattttgatgttgaatttaagccactactttgtttaaacttttttaaattggcaactagaagtttgagaatttgtatagaaatggaacatgtatttctaacagttgccaatctggctggtcccaatgttagtttattagtgattgatctgtaattattgggattatttattcaactctaaaattccaagatgaaaataatttatctctttcttttcaagggaaaaaacccaaatgaatgcattttcagtttctccaggcctttgaactgcagcagaaaattcaaggatacagcctaggcctgggcaaatgcagccctgggtctttgggccagtttctgacaataatagttgagttttgggaatcacataagggtgaaaccagaaacgatcctaaggaaaggcttgacctttgttaacacctttagtttccaaagtcacagcagctggggtccctcttttttttttttttttctttttttttgagacatagtctcactctgtcacccaggctggagtgcagtggtatgaccatagctcactgcagcatcaaattcctaggctcaagcaatcctcccatcttagcctcccgagtagctgggacaacaggtacgcaccaccacggccagctaattatttttattatttttattttttgtagagactggatcttgctctatttcccaagctactcttgaattgttgtgctcaagtgattctcccatctcagcctcccaaagtgctgggattataggctgggtgtggtgagccaccccagcctggggtctctttaattaaggttataatgctaaccatggcttaaaatactaagcaacattttccaaattgtttattactattgctttgattttggagaagctgggaagtaaggaggtgaggtgaatactctgataattaacacgtgttagagaggaaagttgtgtgaagaggctgccaaagtaaacagcacgaatgaatcttcttgtactagggctgctgcaaaccccaggtagacaaatgacagcccaggctcctgaaccatcaggaacccaggaatctacccaactgtgaggagggggcaggccttcgtcaataagggtcccaccatcacgggctaataatctttctcagtttaggtgatattgaggtattgaaactgttagaaatctgacagatttgaccaagatttggagacgtccacataattgggaaggactgagtgtccctagccactctcctctgggataacgcggacgtcattagtttgcgaagtgggtggggagaacaggaggattgactctaatttggtgtgtagtgggggccttgatgtccttctgcctctgtccacatttccccatgtgactcattgcaccctgcattgctcacagggatcattagttctcccggtagacagagcacctctgcagcctctgctctgctgccttgtgaatttcctacacagacttggttagttacaatttggaaacagtttttttgggtttttttcctttgttttaatcttctcacaa

SEQ ID NO: 94823 - DNA, 1018 bp, Homo sapiens
cacacccagtaggcccacaaaacaatgttgttcttgaactatgtgccttaaagtgtgggtatgaaagtgctttattaatttttaaacagtataaaaattaagttgttggaatgctgctgtttggaaacaccaaactttctaattgtgtggaaaacacaggttgaatagtacaaaatacaaatcaacactgtataatattgtaagagaatcacttgcctagtattgacaataccatatcagtgtttttaacttctgtgaagtatttgcgttaagttcattaacagtttttgtagattttatggtaattccccactccctttctcatgaataagcacatcctggaatttgctatctgtgttccaccttgctcttgaattagaagggttttttttttctttctttcttcctttgccttccctttctcttttgccttacaatcatgtacactcaggacttactttttgggcacaggaagattttttttaaaaaaactgaactctgatttctgattctctatagtgattttccatattggtggtgagaaatcagtgtgctagttgcaaacaactgccaaatctttggaaataatagtacagtatatcttgctacccagcaaggttcaggacctttaagagtctctgtgctcttacttacagggcaaatacagttgccctggcatttagaacagacttgcttctatcactgttatgctacagatggaagtggtaaaaataaagaactggtttctttccctctatagcttatgaaattattattatggatctgtatttggaatagacattgatttcttttgtttctatttaaaatatgttaagcagatatatttcatattagtagccttatttaaacctacagtgatttaaatgggttctattttaaatgaattcttttagaactatgtactactgagttgtttttccatctattctttgctcttcacaattttaccttgtctttttagaatattacatttctaatatccataacaggttaggaa

SEQ ID NO: 94824 - DNA, 1005 bp, Homo sapiens
ctgtagtcttagctacctgggaggctgaggcaggaggattgcctcagcccgggagttcagtgctgcagtaagctatgattgcaccactgagctccagcctggtctacagagtgagaccctgtctctataaaaattaaaaaataggctgggcatagtggctcatgcctgttatctcagcactttgggaggctgaggcaggagaatcacttgagtccaggagttcaagaccagtctgggcaacatggatcccatctctaaaaaaaatataagtaagtgttttttaatccctcttgagtaacttgatttgtcaaaaacagattccagagtagtgctgtcactgactgtggggaataactgttcatactcaacgaagagtgctcacttacagatcctaacccctaagggcatgggcttcctgctgaggaaatgagatttagaatacagcgttctaaaaatggcagttaacagattatttattaaggacctggtgggtgcacagaggcatgctagaagctgtaaaggacttgattcttgccctcaagaaacttccaaggttatagactagtcccaaaacaagtaatgagtgatgctctctcaaatatacatacaatcaaatgtgagatggaggtgaagatggggaagaccttaggctcggagattgtattcaggcttttatagtggcatttatttgatataattatgcatttaaaaaacaaattgtcatcacatcagtctgaaatgtatggagacacttgttggtgagaaaggttttttatatataataatttacccataggaatgtttttgattaacgttgtctgttaaagacttcacaatatttcccccattaatagtctatatctttttggagctgatctggagaagtcaaggaccatatgctaattgctatttgatgttattctgggaggacaattgattggctttggggcaaggagttggaacttgaggactcaaaggtgggtctgagtctagagatcttgccac

SEQ ID NO: 94825 - DNA, 1056 bp, Homo sapiens
aagtagctgggattataggctcacaccaccacacccaacgaatttttgtatttttagtagaaacagggtttcaccatgttggccaggctggtctcgatattctgacctcagggaatccacccatcttggcctccccgagtgctgggattacaggcgtgagcctctgcatccagcctcaaactctgctttaatctgtggtgaacaagctggagattaaggtcctgccctgtggattttatatttgcctaagaaagacagataagagctaagtcaggagctctggggaaaggcccaggttggaattatagattcacttgaccaaggtaaacctggtgtgcctgctcctacttcacatccccagacatacttccagaacatttccttttgtatttttgtgtacaaacttccttttgagcctctctccattgtcacatgtcaacctctacttgtcttttgttgattttgaggccacttgcccatgtaagtggcaggatattatagaagaatcatgctgacctgggtctttgaattctggttctgctacctaccaactgagttcctttggtcaagctcttggacttctgagcctgtttcctaattccaaaagtggtatatgatgtgttagtccctggtgggttgcaagaaagaggcacacacatatcagctttggtgatgagggctgaatgtaaacttggatggaaagtcatctaagcagccatattgtctcttggccctagtactttcaaaacttcacagaacattaatttagcagtatttagtatttgagctctgaagacctgccctcttttgctttgttcactcaacatttgtattttccaagagagaatatctgattggattagtctgtcaccttctaaaaacagaaggcccctactagagagaattttgagctgtgccatcatgtccttggtgattgatctccctgaagttcagcctatatgccgtcctcagctgaagcactgagccctggtccagtcacttgtggccacagaagtaaggttggttttatgcattaccagtcacacagatatgcta

SEQ ID NO: 94826 - DNA, 1089 bp, Homo sapiens
tcagccaatcagagccggcatctccctcaaggaggtgttccaccacaggaaaaaaaaaatgaaggaagagaaaagacagacattaaaaccaatcagaagctgaaacttctgagggagtgggcgggcactgcttcacatttagaccaataaaaaccacatatgccattctaggtgaccgaacggcatcttctttggcccaatagacgaatggggcggtgcccggcaaccaatggcttgggttcgggggcggggcgaggaggcagtgtgcagtaagagataacctggcaagtggtagtggcgcttctcgggtgctgtgcttcacgttttggtactaaaggccgagactgttgtggcgacggcgacctctacggcaacggcttaagctctcggaggagtggcagagtacgatctgaaggaggggcttctggttagcccaggtgggctcgggtgcccgggctgctggggaaaggactcgagggaaacgccgttctcccggctctgggggcgccctgcgcctccctttctgccgccgtcggggctgtgaagggcggcacgcgcctgcccgagctcctgtagggagggaaagcgcgcggggtcccacgtcgcggccatcggcgaaaaggggcgtccgctggggtcagcccctgcccctcgggagcaatagggggttttcgtccctttcccccccgcacaggtgctctgtttccccccgactcccacccaagttcctgactcccctcagcgtcctcctaacactcgaaccgaattcttggcctgagtcccatttctacccaggtgcaacaatgctaggcaaattgacccgcgcggcatcccccgcccctctccccgggctggagcgggagggattgcgcgtcgtgcccttcccctattcgcggcccctgcgcgtcctctgcctttttatacttgctccatctcccccttgactccagccctcattcttcatgcctcatttgcctgggagacgttcgccacttctcttgtgccttgcggtccgtgagtgagcccatcaccccctaccaacccctaaattccattctcatctctccagaaaactaacattttccactt

SEQ ID NO: 94827 - DNA, 1398 bp, Homo sapiens
tagtgaaggaaataataaacaaatacataatgtggtaatgtaaaattttaaaaaatactgcagttagggggaaaatgatgaggcaggggctggggaatgctttagatagagtagtcagggaaatctcagataaagtgacatctgagcagagatataaaggaagacagggaaaagacatgtagatatctggaagaagagtttccaaaccagaagaaacatcaagtgccaaagccctgaggcaaaatttatttcaggactaacaagaaggccagctcagaggaagaatgaagaggaaggatgagatgaagatgaagaactatcaaggaaccagaccacacaaagccttacaggccatttaagacaatgcataacactgaataaaaaactggattagagatcccaagagttatccttctagctccttcgctgatactaacttcactggatttcagatttcttacatgtaaaatgcaggaagaaagggtactaaattagcttttccataagatgtgagtctggaaatctataaactgaaaaatgctcaccaatttatggcattcctaagaaaatttcttttttatttttggagacagagtctcactctgtcacccaggctggattacagtggcacaatctctgctcactgcaacctccaacctcccaggttcaagcaattcttgtacctcagcctcctaagtggctggtattacaggcatgagccaccatgcctggctaatttttgtatttttagtagagacagggttttgccatgttggccaggttggtctcaaactcctgacctcaggtgatccgcccacctgggcctcccaaagtgctcggattacaggtgtgagccaccgcacctggccagaaaaatattttttatcttagagtctactatatccaagcatttatgccttgtagtcatgtggattatttcaataaatcctcattcctatctaaaaatgtcaatattcttgacaaggaaaaaaaatctatcctactgcacatcatcttcttccacaattccccaccttcttccctcacccactctgttgtctgattggccagacaacaagcattgagcagctctatccagagctcagcttctgcctgctcggcacagtcacagctcaatgcctgattagaaaacagaacagtcatcacaaactttgttaacctaaatggggctctgtctcaatgacatagagaatctcatcaccatttcagctcaagtgcaagtatcctaataaataggatctgggggcaactatggcctttttgtatttagaaactaaatctaagaattgggatagataaagggccatgatgagaagtatgagaaatcccagagtcatttcctgtcctgaaaaaggacaaaaatatcaagaaaacttg

SEQ ID NO: 94828 - DNA, 1063 bp, Homo sapiens
cagccaactgcaagccaaggagagagatgtcaagagaaaccaaacctgttgataccgtaactgtggacttgaagcctccagaatggagagaattaatttctgttgtctaagccacccaacttgtggtgatttgttacggcagccctagcacactaatccagcaagtgtttccagctcccctccacctcatctcccgtgtcctctcttaattatgctgttgtggcctctttggcctttctgctttctcaagtacagcaagctggcattcacctcagagcttttacattttactttcactcttcctggaatactcttcctcctagattctatactgcttattcacacacttgtcagatttctgttcaaatgttgccttcttagtgatgcctttcttgaccatctcatttcaaattgcagcctctgttatgtgtcctgatcttgctttgttttcctccatagcgtttgtcaccatctgacatactataaatgtacttgttaattgtctgtctccttgatcaaggctgtacgtgccatgagggcaggagtgagtgttgccttttggtttgctactcactccttgatggctagaatagttccaggcacagagtgcaccctcaagtaatattttgttctgcgttcttttatgtaagggtcagtcaggtgcggccacaagaggagttccaggagaagctcagggaaacaaagtttactatgctcccaggtcctaaaagcaggaggcacgctctgccatacagggccacatgaggaaacacccaagtctgtcaggaggcagaaggggcaggaacgagtggcaggaggaggagcccaggccaaggcctttattggagtttctcgggaaagggaagacagagcagggtaaacagctcaggactggctagtttgaaacatttccacaggctctaagttataggagtggtctgtggttgcctggtacctgaccctgggatgactaaggcagaggaatattgcctcctggggtatacctgccagatagaggaggatggctctgaattggtagtttgcatatcaaagtcaagctcct

SEQ ID NO: 94829 - DNA, 4221 bp, Homo sapiens
tagctgggactacaggcgcgcgccaccggctattttttgtgtttttagtaacggggtttcaccctgttggccgggctggtctcgaactcctgacctcagatgatccacccacctcggtctcccaaagtgctgggattacaggcgtgaaccaccgcgcctggccatataatgttattattgaaggcacaaatgatcagggaagacttcatgaaggaggtgagacaatataggtcttaaaaggatgagcggtttggagaggacaggcacagaaccagcaaaagagtgaagacggcgctggagtttttttttttttttgccgcacgccttcgccgccaccacgcgggagcgccccttccgggagcccgctccgcccggctcttctcgggcttcgggcgagcgcggtgccagcggtacgcaggcgccgggagcctacgagggctcgcaggagctgggaggcgcgcatgcgtgcagctctttggaggcggtagcgttttcggcgtcgagactggaggctgagtgctaaactgtgtggggcgcggatgggatccagctgttagtcgggtaggcataggtaggaccgctgccctgtggggagtagggggttggaaggcggaggccggtatcgtgggggtcctgagcccttcctgtgagatccgggccgactattgtatctgtgtcgcagcggctccgcacaaaatggcggcgggcagacggcgggggcgggaggaggttgggggacccccgggatgggaagggaagctgtgctgtgctgccctgctccgtcgtttattcacttcgctacccgggagggcccgtccgggtactcgtgaaggaccctgcctcgagaagagctgcctgacgccgttgcactgggccgaggatcgtgaagagccctttggcgaggccgaggcggccccttccccagcagcgcccggcctgccgaggctgcgctgggcctgacagccgaggaagcggtggtgagggaatgccgagcagggaggaagcgttcccgtcgggcccgaagaggcggtggagtttgagccgagccctctgaccagcgacattgtgcaagaagcgtggagagaagagcgtgtttgtgtttggggttggggagggggtgtcgggatgaaggagggaatgttaggatccagcggcttttccgggctggtgttctgtgctgcgtagtgcaggtatgaaaccaaagaaaatatcacctctgtgggagactgaggactcataaatggttgtgatacctaacagtatttccaaatttctcagaggaattgtgaaaacagaacgttagtgaattgtttttgtgtgattcttagcttgggccccgttctcttaaaggaagggggaatgtatatatcacagactggaatccttgagaacgtttgaaatagatcttttgttgtttgaggtaattgttaatgagggatacttcagtattacaaaatcatggattgagctatagagtgaaggctacctgaagctaatttttcttaatcttaaaatttgtccttaggcgaagtttggggccaggaccagaaattgtagtagtttaaaggagtcccgatgaaaaacttgtcaccaggatccagcgatttatgttcaagtactttttccaacgagctctggaattttgcacaaaaaattttctgctttttcccctcatttgttgtaaaggattattttttcagggatgttgtgcttgctggttcagatttacaattaaaaattgataacctggagaaaaggattgaccaaaaaaaggtgaatttaaggaagttttcggagaaaaacaaacatgtaaatgacattcaaatagctttaaattttgttaatgattagacatttgagacttagtggacttatgttgctgtcttttaaaaaagtttgacagcattttatattttattttgtactccatattctgtaatatgtacttctaaataattacagggcgtcccagcatgttatacattaaaatatgctgggccattccttccttggggatttatttgtcttggaaccaagaaagggtaaatataacagttggaagaaatcacaaaatcttattcgtttttattaactagttttcataatgtgtttatggtcacatatttattgtatattggttgtatttgttttgtaatccttttttgcattttgttttggagggtgtatacggcaggtactctaggttaaaaaggtttaggtactgtagtttaaaaaagtcatcactttgtacttgactatcttagggtttttcttgggtgctcttaagtaggtgatctccggaaattttgtttttatgtaagtggaagaaaatgagacaagtagtttagtggaaagagaataggctttgcagtcggaagatctggattcacatctcccttttcctcagtatgtgtgagactttggtaaattattttagtctttcttgagcttttgtttccttatctctaaaatggtgacattattacttcctgcttgggatttttgtgagtgactgttaagtgagacagtgtatggaaagctcgtattccttggcacatactaggtgcttaatgttagctgttacttgtatttcaaaattgaagtgcttaggcagcattgtttgatagaaaattataatctgtgggtattctcttctaattaaacggcttaaaaggatttagagtaatagaattttggagttgaaaggccctctaatctaactttcattaaaatattttgtgcttctataaactttttacatgcctttcttgtagaacttatcaatatatattgtaaccatttatatgattgttacgttagtctttgtatctttcccagtgcctggtatgtattagatgctcagatgttgagtgaatgaactcagctggtagtcaccagagcctggactctaaatcatgctctttccactgtaccttaatgtatactgattaaggtttggactaaatttgtccaaatccttaataaaatgccttatatacttagaaacagtacttccagtattggtacccagtaacatagcttgggctgttttgcaaggaaacaggcgctaatgaatgctgccatgtagtggttttagagactctccaaattgaaagtaattatgtttgtggctaaagctaataagccctcatgtgtatccagcttatctactcttaattgctttaactttgtttagtgttttgaaatttgtgatggaaaattaaaatggaaggaaaataagtatatagaagatgagaagagaataatggaaaggaaaaagagtgaggaaaaggtgagatgtagaaataaaacacacaactgtaataatgcgggtgagggccgggtgcggtggctcatgcctgtaatcccagcactttgggaggcgaggtgggcggatcaggtcaggagatctagaccatcctggctaacacggtgaatccccatctctactaaaaatagaaaaaaaattagccgggcgtggtggcgggcgcctgtagtcccagcgactcgggaggctgaggcaggagaatggcgtgaacccgggaggtggaggttgcagtgagccgagattgcgccactgcactccagcctgggcgacagagctagactccgtctccaaaaaaaaaaacaaaaaaaactccggtgagggttaagaataataagggttttggtttgaaaagaaagtccagggttttggtttgaaaagaaagtccaggaaacaggagaaatagctttaacgtacattatgtttttttgctttgtttttgagacaggatctcactctttctctaaggccaccatggttccctgcggcctctacctcctgggtgcaagcgatgttcctgcctcagtctcctgagtagttgggacaacaggcacacgtccccacacttggctaatcttttttaaaaaaattcatagagacaaggtcttgctgtattgcccaggctggtctcaaactcctggactcaaaccatcctcccaccttaacccgcctaaattgctgggattacaggtgtgagctattgcgcccagcctgttttcttcatggttaccctaaggaacatatattttggattattttttaattcttttgaaccaaaatatatttattgttcattcaagttttaaaaaaaatttcctatcttatttccacagtcggttaaacttttagctaacttgcctattgtctctgctgagttaaagttgccaacttttgtt

SEQ ID NO: 94830 - DNA, 1031 bp, Homo sapiens
gattgataactctcaagtctataaactccccacctaccttttcttagagtttacttgaagaaaaactttgctttttatacattatttagataatcttttgcttcatcagcatctgaattcatgaattttgatgtgactttaaaaatgtacttgataaggccggggcacggtggctcacgcctgtaatcccagcactttgggaggccgaggcaggcggatcatctgaggtcgggagcttaagaccagcctgaccaacatggagaaaccccgtctctactaaaaatacaaaattagctggggtggtggtgcatgtctgtaatcccagctactcgggaggctgaggtaggagaatcgcttgaagccgggaggcggaggttgcggtgagccgagatttgcgcccttgcactccaaccagggcaacaagagtgaaattccatctccaaaaaaaaaaaaaaaaaaaaaaaaaaaaccaaaaaaacacaagtgcttgttaaacaaattgctagatctcaatataggaaatactgaaagaaaggtggatgtaagcaattaactcctatgtctaatataattttcaaaaattactcgtcttactaaaagaaagaaacacctattaagcattttgtttactgttgagcattttttgagcacctgttgcatgtcaggatttacaattttagttaatcttcacagcagcattcccaatgggtactgttgtttcattttcacaggatgaaacaggcttggattaaccagcttgctccgggtaacattgttagcaagcagtgggaccagagttatttcacaggatgaaataggcttggattaaccagcttgctcagggtaacattgttagcaagcagcaggaccagagttaaaacactgaatgtagggtctaagttcttaaagactgtgctgcactacctctctaaagctgaattagtagtgctaaattttacttaaggagttaactaattttgcatgaagtcattcactggcacccctcctagcagggtgggtatcttcagatc

SEQ ID NO: 94831 - DNA, 1117 bp, Homo sapiens
caggtggtgggggagttccctgtctcctgcatatatggttttttcccgaaaagtttgacattaagttgcatatattgtggtcctttatctctaaatacttcagtgtgtatttcctaaaaatattttctttcacagtcatagttaccaacttcaatgaatttcacgtttataaaatccttttttatttttttgaggaagtgtctggctctgtcacctaggctggagtccagtgagtgatctcggctcactgcaatctctgcctcctgggctcaagcgatcctcccaagtggctgggagtactggctcaggcgcgcaccaccatgcctggctacgttttatattttttgtagagatgggattttgccatgttgcccaggctggtctcgaactcctgagctcaagcattccacctgtctcggcctcccaaagtagtaagattacgtgcatgagccaatgcgcagcctataaaattattcagtctactatttgtattctggtttttgtcaattgacccaatattgttttttatagcagtttttttttccccctccagtacaggactaaactaagatcagatgttgcatttagttgttatgtctttttaatcttccttagtctggaacatttccatagtctgcctttatcttttgtgaagttgacatttttgaagaatacaatctgctttgcttttctctttaatagagcacttctcattttggatttatctgatgtttcctcttgattagatgtagattatatgtccctgggcagaaaaatcacgtaactaatgctatgtccccaggatatcagatctggagatttaccatttccatttgcccttcatgcatgatactatgtgtgagcatatgctatggttaaagtgcttgtttccccccactccccctggaattaatctctggagagacgttttaagaccatgcaaatatcctgctcattagaatttacctctgtaacacccactcatgattcttacctgaaccatcctttactatgatggttgcaaaatgattttctactccaactgttattctacatttagtagtaggtactcagcactctataagagcttcccttcttccgcattgattaatttatt

SEQ ID NO: 94832 - DNA, 1951 bp, Homo sapiens
aaaagatggcatactgtatgctcatctgcacttgtaaagacttcaaggcttaaggcttttaatgcatttagtcggtttaggttttttttttttttttttattgagacggagtctcacttgcacccaggctggagtgcagtggcaccatctcagtgcactgcagcctccacctcccaggtgcaagtagattctcctgcctcagcctcctgagtggctgggattacaggcgcctgccagcacacccggctaatttttatatttttagtagagacagggtttcaccatgttggtcaggctggtcttgaattcctgacctggtgatccgccctcctcagcctcccaaagtgctgggattacaggcatgagccaccgcgcccggccagtttaggtatatttaattgaagattttagaacccactttaggtaaatggaaacattttttggccatgttactccatgaagaaaagcaaataaccaaatggcagagagggcaaggatgagttaggcttcagaaacaattgggactggatattgaataccttcattattgtctttacttcttggtcttgcttacctctgttccagtggcttttgttgttgttgttgttttatggtgcagtttctcagtaaagcagtaaatagggctgttaacagcatttgaattttagaaacatctaccacttttctcatttctagtttaacaaaaaatcctagggaagatttctttgttccagcttggataaggtgtttcctcttgggctaacctgttacacttactaggagtgtttagagcaaggccaccagtgcacatctgcgggggagcatcatttacaataaatacaatgttgtgctctagaggcctgtttacgtatgcaggtcacatgctcctaagaaataaaaaggtatatcttacaatagcccatttatcaaaaaatcattttcctgaaattggtaacaatattaaatcattgctatatgggattaatgcctggttctcatggagatctcttaacattgtgcattagcagttttccattttttttcaaatctgaaatcatggtgtttatcaatccttgcagttagtagtgaaatttggtgttgcccttcatgatgccaaataacgtttctaattttctgcttatttttgctttctgtttcattgactgtttctttgaaggcaccacattttggcattttaacgtgaaacatggtactctctgtcaacacttgtggcaccctcagaattgttacttgcatgccttttgtgagacaagagaggacaaagactaatagtaaagaagttggctgagtggctttatctgcgtggtaggagagatcagcagattgagtaccaggaaagcacagaatgacatgttagtttttatagctgaataaacaatcagcctcttctattaactacccattgtaataactgcattcttaagtaccaaagtgaatttatatattctgagacaaacagtgctctaacaaagcagtatcaaatgaggtatatgggtgtatgtctagaaaaataatgttagtggtagttttccctttgtgggaagattatagaatacttttttttctttcctgcatgttatagggtggtttttctttttggggggcggattttgaaactgtattgcttttttatgattagaaataaagttataaagtagatttacacttaatgtatctggtatatggaaagaacaccaatgggagatgttgtaatcttgttacttcctagctgtgttttacttaatgtgtgaactggaattcctttcctcttaaggtcattgtgaagctcagacgagataatatttaaagtgctttgtaaactttaaagtagtgtaagtccaaaagtatggtgtttgatataaatcttttccttataagtctgatggagccattatctgatggattgatttttgatgatggttttggataa

SEQ ID NO: 94833 - DNA, 1285 bp, Homo sapiens
agaatttttatggttgacattatattgaatatttcttgttttacagtggtatgttttagttcttaaaaggacataaatgagagttattagttacttgttaaaacagttcaaaggttcagcatgttttgtcactattaagtatccagtttttgaaaaatagtaaatttagaaaaataaaatgtcaactgaaaagagcaaatagtatacttctaattttgtacagtgtttaatataccccacccccccatcatgcgtgcatgaacgtacactaaagtagatgaaactataccagagtattaatttactctgggtgatggttttattggtaaggattttgtttgcagctttattgtttctgtaacaagcacacattacttacataactaggaataaaacatttattttaaagggttaatgctacttaattgcagttttttccccaacaagttaatagttaagaaccctgatctcaactcttcgtttttccaggttatttatttcataagatgactatccataaatcttccgatgaacgaacctctttatgaccagagctcctggggttaaaggagaaaggttttataatggctgtcttaatttgtttggtggttttccaggtattaatgccaaatttgcctttgtttagtttctgtttcttatcacactgttttcaggttacatcattatcttaaaaaggcagaggctttattttcttcgttgtgatataacctaattcttagaggtttcttaccaagatcactttgcttgttttgcttaattttattttctaaattttacaaattaatattttccaccaaaaggtggaacgaaacaaagacagcaaaatatcaaactgtttagtaatagttaaaaaagtcaagtgggaaggaaggttgaggctgaggcaggagaatcgcttgaacccaggaggtggaggtttcagtgagctgaggctgcgtcactgcactccagcctgggtgacagtgagactctgtctcaaaaaaaaaaaaaaaaaaagtcatactaatatttaggacttaaactttttattttggaaatcttcagaaatgtaaaaaaagcacagataaattcttagggactcagcttccacaaccagtatttttacgtgtcttgcttcatcaaattcccttcatctaccaccaccaccgccccttgccccactacacatgttcactctttccctcacctccgcccagattattttaaagaaaatctcagacacattattttactcattaagcacttgagcctgtaacttttgcct

SEQ ID NO: 94834 - DNA, 1082 bp, Homo sapiens
gcctttaaggaattttaaatggagattgttccaaatgatacttattcacaattccatttagtaattagatcactctgattgaaatttgttcttttgctgttttattttgggggagaaacattatttgaaagagcttgtgcttatgaagttataagaggagtcttcaccaaatggaataagtggttcagaaagcattgtaataactacatgataaactgcttacataagcaatgcgtatcttttaggattgggtgaagacagttgtttttggaagatattttattatgtagaaggtaggcacaatttcatatgattcatgattgtttaaaaagaccgtgagtttgttacaaatgaactttttaacagaatgtaggtatcattgtttggtaagcttgtgtctgcagcttgtatctggtgaatcaaaagcctgtgtatttgatgtgtttttgtgtttcattctaatttgaaaattaacctgtgcatgttactaatgagtactttggatgtgaccagatagtttaacaaatacttgaggatcttttgagtaggagtagggtttatatgcctgggggataagacttagccatgaacataaaccttcaactgacattaggttgttgaaaaagaccatgtgtgtgtgagtgcaaaaacataagatagtaagaatccaaaaatggtgcaagcaataaataaaggttattgaatgccgggcgacgtggctcataccccagcactttgggaggtcaaggcaagtggatcacttgagatcaggagtttgagaccagcctggccgacatgacgaaaccccatctctactaaaaatacaaaaaattagccaggtagcatggtggcacatgcctgtaatcccagctactcgggaggctgaggcaggagaatggcttgaacccaagaggtggaggttgcagtgagccgagattgcgccattggactccagcctgagtgacaaagtgcatccctgtctttaaaaaaagaaaaaaaaaagaaagattattggaagactcactcttggcattggtagtcaagggaggttgaatgggggtgaccttgaaggatgaataaag

SEQ ID NO: 94835 - DNA, 3315 bp, Homo sapiens
gagaaaagtgtatagtaaagtaacggatgaaattgtggcttgaaccagacagtgatggttagcaaataggatccatgatgttgatgtttataacaattgtagatgcctcaagacctcacattttccaccatgcatttcaatcacacataaaagtgaggtcctgatagcaccagcatagtctatatgctcatacattttttaattgtagaaaaggcaagttgtgtggctgctgaccttggtcctgaatggtagctaaagtactgttttctgagaagagtgttgaagggggtagtacagtctgatgggctggtcagcaaccagttttaactaataaagtgcctggaaactgtaagttacttttactcacatctgttaatggttaagagcacagattactggaccagataaccttgaatacaaatctcagcacagtcacttttctttgtaagttactttacctgtgtgtgccttagtgtcttcctctgtaaaactgtacatatctcaggactgttgtgagcatcaaatgacccattccatttaaagttcatagaacgctgactgacacgtggacagtgctctatatagttaatcattattgtcatccatatatattcgtccatactgcgtctatggatggaatccaagggaagggttactggttttgttatgtattatgttctatgttataacgaattccatgccattgcatactgttttcttagactctgtagtcaggttattggcaacaaatttttatcttacaagaaacaactatttaataataggaacataagtgtagtttaattgccctatgggatttattagatgtcaaggctgattccaaggaagattgtgttttacaaaaatgggtcttttaggcttacagttcttactttcattatttgtatatctgataacatgcgtattaaatgtgtgcatttataagtattttaatgccttcatcttttttttccccagtattacagcgtgaaataaattcccagtatttttcaagattatgtaaaaggagttgtaattactgctcagcacctaggacagcacccagtgcaacacaatgtacatgaactctggcttgaggtttggggcttgtgttctgcattcaggaaagaaaagaagagaaagtttttgggaaatttaaatcttcgtaagcccttactctaaaagtatatgaaatgcagaatggtttcatggctttatttcaaaatgttttacactggctgtagaacccacttcatgaagtagtttgagttaaaatgatctaatatttgtgttttaactttcagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaaacacttggtagtgaagcagtttcaagtaatgtgatcgattatgggcatgcaagcaaatatggctacacagaagatccacttgaagtacgtatttatgatcctgaaattccaactgatgaggtcgagaatgaatttcagtcacagcagaacatttctgcatctgttcccaatccaaatgtgatatgtaattctatgtttcctgttgaagacgtatttcgccaaatggacttccccggtgagtcctccaataatcggtcctttttctcagttgagagtggaaccaagatgtcaggcttacacatttcaggaggacagtcagtccttgaacccataaaatccgtcaaccaatccattaaccaaacagttagccagacaatgagtcaatctctgattcctccatctatgaaccagcaacctttttcgtcggaattaatttcatctgtaagccagcaagagcggatcccacatgaacctgtgattaattcatctaacgtacatgttggatcaagaggaagtaaaaagaattaccagtcacaggctgacattcccattcggtctccctttggtattgtgaaagcatcctggctaccaaagttttcacatgctgatgcccagaagatgaagagacttccaactccttctatgatgaatgattattatgcagcatctccaagaatatttccacatttgtgttctctgtgtaacgtagaatgtagtcatttgaaggtgagtgtttttaaaaaaagatcactgtataatgatgctcagcgccagttttctctaaattctgatatgtatgctgcttgttaactaggcgttaaggaaatggcagaaggtaattttaattgcaacctcaatacatagttgtaatcttaagtagccctggccttagtactgaattgaattttaggcttactgtattcctatgaccgggcacaccatattttagtagtgtgtccatttattttgaacttttagttatcccacttacgcaacataaaatttatgtaacataagctgcgtacttacaagacaatgtcacatggaatcacctttctctaaaaggatctgttagtataaaaatacaaagagatggtataacccatttgtaatgcacacatttaagagacagtatattatagccttgcacatatacacctgtcttgggataaagacaattaatgttgatttaaatatttcctgactttatgtagacta

SEQ ID NO: 94836 - DNA, 1785 bp, Homo sapiens
tattctgggaccagctgtggactcagaaaatagtgtaaaatgatagaaatttgtagagaaaaatctttaaaaaataaagatgatttaggtagtttgatagtatagttagaaggaagtattttgcagaggcagtgaagtgtactataatgtagaacatactgttcagtcgtaatcattggtagatttgagcaggaatttccaagtaaattttatttacttacgtatggttggcaatcactgtttcttctatttactaatgtgatttatagatttagattgtaaagggtcagaagagaatatactaacatgggaaaaagctttgattcaaggccatggcctggaattggttgtatacttaggcttaaaaatctgtgtgttaacgctcttgttcttttcttccagtgctgcctttcgattttcttttcattatttactcactaggttttcgtcaacatgaatctgataattagatctgttggtattttcttaaggttaactccagcaaaagaaagcagcattctaccccattttagccagatgtgccaaattctattaaaataatagttgccttattccatcagaagggatagcaaagtccttacaagggaaagtcttagaataattcatatcacctaattgtaatctgtaagtagccctggcctaagtagtgaattgagtgtttgtctgtattcttgtgactgggcataccacataattttttttaattgattttgaacttttaattaatcataatgaatccaagaaaatacatctttaaataaagaacttgaagttttgtattctgtagagtagaaaaggtgtacatttaatttagtatgtacttatggataccagttttgtacttgactccaattaggtactggggcagaaatgaggaactgtgtaaaattttagatgttattaagcagtttattcagtcttattggggagaaaaattatgctcccaagacatttaaaacaattagaagacaacaagtggttttgtgattgatttaacttgtttggatatgctgtaggggacagagatttctgtcttgatttcaggcatgtatcactcaggccagcatcatcaatttaccaatttaatcattaccaatttgccaatttaattattttaactattgtatttgtaacagtatgtgtttaaaaataagtataaatatgcatcctgacatcaaaagacttttatagcctagttagactaatggaatgtcagttactaaatgcactaagtctgtcttgactagaatgatgtgggagagaagacttcatggagtaggttgaagatgggtcttgaattgaggctttagatatgcctgtataaagaggaggagggggccgggcacagtggctcactgcctgtaatcccagcactttgggaggccgagacaggtggatcacctgaggtcaggagttcaagaccacccttactgacatggtgaaatcctgtctctactaaaaatacaagaattagccgggtgtggtcatgcgcacctgtaattccagctactcaggaggctgaggcagagaatcgcttgaacccaggaggcagaaggttgcagtgagccgagatcgcgccgctgcactccagcctgggtgacagagcgagactccatctcaaaaaaaataaaaaaaataaaaaaaaaaaaaaagaagaggagggttggcggcaacaacatacagagaggcagaggtccggagagaagactacatttcattgtggtaggaggcagttgggaaagagtgatgagcgtattagaaata

SEQ ID NO: 94837 - DNA, 1990 bp, Homo sapiens
acttggaagcttctttaattgttcaagtataagatggtaaaaacctgggttaataggataaaagtaaaaatttgagaggaaaggaaatcatttagtcatcattagagctcacctagatagattgccattaaaaaacagacacaccttttaacagcacaacagaatggggctcatctaagtaatgaatttttcactactaagtggccaaatgatagggatttgtgaagatggatttcgatggtacacactgcctctcgtttctgtgatatattttgcagcctcgtaagtgttcctgtgtgtgtatatatgacataaatatgaagccaataaatgtaaattaccaattgtaaactttttcctattgagtaaatctgacaatatgtatattccccaccttcgagtctttgaaactatagctgtgaagatgtactttgagaacgtgaaatgtatttgcttgttaaattggggttcagattttaaaggagaaacttcccttggtttaggagctgtgtcataatgactgaaataattcagtttgagaaagtaccgacaataaaaaattgttgagaatagtgagtgagccctgatacgagtagttatatattttcagtttcattctgagcctgcctaattctgtgcagtccttgcagcatctcctgctagtaggtaattatcactttttctctggggaggcagtgctgcttttggactataatgtggaaactattactagagagtctagaagttggggtgggatgggtgtgtttactgagcttaaagcaagtaatgtcaatttgtgaagcaagcctaagaatgtgtgtatgtgtgttgaactgagaagagtatatcttaaatagggcagccatcatcttcaggtgatagttgctgtaagaatgatatcctgtattactgtatcttcctattttttcaagaaaagctggaaatctggacttgcgggtaaaaatctctggattattaaatgttggcaacgtattcagataaaacactttatggttcaaataaatcatgcccaacccactgcctgcaccagtgtgtctgtttgatgtaaacagtgtccaattaatattaaaaatatgggttttagtactactagagactcttcttctagctttctatttgtattattaaacaggatgtacaaacatttcttttttgtagtccacaatcagttccatggcttaatgaaatagtttaggatttgtcataccttgttgctgagtttaaattgatgctgagcattgcaaatcagtgtaccttctttcagatagttcttgccaaggcagaatccaaaattattgtcaaccgtggttttaactgtggaaacttctaatgacctaaactaaaatgtatttcaaatggaaacaaataataacattttccttaagcaaagtgttgaaatacgaagttatttagtaagttttctgcctttccaaatgctggaggaacagtaaaacattgagtaacatacatattgcttttaactaattgtttcaccttggaaactgtatctttgtaaactgtattggcttttttttttttttaaccagatgtatcttccagagttatttatgggtacacattgtaattttaggacagatttatttgtaaatgaagtaatgtataagaaagcattttgggctgggcatggtggctcacgcctgtaatcctaacacttttgggaggccgaggcaggtggatcacctgaggtcaggagttcgagaccagcctgacaaacatggtgaaaccctgtctctattaaaaatacaaaaattcaccaggcttggtggcacatgcctgttaattccagctactagggaggctgaggcaggagaatcacttgaacctaggaggtggagagtgcagtgatccgagatcgcctcattgcactccagcctaggcagcaagagtgaaactgtctcaaaaaaaaaagaaaagaaaaaaaaaaaagaagcatttcgttaattgtaaa

SEQ ID NO: 94838 - DNA, 1050 bp, Homo sapiens
gaataatgttggtacaggaaaaaccagagaaattcattatcgtattcttctgtaaactagaaaacagacatccaagcaattggagggctgataaactgttctgattgtttcttatttacgtataaggctgaattacatcataacaaacagatttttgttttaagtacatatcttttatgagagtttggtattgttaacagtctgtttttaacaaggtacttctgtcatttattatcatttaaatttacattaaattgctgatcactttcttttccgcccccctgcttgtagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcaggtacactgatggccatgaaatagtgaatgtacttattttgactaaatttttaaatgtctttctttttggattttgagaaatgttctactttattaaattttagagttgataaatgaaatctgacccacatgccacagagttattccctctggtaacttggcaaagaaatgtgtgtgaatgtatgtgtccatcaacatcatatttaaaaaccaaggatggtaaaaatgtcttagtttgctttaataattgattatagaattccatggattaatttaaaatgtttttgagattattttttttaacctgtgacttaatgttgattttatgaccctttcagaactagctcacacatgcatgcccacatacacaaacacacaccttcttctacaatgaaagaaaccatagttaatatctgagaagtactttgacactcccactgtttcacttgactagcctgaaa

SEQ ID NO: 94839 - DNA, 1006 bp, Homo sapiens
ttcttcttttaagctcaacattaaaatgtgtggaagaaggtactatagtgctacacatttcactaattttgttttgggaattacagttggtttttataaaaatatttatgttaatatgggaatttactttttttgccattactttcagtggcaaaaactgcagttacttttgcaccaacctaacatatgaattgataaatatttttacaatttaatttctaatatggtaaatatcagtaaatataacacaaatctttgtagtcttcaataagtgtaaagcaatctcaaaaccaaaagtttgaggatcactggtataagggaataaaggaacttcatgtaaaagccttctgagtgcataaaatctagatttttgtattgtctgtgtgctccctgtttagcttgagaatagcactatgtgattatgtcatgagatggctcctaccttaatttttttccaattgaaattatatttatatctttttactagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaaggtaattctttaattaataattatttttagagataaggtttcactctgtcatcctcgctggactgcagtggtgcaacaagcatggctcactgcagcctcgatctcctgggctcaagtgatcctcctgcctcatcttcccaagtagctggcaccacaggcgtgtgccaccatgcctggctaattttttaatttttgtagagatggggtcttgccatgttgctcaggctggtctcgaactacta

SEQ ID NO: 94840 - DNA, 1169 bp, Homo sapiens
tttttaaaaatattatacctgtctagagatcatttccaattattagaacagagggggtaagcaaagctgtaatttcagctttacttgttggtgggccatgtagtttcatagaaaaattctctctaatggccttggaacattccatagatcttatttgctataagatgctatcaacagaaaagagcacctgtaaaccatttctgggttaaaaaatataaataacatttcttaccacttttgcatttaaaatcttattaaagtgttaaaatcgtgatttaaaaatgcgtaaaggaggtggtgaaggaaaaagaaaaatgggtaaaaaatatggaaaagaccctttagtgtactaatattagtggtagaagaaattatataggaaattattactgtacattgtagcttaatttggtttattttaaattttctttcactccaaaaatagcttcggaaagaacagtcattgcattatggttcggttcttcttataactgaattaccagaggatggttgtactgaagaagatgtgagaaaattatttcaaccatttgggaaagtgaatgatgtcctaattgttccatatagaaaagaggtgagtcatttagtctgtggcaaaaattcatacaaagtgattgctttaatgattctataaattgctgttgtgttccttagctgcttgtactgcatatataattgttctttgagagttatataaatgtctggatgtgaataagcaaggccgcaaaataatgttttatatcctttaaaataagtgtttgcccactttttctgtaaagggccagctaaatatttttggttttataagccatctgtaggatctcaactactgtgctctggcattctagtacaaaaacagctataagtaatatgtaaatgcgcaagcatggctgtgtccaaaaaactatttacaaaaataggtagtatgccatagtttgccagtcattactttagaacaccagttagataatactaaaacaaattatttcctttgtatggttaagtattttctgtgggttatattcctataactcacatgataaagttaagaactgtgaacagttcttcacataagcacaacataaaatagttagttaaggctgggcgtgttggcttgtgcctgtaatcgcagcactttgggaggctgaggc

SEQ ID NO: 94841 - DNA, 1059 bp, Homo sapiens
aaatgtcagacctaccacaagctggaccatatcttcccttccctcctgttgttcagtgagccctgccttctcatttcctcttcttccatgagcctgcctggatttttttttatcttggtagtggtatagaaattatgtaaggttaaatgtccatttaatgtgtgaaacatccttaatcaaattatacttgaccaaaataaaaacaggcaaaagcaaccatgacttgaggtagtttcatagtttgatgttacaaaagaaaggattaagcccattttaaaatgcaggaacttttaaagatagatttgtgactaaagatggaataaatttcattttaggcttacctagaaatggaatttaaagaggcaattactgcaattatgaagtacattgaaacaacacctcttacgataaaaggaaaaagtgtgaaaatatgtgttccaggaaagaaaaaagcacaggtaatctggatttaggtcttaaatgttttatcactgttgttttagtttaacttttttgtttaagtatggcacacatatagaaataggcatagaaacataaatgttagctcaacacattatatgtgcattaattcaagtatgttgaaattaaaacttcctcatacatgtatggtgctatatacagtattaaataacgacgactaggagaaaatacttgccatatataacacaaaaatagcaaacatctgtgaatctggtacctaggtcacaaaagagaacatttgacagtatctggaagtcccttgcttgcttcttcccaattcttacaccctcccttcttctcacaagtaaacactaacttgatttctaatgccatagttgagttttgcctgttttcaactttacataaacaaaatcgtatagtgtacattctttgggcctttacttccttagaagtatcaagttttgtaactttaatttttctagatcatttctgtgcttcagttcatatgatcgtagataatatctatagaattactttaaattaccctttaaggatgagctttctgttaagtaaaaagctatatgtatatctcacctg

SEQ ID NO: 94842 - DNA, 1196 bp, Homo sapiens
ccttcctaaagtgcacagactctgtccatgttgtggggccagattagggaggtgtgctgtcagggatttaaggctgtctctgctaccctcgtcaatgcctctttcagtgatacaaagtcaaaaccaggtagtatgaatgctcacttgatatttggttcttgtgatgatgcttttctgtgtgcagatagtcgttaaaatttggtgttcctgctggggatgggatgaacagtgtagggttctattctaccattttgctccacccagctatgtgttctagtaatttaatttttctactagctgtggaatggctactttatagaggttctataacacacatttctcaataatttgatttggtagtctaaccatgttagtgcattcctcattctttgtaacttctctatagtgtttctctgtatgaatataccacagatgtattaccaattccttactgattgatatttaggttgtttctagaaacagaactttagttaacaccttgtgtaccttcacaggccatcttttgacatttatgatagtggttttttaggtgatacctacccaatggaatggttggtttataggatgcacagtaatggataatataagattgctcactaaataactgttataatttactccctggtaatttatgagagtattaccaacaacatcttaatttcttcagctttaaaaattcgttatatagaaaatgatatctagttttaatttgcatctttttgattattcattaacttcatctttttatataattgttagctatatctattaactgtttaagtgagttgtctgtatcttttcctattttattattgttgtctttttaaaaatattcatttgaaggtgcatgaatattgtgcattctagacactaattttgcattgtatgtaagaagtcttttcttacagtctgttgcttgtgttatgcatacatatatcaagtttgaatttttttttttttttttttttttttttggcggagcctctctctgtcgcccaggctggagtgcagtggcaccatctcgcctcactgcaagctccacctcccgggttcacgtcattctcctgcctcagcctcctgagtacctgggactacaggtgctcgccactaacagagatggggtttcaccatgttagccaggatggtcttgatctcctgacctcgtgatccgtccg

SEQ ID NO: 94843 - DNA, 1981 bp, Homo sapiens
caaggactgaagcagagaccattacgaggcgattgtagtaatcaaagcaaaaggtagtagtagattagaccagggtgatagcagttgaactttagacatttgagatgtcacagtgctatgagaaaccatgtttttgaaagttacagtagttcccgtttatctgaggcttggctttgcagtttcagtggtcagttgtggtttgaaaatattgaatagaaaattccagaaataaacaacatgttttaaactgtgccctgttctgagttagcatgatgaaatttcatgcagtccaactccagcccactggggctgtgagtcattgctttgtctagagtatccacattttatatgctacctgcccactagtcacttaatagctgtcttggttatcagattgaccgtcactgtattgcagtgcttgtgtttaaccctcattttacttaataatggccctaaagtgcaagtatggtgatgctggcaatttggatatgccaaagagaaggggaaaaatgtttcctttaagtgaaaagttgaaagttctggacttaataaggagagaaaaaaattgtatgctgaagtcgctaagatctacagtacagtaagatattttgacagaccgtattcacgtaagttttattacactatattcttacaacttatttttttaatttaaaatatggaatgcctaacgaatatgcgtgtcatccttgcgcaggggccatgctaattaccgtatcattccaattttagtatatgtgctgctgaagggagcgtttttctattttattattgttgatcttttactatgtctaatttataaattaaactttcatgtatatacaggaaaaaaaacatagtatatatagggttcagcacgagcacggtttcaaggcatccaccaggggtcttggataaggagaaactgctgtagttaatgataagaaaatgcagatgagttgtgaaagatgagatgtaaaattaggctgtgtaatcacaaattgaaaaaaatgtctttataaataggaaaaggtaataatcatgtgtcctttagaataggaagattttagatttttgttctatattttctaaattgctttatactaaatttcttttgttcaaaatatttttcctacgtagaacaaagaggtgaagaaaaagactttagagtcaaagaaagtatctgcatctaccttaaagtaagtgactttatgatttcatatgtgagaatgaaatgtgcatatgacttaagaaattttaatttttaaaaccgcattttaaatatattttatcactataactatagtttaagagggatatcactccagttgaattattttaaacgtttttaggtttaaatattacatttttaggattttgtagaacttagaattcctaagttgctgctaaattttttctccttttaaatagaagagatgcagatgcttcaaaagctgttgaaattgttacttcaacttctgctggtaagttgttacttttaatattctttcaaatgagtgtatcttgtcagtttagtagaaacttagatgatgatgctatgaagacactattgtgctttaatgaaggagacccaaattacattctttaattggcccctgtattaagcaggcggttaatatttaatgctgtgtaattacagaatcacttctggagtaaatacaacaaatctgtgagataatgtatgtgaaatagctatcgtagttccacagttaatagctgttttttacatgtttaggttagttatgcaatatctccctccatcccttcccgataaacccacaagacacaaaacataagaaaggtatgttaagaatgcttatctggtcctctttgattttggaggttaattgagagccaaaaagcaagcaaaaaagactatccagaaatggatgctatcatactcatgtactaaaagctatttctttatactcaggaaaatacttgaagccatcattatgaatcc

SEQ ID NO: 94844 - DNA, 1178 bp, Homo sapiens
taagggcaagaagtaggtaacaaaggagtgtaaaggaatttatctagacgagttttatttacttttgcagacctttgatcatcctattgcgcgcaggactgctcccaaggcggtgggggtgacaattacctacagattgtgttggctccaggcctttgtcattaaatctgtactgaataaatacaagcggctccagcttatcagggctgcattctctctttggtgtctctaaggccgaacagtcccctagccgcactcatgcaaaatacctgtgtctgtgtacttttttcatccgtcgctcagcctgagtctgcaggtcagacttggcaggattttgacttgatatattgtgtgtgtttggaaatggggaataattcctatgcttatgtactgttgatgggaatattaattggttcagcctttctgaaggtcagtctaatgttacttgttaaaatttaaatctgtatgccttttgatacatcaagtccatatctaagaatttgcccccatagtaattccatggacatacaaagatgagtatagggctgtttcttgcagggttctttcgaaattattgctaggttgacttttaactaaatccaagtgatgttatttgtaatgtagtacttaaatgtttttcttgttgttttagccaaaactggacaagccaaggcatctgtagccaaagtaaacaaatctacaggtatgtttttttaattaggattctagactattagttaaaactttaatgtattttaaaatcgtatggcagtagtagtcttggatttcacatgacatagtctgtattgaatgcatgctaatctttgagatttataatcatctagcaattttgagaaatgatatgtactagataatgcttctatagtaattattgaaataattaactggagaaatttcttatgatgagtatcacatattttcctctttctcttttattgaggtctctcttcttccttacttttatataatagttcaataaatatgatcctttgtagtttttgtgagctatagtgggattttaggtaattattaagttttttctcttttccctggcataatcctttccagtttttctcccagttctgctaaatcctgattaattcagggtcatctctttaagtggatagaaatcaatgtattaaattatctttcaagcc

SEQ ID NO: 94845 - DNA, 1075 bp, Homo sapiens
agttgatttttttagatgtcaatgaatgctttttgtatgatttttaaaagtatgattgtattctcataacgttcctgttaggtaattttggcaatcaccacccttatgtatagggaaatgtgtacacaaatctgttcgtgccccaaagcttctcaataaaaattggaattcaatttagatctattgattttttatcttgggctttttcctcatccattctcgctagttgttatgaatcctaatttcgaagttaaatcttctgttgctctctgaatggtggaaagggtttgggctctctgatgatcttctgcaacactttcatgatcacatctttataaacagtatcatcttggaaaataggccatagtaatagataatgtaggtacaaataatggtcagagcaatttaaatagtactgtacagctaggaaactgtaggaatgagtcaaaacaatctttatatgacctgactatgatataagtattcttgaatgctttctaatcaattaggagccgtggaagtgtgggttgggaggatctaggtttaactgcttttggaactgctcaaagtatgggattgtttttgtgtccttggaattagtaattttgcttctagttgatccacacattcagaaatttatttaacttgcatgaatgctattttaagtacaggttgagtatcccttatccaaaatggttgggagcagaagtgttttagattttggattttttttcagattttggaatatttgcatatatataatgaaatatctgggggatgggagccaagtctaaacgtgaaattcatttatgtttcatatacaccttatatacatagcctgaaggcaattttatacagtgttttaaataattttgtgcatgaaacagttttttttaagtacttacatgggaatttccctcttgtggtgtcatgtcagcagcactcggggtttcaggttttggaacatttcagattttggattttcagtttagggatgtttgacctataccccagtagggaggtaaatatcttatttcagtgatttcttttttctgaagaaattatcatcattgct

SEQ ID NO: 94846 - DNA, 2229 bp, Homo sapiens
gaggagagattttattgtttattctttatttatgttttaaattcgtataataatttttagcatctaatacttgaagagtttagtagatatttccttgatatttaaaacctgacccattttgttggaattttatctttggcagataggcagatatatttttgtgcatgtaaacaatcacatatatataaagctatataactgtacatttttgacagctttgtaatcacaggttgctctgtcgtttccctccataaatggtttaatctttgtttccttcgctttttttagagttgtcaattcatattgccctctccagtttgtacagtttcttagatgcttgttacttttaaaaaggatgttaggagaattcattttttttcataaagaaatggaacactatttaaaataaatttagcaccttgcaactagagcaatctttttagtagtacctttcctaacagactaattctaaagaatctttgcagaaattacacagtattatttttgcgtgtgtgtgattacaatgttggtctgccacatgaaggttaaacatgtggctcatttgacggcatcaccaaaaagttgtatcttgatttaaatttgcttttaatcttactgggaaagaggtactgaaaataaatagaaataatgactatgtggaaaagagctgcttttgtaataaagtcaaactaatttactaatacattagtgtgaaacatgctaaatgatttaacaagacctttagaataatggctgactgtacttttacaagcaaaatctggtggaaagaagtctctagaagccaaaaagactgggaatgtcaaaaacaaagactctaacaaacctgtgactataccaggtaagcttgaaatgtggtcattcagtgctttgttttcttttcttttttttaactttttaagttcaggggtacatgtgcaggtttcttacataggtaaacgtgtcatgggggtttgttgtacaggttatttcatcacccagatattaagcctaggacccattagttatttttcctgatcctctccttcgtcccatcctccaccttccaataggccccagtgtgttgtttccctctatgggtccatttattttctttagatcatctttaaggtatattttgaaattttgcctaaaaattatcaaagtggggattgctgtcttttgtttttcaaagagagatgtttggcttatgtcaggtcagcctaaggagacttgaaatgtcaaactagcttaagttcctgtttagattcattagtttaattatattagtgttttactagactattaaagcagactatttcatgcagaaaactctgaaataaagaccagtattgaagtcaaagccactgaaaactgtgctaaagaagctatttctggtaggtcaatagaaattttattttgttctttacttattttaattaccaatgccatacctaagtgaaattaagagtattacgattcatgtctttatctcttaatctgaaattttgatctcagaatgaaatttaaatgtattttttaaaagccaatgtcacttttgtagtcattttgtactaattctctagacttgttgtattacacgttttcatgtagctactgtttaacctattgtggaataaagtaggatcttgataagtatgtctgcattgtttttaattttattttgtattaagatgctgctttggaggccacagagaatgaaccacttaacaaggtcagttttcatgttttatttatttctttaaagctcaagacattttaacaaaagatatttttcttataaacccaggtaaaaaattcatggtatttggcatgtgagaaattccagtcatttgtgacttttaaaacatgatttttagaaaggaaaagagaaaaaaatgtgattttagctcaaaaaccctgaggtgcagagtaagtcacaaaaagtaggaacagatcatcaacaaatgtacatgttttttgaagattacttttcatttgccaaaatgggttttgggtagacagtagttggttaaattagaatcagtagaattttgtgaagtctatttttttcttagaggtaaatgggagatatgttaatggttagaataccagttgtttgcatttatggggaagcaagtggagtttgcagtttaaaggacatgaagttcacttaatatattgttttcttatgtttatatctattattattaatacattacaatcattaat

SEQ ID NO: 94847 - DNA, 1028 bp, Homo sapiens
ggatacacactgatttggagcttggggatattatcacaaggcacagggatggcgacagtatatgaaaggaagcagttgtagccaaaaacaaatgaacttgtgttttaaaacagtgggtgacagctgcttgggtggctgagacacaagaatcacttgaacctgggagacagagcttgcagtgagccgaggttgtaccactgcactccagcctgggcaacagagcaagactaaaaaaaaaaaacagtgggtgaaaaagagtccagcagacctcgactagatgacagatggtataactacaattagtctgtactcttgaagagtgtaaatttgcaagcttttttgcttttctttttaatttgaggttcagaccagcctcttgagtttatcagactttcctcagtattaaatgcaacaatatactaatataacatgatacacagtataaacttaagtaaatatgaaacaaagaaattttaataacaggttttaaaaatttgttttgaaggaaacagaagaaatgtgtgtgatgcttgtctctaatttgcctaataaaggatattctgtagaagaagtttatgacttagcaaaaccatttggtggtttaaaggatatcttgattttatcatctcataaaaaggtaagagttgattaatagctgttcatatcctctgcaagcatgcatgctttgaaaaacattaaatttacaaaactaaaaagaaaaggtttaaaagcagtatctcaaagtaaactttcaagctaagggattttaaaatataaaacacagatatcctgtattttagtattgttgtaacgagacatagttttaatgatggggacaaatggctttctaatatgtcaaagttctactcaaaattttagtttaataggaaacgttttatatcttcaatatgtttaataaatatatcttttactatgttatgttaatatgtttaatagtaggaaatgttttatatctttaatatgtttaatacataagtatatatatgagaaagaacttacaccagcag

SEQ ID NO: 94848 - DNA, 1083 bp, Homo sapiens
aatattcttagtctttgggcctcaattttctgaggactgcatttttttatctttaaaatatttactaagttgttcaatccacttgacgtttgaagtagtttgtttatacttgcaagtctgtttttgagaaaaagtaacataagatttttcttgttaccttaatttctgttttaaaaggcatatatagaaataaatagaaaagctgctgagtctatggtaaaattttatacctgcttcccagtattgatggatggaaatcaactctcaataagtatggctcctgaaaacatgaatataaaagatgaggtaaatcagaccaccatttttactagctcttactaagtttttaaatcagatttgttacagtctgttatgttttctagttttccactttggttcacatttttctcacagacactgagaaagcttcttcctgtccctccaacaatcacccagtcacccatcccactgtttgagagttactttcatagtgagggaatcctattcttcatgtatgttgggatggaaaaaaggttgcattttgtctaaagacaggtttctctcttatctttctgccattatctgtcatctaaactagaattctggaagttatctttaattttttttctctcatttcttaaatttagttccttgtaaatcttgtttaactcagtgagcttgttccctcttcctcatcccatataccattgctttatctcttaaaaactcttactggtccaggtatggtggctcacgctggtgatcccagcactttgagaggctgaggtgggaggactgtgtgagcccaggacttcaggacccaagaccagcctgggcaacaaagtgagaccccatgcctacaaaacttaaaataattagctgggcctgaaggcgcacacccgtggtcccagctcctcaggatgctgaggtaggaggatcccttgagcctaggagtttgaggctgcactgagctgtgattttaccactgaacttcagcctgggtgacagagggagacctagtctctaaaacaaacagacctcctcctggaccttttgtatatacaaaagtaattgtcttttgta

SEQ ID NO: 94849 - DNA, 1069 bp, Homo sapiens
agttcctttgccgcacacaaagccttccattagttgtcctctgcctgctttgatatccttgttccctgatgttcttggcctcttcataattcagtagcatcaaatctgcatttatgctctgtgctgttttatttgcctgcatttctgttctttctcatctcctactttgcttagttaacttttcttttgtaatttgaattctcttcctgttgtctaaattaaatctctattccttctgtgaatttgaatgtcttttctaaatggtactatcttattagtcttttatattcttaggggaataagaagaattaaattgtatgggttagaatgaggcttgtttaggagagaaagatttttggaaagaatgtaaatcttgctgcttcttaattttataaaatactttgtaatgcatatttgtatagattgtcatgttataaatcttaactaagtaagtatttgtatgagaaagagcttataccatcaacctttatctatttttgctttttaggaagctatatttataaccttggtaaaagaaaatgacccagaggtaagttttgcatttaaatgcttttgtatacttatttaattgatggaaacattgttttacttgtttgccttttaggaattaaaaccttagaactaattttaagatattgaggtgatggagatgtcagatgggtcttcttggtaacaataaaaaaataaaggtttcttgtagtacttgatgcgaaaaaatttttcaggtactggagtgcatattaagtggtctaataggtcaatatcttgtctgaggatgttttgggtaaacgttatgttgatagtagaaatattatacttcccattttagtacgtcattttactgattactcgtacgtaaaattaagacctcactgtcttcccccatgtagtcattttcttactcttgggagagaacatcatctgacctctgtaatagtaagttaatgttaatctgttttaccgtttgttgcttcagctgtggttttttctgtgctgtctcttaaaaaactacaggcaaacatagatacaatttatgatcgatttgtac

SEQ ID NO: 94850 - DNA, 1841 bp, Homo sapiens
gttttctcttgtttcctttaaataaggattaaccttacctttgtagtcatatatctgaaacctgaaagaagaatatattccaaacttttaaaacaattaaaaacatttttattgtagtaaaatacacaaattttaccgtttgtaagacataaatttaacattttaatcatgtttaagtgtttgttcactgatattcagcaccttcacattgtgcaaccatcaccaccatccatttgtgaacttttgtctcctcaaactgaagttttctatccttttgacaataactcgccattaattcagcccttatcaaccattatttctgtttttataaatttagttacctcatgtatgtggaattatatttgcttttttgtgactggctcatgtcacttagtataatgtctctaaggttcatccatgttgcagcatgtgtcagatttttcttcatttttaaagctgagtaataattctgttttacgcatgtaacacatttttatatccactcatccattgatggacagttgggttgcttctccctttgtctgttgtgaataatgcttctgtgaacatgggtgtacaaatacatgtttaagtatcggctttcattccttttaggtgtatactaaaaagtggaattgttggattatgtggttattctaattccaatttttttaaagaactattcataactttttaatcttctccaaaggcaattcttcagttagatagtcctgaatctgctcagtcaatgtatagctttctgaaacaaaatccacaaaatattggtgaccatatgttgacctgctcattatctccaaagatagacttaccagaggtaagatttatctttcttcagcttttgtgattttagaaaatacagagaacataaaggtcattctcaggtagtagtcaaactgtttctgtgtttagagatgatttttataatttgtgttgcaatcagtgttccaattttcatagtttataaagcagtataaatttgtctaaatgagaataaagaaattttcaacaatgtaacatatatgcatttttgaatacttactgttgacatgtaggtatctacatttttgtgtatagtgactctttgtatgtaacatgattgtctccagaatgcagctactttgaatccattttggcttcctctgggtagaaagaagtttgttttattcttctttttgtttcagttacatttattataaactgtttttgtgttaagaaataagatttcacaggttcttggcctacacagtagtacatgtaggaaagctatggatagtccacctttgaaagcattaaattcaaactcaatctattttctccttctattccattgtatgctgatatcagaggtaagtaataggaccttatatgtggtgtccttgtgttgtcaatctgttaaaaatcttgcactatctaaagaaaaaggcaatttcatcatctaaatctaaattagagtatctttaagtaaatgtattatgataggtaccagtttaagcacaaatgagtggctcatttcacttgataatttcagaaaaaaatatataaaagtttttagctattcctcagcagaacatgcatttttaaaaagttgtcatttatatttttcaagctgttattcagttgtgttcaactaaattcaaaattaaacactgactgtacagaaatccttatcccagaaatatagtcccaaattcttagagttaaaagaaaattaaagaagtgaaaatttacataaacttctgcctgaattggtacttcacttcctaagtgcttacccagaaccttattcgtatagtttaagttggataacacatatggcttat

SEQ ID NO: 94851 - DNA, 1016 bp, Homo sapiens
cccacatatcagataaatatttaaaatatttatcagatatcagacaaatatttaaaaggattattgttcaattttatttagcatttctaggtattttgaataggaaacttttttagtcagctgatctctcttagaagtcttttaaaataattcctcaaggaagatgttgatatttcacatttattgtttagggaaaagatagaatttccaggcttctaaagttaataaagtttcttatttatatcattattaaggaaacttattttttcattaatataagttattgtgtgtgacctaatttggaggtctttaattagaaaaaaattctagaacctgatagtaatgtagacactgaaaactagctgctttgatacatttttaaggtttttttttttgagcttaaatttttactaaaaacattgcttttatagttaaatatttcaaatccagtggaatagcctctaataaaatgctgattatattacaggtgcaaattgagcatgacccagaattagaaaaagaaaggtatgttgctttatgtttactaacacttttgtatagtatttagtttctgaattttattgctgtattttatagtaatggctcacatgtagtgaaaagttcttttctgcatatttattttgtgtacatatgggcttgttacagttttctttttggactcagcctgacctaggagtttcgtttgttgctttttatttactctcatttaagtatttactgaatatttagagtaactgcgtatataaacagtttgaattaaataaaccactttataaaatgttttaagactctcgaataactcaacatcacgaacagtaattacattgtttttgttagattttcctattccaaaataaacacggtagtaaaattttaaccttttaacgttacttaatttcattgtgtgttttgatactttttaaaaacaactgggttggggcgagtaagtatttgtccaaaaaaattatgtatatagttttgcattatcagaggaa

SEQ ID NO: 94852 - DNA, 1879 bp, Homo sapiens
caaaaacttcttaattcccacccccccccgcctttttttttttttttttttttttttttttaacattagagaaaaagatgtgggatatgtccagaatactaaacatttgttttggagtgaactgatgctgagaaaatactatttgttgtttttgttgtgtttttttttagagacagggtcttgctatgttgctcaggctggccttgaactcctgggcacaagctgttttcccacctcagcttcctgtgtagctggtactacatgcacttgttttgttttgttttaaagcacttgtggttgccaattcattatgaatatgatacttttgtttataactaaactatttaaatactgtttagaggaaactcgtggatacattcataatttaataattcacactgtactcattctgttgatatgtaaacagattttatttatcatctgattaaagccacaaataagaatgctaagtgaaatttttctaattcattaacattaggaagtaaacagttggcctctgaaataaacactaatctttagtattgtgaagtcccagtttaaggtttctcagaatgtttgtctttcagtgttaacgtttgttctaatgcccagcttttattgtatgctttttctgaaggctgtgaaattctggtattactgggatattggggctggagggaggagtggcaaatgagatatctgtatctcaaatgcctttctggaatccttttctgttccatttcccagaatgtggctgttttcatttgatcgttacaaagagtggttgtttaactttggtgttaatgtcatttatttgacatttcaaactgtcttttcaaactaacttgatcaatattgaggcttttttcccatattagccagaaagcagatactagttttggtaaatgacttctctaaagaaaacactatgatttgaaaagactagcacacaaggacaaatatggaattaaataattcttctgagtagacctgtgttctctgtttcaagtatggaactgcataatggttcagtttgtatataagataataacttttttattgaaaaacttgtgaaggggaaagtcttgctatatccttgagccaggaatcaaggtctccattgttatcctagccccatagatgtttttacttagccctaagtttctaaagttttatgtagggttaatatgcagtacagtaatgaggcaggaatttgaatattttcttcattattggaaatgagtcttgtaatttaaagacaaaagcttgttttgagaagtaatattcatatacctgctgtaactgtgaatgtcactgctcttttctggttgtgctttgccacaaattttattgtgaattgtaaagatttgaaactcttaaaattagccatttatattttgaaaaaaaggggtgtgattattttaaaaaaaaaacattttagcatgcaaagaataacttgcacaatggatagaatatatattgattaaggtttagggtcaagaggtatttctctaatctggtagaaaagttttctcctcaggatgtaatctttggggcatgagggaagaccagtttggttcaaatgatttaagaccctgatgtggtagcacaactttcttaaatatggttaacatctcagcacacagatatacaccatcttgtgttgttaactgaagggtacatggccaccctctaagaagcaggtcaaaagggatggctcatcctctccttccttaaaaaataggagaagaaagtcagtactttttaataatcaggtattgatatgataggatcactctctggtgtctttctccaatctgctgcttctcattatatgaatatatttggtaaattttaatttgcattgatagcatgttgg

SEQ ID NO: 94853 - DNA, 2605 bp, Homo sapiens
ttcttcaagaaaacctctgatttgtggaatattgatataaaaataacttattctgtgtctacctcggtgaaagtactggaattataggactactcacttttcatatactttagatttgggaagaccatgatgaaataagatgaattacatatacttagccatgtatttcctccatttcttctgaatattacttacacatttaagttaaatattagaattatacattattctcttgaattgggaaggtttattttttaatgcatttcttcttatagccaaaggcaaatatttataagactgtatgttcacataaggtgattatatcaggttttgtcactagctttaaatcctcaatagagtatataaagaatactttccaaataatgttctaagtattatcattaataaatatggttcttgggtaattaaaaaaatattttacatccaaaaaaaaaataaaaaggtgatatgatttagagtatggtcttttccccccaccagtttctgtttatgttctttttaggtaaggttcacttataaaattttaaatcataatgcatggatcattagttttattgtagaactgtacacatattttattatttcagttaccactgttgggaataggacctgataatatttgaagtgtctcagattcacatttgacctttcaatgtcaggggttaacttgacagaggagggaaaatattggctgtaatcacatgagcgcaaaaggaacatatcaacagtcataatttatattatttacgtatttccagcaatacatcttacccattttatgctgattggttggatttcccagtgcttattacgaatgcatcaggaagtcttaacaattggcatcagcaggattctttataatggttgaattctcatcatagtttgatttttgtttgtgtttttgtttgtgttctttttgtttgtttttaaatacttttagccctggcttgaaaaacagtccaattgatgaaagtgaggtgcaaacagcaactgatagtccctctgttaaacctaatgagcttgaagaagaaagtactcccagcattcaaacagaaactttggtacagcaggaagagccttgtgaggaagaagctgaaaaagcaacatgtgattctgactttgctgttgaaactttggagcttgaaactcaaggagaggaggtcaaagaagaaattcctcttgtagcatccgcttcagtcagtattgaacaattcactgaaaatgccgaggagtgtgctttaaatcagcagatgtttaacagtgacttggagaagaaaggggcagaaattattaaccctaaaacagcattgttaccatctgacagtgtgtttgcagaagaaaggaacctcaaaggaattctagaagaatctccatctgaagcagaagatttcatttctggaattacacagactatggtagaagctgtagctgaagtagaaaaaaatgaaactgtttcggaaatattgccatcaacttgtattgtgacgttagtaccaggaattcccactggggatgagaagacagtggacaaaaagaatatttctgaaaaaaaaggtaacatggatgaaaaggaggagaaggaatttaatactaaggaaaccagaatggatcttcaaataggaacagagaaggctgaaaagaatgaaggtaggatggatgcagaaaaggtggaaaagatggcagcaatgaaagaaaagcctgcagaaaacactttattcaaggcatacccaaataaaggagtgggtcaggctaataagcctgatgaaactagtaaaactagtattctggctgtatcagatgtatctagcagtaaaccaagcatcaaggctgttatagtctcttctcctaaggcaaaagctacagtttcaaaaactgaaaatcagaaaagttttccaaaatctgtgcccagagatcaaataaatgctgaaaagaaactttcagccaaggaatttggtctgcttaaacccacaagtgccaggtcaggcttggcagaaagcagcagtaaattcaaacctactcagagcagtcttaccagaggaggcagtggaaggatctcagccctgcaaggcaagctttctaaactggattacagagatataacaaaacaatctcaggaaacagaggctagaccttccatcatgaaacgggatgacagcaacaataaggtgaggagggtaggaagaatggcacagtgtgtctttgaagtgattagctccgctgctgtagctatgtagtaggagatgtaattttgtttcatactttcatctcctcactctaccccggaagctcccatttccttttcttaaatgattccattgtttaagccagtagacattcagagtattaaactcaagttcataatttattgacatgtttgaaaagcattatttggatacaatttggaaataactgtggtttaaaaaaaaaaaaaaaaagtctgcagtgaatctcctaaggtgatttaccactctgcttctgaatgggaaactgtttcctctcttaaattgaagcttcctttatcaggtcactgattgcctaactagacattgtgggacgaaaagatcagtaaaactgaatttaacta

SEQ ID NO: 94854 - DNA, 1920 bp, Homo sapiens
attagttaatgtgtaatcaatatatactgataaatggaacagcctaattagctgtttactttctaactatatttgaggtgcttttagaagtccagtaagtcttctagagcacttattagatgtttgacatatggaacagtaaatcctttgtactgtctgacaaatactttaaatgtatttttatgtgtcatacttcgaaactcttcatttaggaaatgtaatcttattgaatttaagtaaaagtggaattaggttgatactgttagaattttacttttggattatactttgtgaattatagctaagtcatttgtggggctttaaaaaaaacaactcttaattttagcctttaggaaaactaatttgcactgaaattctcccaaatgatctgcatgcacatttattgtgactatttggaatctagccagtggtcaaaatttgtttacaatactatgatttttaactttccaacaggagccattatttccatttaatttggatgaatttgttactgtggatgaggttatagaagaagtgaatccttctcaggccaagcagaatccactaaagggaaaaaggaaagaaactctcaaaaatgttcctttctctgaacttaacttaaagaagaaaaaggggaaaacttccactcctcgtggtgttgagggagaactatcttttgtgacattggatgagattggggaagaggaagatgcagctgcacatctagcacaagctctagtcactgtggatgaagtaattgatgaagaagaactaaatatggaagaaatggtaaaaaattcaaattcactttttacattagatgaattaattgaccaagatgattgcatttcccacagtgaacctaaagatgttactgttctgtcagtggctgaagaacaagatctcctcaaacaggaacgcttggtaactgtggatgaaattggagaagtggaagagctacctttgaatgagtcagcagacataacttttgccactttaaatactaaaggaaatgaaggagatactgtaagggattccattggcttcatttcttctcaggtgcccgaagacccttctactttagttactgtagatgaaatacaagatgacagcagtgatttgcatttagtgactttggatgaagtaactgaagaggatgaagactctctggcggattttaacaaccttaaagaagagcttaattttgttactgttgatgaagttggagaggaggaagatggagataatgatttaaaagttgagttagcacaaagcaaaaatgaccatcccacagataaaaaagggaatagaaagaagagagctgtggacacaaaaaagacaaaacttgaatccttgtcccaagtgggtccagtaaatgagaatgttatggaagaagatctaaaaaccatgattgaaagacacttaacaggtagatacttggaaggggtagtctttctgttttatgaggggattacatttaaaattaattttaaaatacatgttgtggcattaccaataatgtcacccagtattgatattagaggccaacagacagttaaagtcaacaataaattttccaaagaaatgtgtacaagtttcacagttttttaaagttttacagcagaacttgctccaggttatgcttcaagaaaggatgacaaaaaacagaaaacaaactgaagtagccaaattagaattggaatgaaaatgatatatttgtattgtgggaaaaagacaacttttgataaatagaagaacatttacatcagattacctcccagtttttgcttagacttagaattaagaactatttataaaggaactatttgattttaaagtaatattgtaatgatacagaatagtacggcagctcactttccgaacttgagggagataaacataatttccattaagaaaatc

SEQ ID NO: 94855 - DNA, 3542 bp, Homo sapiens
agtgagccactttgtctccaaaaagaagaaaaaaaacctgaaagatttaactcaactaagaataaaatactaggaaggtcccacaggcttatggaacaaattagaaaaacatttatggacatcctgggaaaagaagttagaaaagcatagttacttggaaaatgataactgggaacaaaaggaaatgcttagattaaactgattattttaaaatagaattcttctattttatattagcagtaggcttccctcccaaatttgggtattttttgcaaaaatgtataatgttgattcagacagtataatatgtttaatttaaagcaatttaaatactgttactagagcaataaattaggactttctttttaaagctaaaactccaaccaagagagttagaattgggaaaactctgccatcagaaaaagctgttgtgacagaaccagcaaaaggtgaagaggccttccagatgagtgaaggtaaagcaggattgttggaatgggaaggaaagttacacaacacaggagagtagttgaagtttaaagatctatctaagaagaaaagtagaaaatcagtggaatagagcaggggtgggaaaagtcaactatagttattagatgtgggtaacattttgatctttgtaatgtagagagaatggattattgatattagaatgtgacagattagaggaaatgatcctcgaaaggttttctgaccatgttgcagcatcagatagaaattatttattaactagctattatttgtggaccttgctttgttgatgcttgtcagcagccagccaatgaattaaacaagaagccttaatagcgtttataaaatttaacttgaaacaaataaggaagggtctagtgagagagaatactttagtcactcagcagatacttgtcatattgtattgggtatccttcataacaatgttaaaaagggtagacaaaagaaagtacatagctcttgctctcaaggggtttattgattcagagaggttaagcaaaaaatcaccttgccagtatgatttaaatagagcactgtaagggtatcgcttttaccattctctttgtagcaccctcattgccctctttctttcctatcctatcttctttaaggaaaacttaccaagtatgatttggtccaaggatttcaggtgggctctcagtgctgctcccaatatattagaggtctccttcctttactatttcctaaccagatgtaaaattagctttcccccccttctacatcacctaacccgtttctcattggatgtccttgctttcgtttttatttgccagagtaaatctaggatctcccttgtctgccaacttatattttgttttatacacataaaatataaaatttggccaagtttttcccattgaaagaaatatccctttgaccttgaaatctctctagctcctatcttttctacttgcttttagagcaaaacgtctagaaagaaccacctacttttacgtcttaatttcccatggaactgaatgtattttggtttctttctcctaccactttcctgaaaatgatgttgatgaaacccccattaggttgttgtcaaacgtgattttttaaagtgttttcttcttaagttagtcttacttgacttttccacatgattggttacttttgattatgccctctcttgaaactctttgccaagtcatggtcaagtgggtattccttcttccttgtctattcttttccataaacaatctttgataaccaagctataggtggtggttcagtaattaggttctcgcatgatttcatgaggtcaccccccgacttcagaatttctgtatggtagggcaaccttggcaatcagcttgcttagaactgcctcattgcaactgagtaatataaaaggatgatttagttactgcttacgtaacaatatatttctactaatgaacaatatgttttgacaaaaggacctagcttaagaaaaagtcatttttccacacaattgtaaacttaaatcatttattttaatctattttaaatatataattttaatatatgttatatactattaagataaatgtgcctttggagtggcaggaacagatatgtttgggaaagtttattaccctgatgaagaaataaacaattatagaaagagattggaggcaaggaaaccagattgttttaaccatcaagttaagaaaaggaagatacctttttcttattgattgtaggacttgatgatcagtaaagtgtgaggaataagagtaagtaatgatttcagagttccttgccatcccctcaggaatactaaagagtagcccagatgtatggagggaacactgaacttgaagtcacaaagtcttggttctagcctgtgtcactcactagctatgcaaccttgggcatatctgtttattacctcttttgattgtgctttctccatctctgaagaaatagggatgggttaataatgatttcacgtgcctatcttacatgaggtaaaagctaaatgaatgattatatatgtaaaagggttttgtcaagtattaggcaacagtaaggcatttcagctactgagggtaatcagaattgcttggaatcagtcttcatttttgtctgtccccaagatcatagtatgcagagtctgctaacattgagtgcttcttacgtgttactcactttggtgggctttaacatttatattaataattttacttgtgtttctaacaggggtcttaggctatcagtttaggctccattttctagattggaagggcctcagtattgggccatagaatcaatttctgctggtatccttttcccttaatctccactctcggctcagcttagcactttgcatatataagttctcttgccagtaatgataggacttgtattacttcgttaaattctgcctggaacatatataaataaaatttgctgttagctttagacctatattcctaaatccatttgaatggatttacccatttattccttacattaaagaatcttggagaatattgtgcaaagaatggccagatgggattaacaaagggaggttttccctgagaaagaaaaaggtaagaattatccaatgttaactttacaaagtctgtaaatctattctgaatagctttttttcctcgaaaaattttagttgatgaggaatctggattaaaggattcagaaccagagcgaaaacgcaagaagactgaagactcttcttcaggcaaatcagtggcgtctgatgtccctgagggtaaagttaaaatgacatttttttcttacccatatgaaatttaaaagtcggccgggcgcggtggctcaagcctgtaatcccagcacttcgggaggccgaggcgggtggatcactaggtcaggagattgagaccatcctggctaacacggtgaaaccccgtcagtactaaaaggtacaaaaaattagccggacgtggtggcgggcgcctgtagtccaagctactcgggaggctgaggcaggagaatggcgtgaacccgggaggcggagcttgcagtgagccgagatagcg

SEQ ID NO: 94856 - DNA, 3766 bp, Homo sapiens
gtgttaacgaaataaagacttacgttttctgattaaaattactactattgatccctaaatttatagcagtgtgtactgttcttatatttaagtatatactgtgcttaatatttttgtcgtgtttaaattgatgaaggccagttgtggctcacacgtgtaatcccagcactttgggagaccaaggcaggcacatcctataggggaggtcaggagttcgagaccagcctgggcaacatgataaaacccatctctactaaaagtacaaaagtagccaggcgcggtggcgcacacctgtaatcctagctattcgggagcctgaggcaggagaatcacatgaacccaggaggcagaggttgcagtgagctgacatcgcgccactgccctccaacctggatgacagagtgagactccgtctcaaataaatgaataaatcgatgaacacaactggagattaattattgttaattttcttcttgtctcttcttatcctctagaattagactttcttgtacctaaggctggattcttctgtccaatttgttccctcttctactcaggtgaaaaagcaatgacaaatcactgcaagagtacacgtcataagcaaaatactgaggtaattttaaaaattcttacaaaatcttgaggtgttgttattgtcttagaatcaaattatttatctccccaaacgtacatttccccccgctttaggagaatgtttatgccagtttattcctcttaagtcctgttttctccttcagtgtaccttgcctgtaatttctagtccttattccttttccttgaacagcaacatttgccagagtagattctgcagatcactagtctcatatgacactccattattaaagtaagaaactgcatgttttgatgccctcttgtcatgtagacattagcatattaaagtttctgaattgtctagccagaatgaatcctggttaacttcatgcaaaccatttattaaactgatttaatcacaaaaccttttctaaattgtacacatctttaagaagtgttactctggagaatcatcattaaccataattgaagtggtgactctagttcctgctgaatatttgagagtttcgtacatcctctctgttgaatttgtggcacagacactcatctaacatttactgagctgttctatgctggaagcttatttaatctcctcatgaacttcatgaggtagatgctattattccaatcttaaagatgagaaaatagacttaaggaggttacgtatctaaacccaaggtcacatagctagttagtagcagacctaggatttgaactccgctctatttcattctaggcccaagctcttatacattgtgctttgctacctgtgtgcttaacttagttcatcatgtcacttttccatttaaaaccttctagtagcttcatattgcacttggtctaatatccaaacttcttattttgggtcttcaaagccctgcatgatctgatttcttttctacttctctgaatgctttctgtgtttcagcttttctggctctctctgttctgtttttcatacatgagagacccattgctgcctttgcacctttatactgctgttcttttgccccttcccagtcctactcgcatggccagttcttcatgtttttcgtctcaaatatcagttccccagaaaggtctgcttaagaaagacctagctaagtagaacccccaaaaaagttcagcctcaattacgttgttgcactgtctttaaagtgcttaccaccgcccccaaagtattttatttttttcttttattgtttctcttctcccattagaatgtaagctttattgtataaaagattctatctgtcttgttgcccaccgaatcctcaggcaccaagtgtaatacctggtgtgtcataaacatcaaatgactgatgaatgaaaggaagaaatggttatataaggcactgtgtttataatattttgtaggatcagtttcttttaaattataaatatacagtagataagtttgcacacatagcaaaataacgtctaataagtattttatattgcaaattgcttttaacagaaattcatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatatttaaaataccatctgtgtttgtggctgattttttaaagacttgcttgcctctgattgcagacaaggtttttcactacaactcctgtgatttgggatgtttggggattcttcatgtatcactggaagtcatagcatgacagtgttttactttgcttcaaccattcatgtgtatacaggtcatagatttcttaaaattcaaattttttctggataaaattagattacagcatattttccccaaataggtttgaatgaaactttgcttgatttttatatgtgttggaaaggtattttttctgcttctggtaacacttgctgtttctgccagaacccatttaaggtaacaccaagctagtcatttattattagcttgaatctacagagcagccattacttctgtggaccaccagagtagctttttaaaccatttgaattatagttgaatatgtttataagaagttttaagggcacaaaaaataattgaatggctagcaggtgatggaaatagccctatacttttaagtttttagattgagccattcttcagacatagtctgaatacttataattgttttagtatttgatgcctcaagatagagtgcaccaattaataatacaaagaggatgaatggaggggaacaacaacaacaacaacaaaaaccctactttttttagatgtcttatttccatcacagcacaagagacatcacagtcagtaagaagggcttggagaaaaaaaaaggcagcacctctttgtcacctcctatgaaactcactgcatacttagtcgagacttacccacagcctgagtaaaattacagaatgctacacgtcacagacaaggggtggggtagagagaggagcggcttgctgtcaagagtttgttggaattaaaaccttacagatgaatccggataataagagggagaagagctgttaaaagattggggaataaggtgcctgtaaattacagaagcacagtgatagtgaataagaatcttagttttaaagaatcttcctttctcctcagcttgcttttggaacttttgcaactagggaagttataagcttctttaatcttgtctggatcagtcttttgaaattgggattctaaattagaatgagaggaggagctgctaaagcataaaaatggtaggggtgatttttgtgttttatcctagtgaccaatgttgaccattaattgtacattataaataatgtttttctctgggactttttgcacttaatgctggtaatttttatcatagggcttcaaatacaaaagatttgtatgaggttttcagaaaataaacatgctctttgcatataattttagtattgttcttggcattttcagaaaatcttcctcctttagtcacaccacac

SEQ ID NO: 94857 - DNA, 1100 bp, Homo sapiens
tggccatcagccaagggggaaacaaagtgagacatttgttgccctcttaactcctaaagatgttctttaggccttttctggtgatatcttcccatgaatcaacaggagtcctttggtgtatgagcttcagaaagctttctggcccctctctgccctgagacatgcaatagggacacccaaacctgctccttttgcctgcatcagctctgcctgtgccttcattttgcaccctactcgggaaccagccatcagcagcacctgactcttctcactgctggggcctataacaggtttcctcacatttgctaggattgctgcatcctgggatgttgtggcctcttccagaagatgagataaccccactttggaaagaagtcgaactcctgttctgttcctcactcttatcaccctggtttggatctccctcacttctcagaggccttctatgtgtgtattactcagggttctccagagaaacaaccaataggaggtgtgtgtgtagagagagagtaaaatggagtagaaacagtaaataaatatctgttacgagatttgactcatgctattatggaagccaagaagtcctacaatatgccatcttcatattggagaatcagaaaagaccacacgttgggaatggaggtggggggggcccaccaggagctcagctgtgatgtccgagagcaggagatgaatgtccagctcaagaagaaagagtggctcttctaacaatcgctgtgtgtggaggctttccttcgtgctgtctagagactcctcaccctctggactaaatccaaaaggaggactgtgcacacagactgacctgttcacattagtcccagagctgcgctcttgcagctcagcagataggccgctcttcactccctgctcaagaggagtgagggctttcagaagcccctgcaccttcatgctgagctcactcctttccattgtatcagcagccatgcctgaacaaaaaatagtttctatttattgagtgtttactgtttattatggtagattcttgggaaattgaaactctctgacactaccattagtttttcttcttaggggaagcagatgaaatgaccaggctgtta

SEQ ID NO: 94858 - DNA, 1045 bp, Homo sapiens
aaaagaattgcatttcaagttaacctaagtaaaatgtgcagcgactcactataaagacactgggcatgttggtctggatccctggctgctagctacagcagccaagcctggatatctgaagcaagagaggatttcagaagagctttgggggctaacagaatggagggaggttggagaacttggctttggttatggacaggactcgcacagcaggcgccctacctggtcatttgctgtcacacggcagctgccatgtctgacttcctgaagctcaagaacttgtttcaagtcttgggagagagcatccaactgtctgagcctaggccacactgcccagtgacacagagtgggaggccctatctctaaagcttccagaaaaaaggcaggcacttctgcccaccaagaggggtgggaaaaggatgttttaggaagagggagattaaaagctggaagccaaaaatggcaaatatccaccacaaggactatctcagcactcacaggcagggagactcaaggaatgagagccaggaacaacaaccagaagggtctctttctggatcttgttttccccacctcaccccctacacgtgatctctttttctctgactgcgaaactttctccacttcatgtgcggggccccttctgagcctcccattttattcatctcagctccagccacacagaagctagcttctctcagtcccaattccacgtttttgggagagagaatgtgattgattcaggttgggtagtctcagagaaagtgattcttttaaatagagaagataccccaaacatgtcctacaatttgggggcagacatgctcactagaggtttatttctgcacagactgggctgtgcagaaaaagtttgaagacagccttctgtatgaataaagtagtgaagttgtgaggaaggtgtttaacctatacagaaaactggctcttttcttttttttttttttttttcctgagatggagtcttgctctgtcgcccaggctggagtgcagtggcatgatcttggctcactgcaagctccacctc

SEQ ID NO: 94859 - DNA, 1043 bp, Homo sapiens
taacttgttcacctctttaaaggtgctatctctaagtagaatcacattccaaggtactggaagttgcctttcacatagaaatttcgagaggacctaattcagcccataacacagactgtgtcacttgtgcccaccactgtgtccccacccaggacagtgcctgacttattttaggacttgacacactcccattaaatgaatgattgcatttcagctccccccttcctcttcctcttcctctccccaccccccaccatacgttgtgctaaaggcaaagaaaagaaggcatagaccactacagaaggaccctaagtgaccacaggaaatgtttgctaccctaatcttgaaattacagacctttttttggggagtgttgctctcttctagtatctccctatggggaaaaaaatcagccacctgtcagcggccagcccatcctgccctgggtgtgtctactgcccccaggggctgctgtgggagttttgctgacagctgcacacccatccaactggccctctttagagggtgagtcaacaggctgccgggagtgtggatctatctgcaggaaggcagtttagcaataggtactagaacctaaaaaaaagtcatatcctgtgaccttacaatctaatctgaagaactgggtggggggagggggagggctaagatgagtttatatcttttttattaaaaagaaactccctttctcactattatagtagaatctggggagagcctaaatgtgaaacaagagaaagtttgtgaatctagtacattcatatgacagacaattatatagctattgaaaatagtgtttatgaataattgtttaatgatgtaagatgttacatgaaaacgtgggacacagactgcattctacactcagatatataataaatactgcaatttacatgtgtgtatacattcagaggagaaagcctgggctgccaaatacccaaatgttaatatactattttttcagaaccagagatttctttctttatgctttttgttttaaaatggcatgtgttgcttttaaagcc

SEQ ID NO: 94860 - DNA, 1052 bp, Homo sapiens
tgtcgcaagcctgactttccgaggtgagagccccgtggctgccgcgcccatgctcgggtgctacccgactctcggcgctcactggcgggtctgaagcccctgctccggagctaaccctagtccaggccacagtttctccctttgtcagcagggacggaaatcccagccccgacttctgcaggggggcgatgaggaataagcagagcacaataaatgccacagggctttgaaaaattggaaaagcgaaagtgccgtaggtcagcggttatcacttttctaagactgacacccagaggaaataaagtccgagcttttactgggtagtggggataagggtaagttggaagatgggtgcagaaggtagagaggaatcagggcctctgaaaaacggggcgtgtagatgatgtgctttgaaagttgtgtcttttttcattcattcattcattcattcacccatctttatccaacattggctgtattgaatctgccccgtcttaatcagtaggaaaaggaacagaataggatggaaatggccttgacacaaggagttttgaggaatgtcaaggatattttctctaaattcaagaagctaagtccctacatgtagtgcttagaatacatacaggtatttctgtgtggggcagcagagaaatcacacacacactcctcttctcaccaggcgtcctgaaccccctcccccaacccctccaaggcagattcccactggagcgggtgtctcaggaggggaaagggaagaggaaggatctgtcaaaattaagagaaggaacaatagctgtgagtcaggaccccagttctgcagagaaagataaatcaggagaggaaagagggtttccacttagccaggagccataccctgtagctttgtggaatcgataataataataataaaaatctacgtatcagaaaagatagtcaaatgaagaaggaagagtagctggtgttttcataagcctccttcagtgcaggcaccaagggaactcttttcagtctgacccatgatctgaatcatatctccaagcacccccaagata

SEQ ID NO: 94861 - DNA, 1020 bp, Homo sapiens
tagattggcatctgggctcatgcaagaagctgcgcctcccatttttcctctagaaggaggtggagggagttgaagaatgaccttatggtgaaggaggcagctggaatgctccgtcttgaaagtttcaacctggccagcctcctcggtggaccccaggcctttgcgtcctctctgccctaagccacctccttgtggcgtccccgcttctgctgctcttatggcgtgtctcattctgcctgtccctctcttttagcctgcttgcatgtcccttttctctctttacaccctaagctgaagagccctgaggttacattctgtgtacccacccaccccagctggccttctttgcatttccccttatggacacctggtggcagtattatccaagatgtgaaccatacttgatttggccaagttcctaagaagataggagtgtgggagagtgtgtgcgactgtgcacttcatggtatggaagaaagaaaaggtcctgccctacttgtagggcaggacaggaagatttaaaacaacttttttttttctgaattcaagaataaaacccattaattgcaaaaaattgaaaaaaatcagagacaaggaaaacaacaaaaactcccactgcaccatattctgtaccctgcaccaccctggagagaattactgataacattggtttgtattacctaccctgttacctcccctcttcccacttgctgggaaaaaatcatgaaaatattgattttccttattcaaggattctgtatttgccaatttgcctactcactaaaatgtatttgcaagcccaaaatcaacactcatggcactttagtgatgatttgtggacactttcagggctttgaaaaatttgagtctcccagcgtgtatgttggttgctgaggttgaacaaggtgactctctgcctccccgctccaactctcatggagtaaacatgacatgtccatgatcaaaggacatgtatttactccacgagagttgaaacagggaggcagagagtctcaaaac

SEQ ID NO: 94862 - DNA, 1023 bp, Homo sapiens
acaccactctgcgccttgcttttttcacttaatcatataacttggagatggtttcacgtcactacctagaggcatcctcattctgtttgacagctgcctagtactccattgtacggacggaccatacttcatttaacctgctttccattggtggacacatgggttgttccaaatccttgctagttcaagccatgctgcagtgaatagcctcacacatatgtcattcctcacatgtgcaagtatttctgtaggatgggtgtctagaggtaggattcatagggcagtgggaacatgcatttgaaactacaatacatagtggccaattgtcctctgaaggggtcaaactattttgttttcccaccagcaaaacatgagcatgcagttttcccatagccttgccaacagtggtctatcagactttagagatttttatgaatctgatgggtgaggaatggtattttgttggttttctttgtgtttctttctgagtgggatgaagcatctttttatatgtctcaaggccttgcgtcttcattctgtgaactgtctcttccactctttgctctttcttccactggattggatcgttggtctctcttctttccttactcctctctttgctaactaacacaagggccaaatcctggcactcagccccacacccagccctgtgtggcctttgtctggggctctttttacagggaggagggggaaggtgggggcaggggccagcactgggtggaccaggaatggagacatcatcctcacccctggggacctgaagtctctgatttaagtcagatgctcattaaatgagataatgcacatgaaatgcctagcacaatgcagggcttatcatagtaaatgctctgaaaaggctgctcattattttcatgtgtagaacatggaaatctaccaggatctgtgtatctgaaactgagtctttacctgctgcccccgtgtgtgggtataggatccctggggctggctaaggggcctggtgttccttatggactccaaggc

SEQ ID NO: 94863 - DNA, 1037 bp, Homo sapiens
ggtaaaataataatattaaaaaagaactttgttaattttataggtcaaaatagtatttcattgttgccttaattttcattttattgatagctggtgaagttgaccgatttcaatttgaatatatttaaataattattttatatttatatataacatgtttatataatttatattcattctattataaatgtcttatttatgttctcagtccatatgaggaaatgtttatctttttctcatacctttgtaggagttctgtatatatatggatattaacttttcccctgtcatttatgtagtaaataattcttgttggctttattttaccaattaatagtttttgacctatagaaatttaaaatttttatgtagccaaatctgttagtcttttccttagggaataaggcagggatctagcattacttttttcaaaattgttctttggtgatacaaacactgtattttgagtaatcttttccctatatttcgaaatgctgcctttatcacctactaaattcctaaatgtgttcttgggcctgttcctctattatcttcaattggtatgtctgcttattatttctttggttttgatatctgggttatgctggctttgtaaaattaattgtaaagatttaaagtcttctctaacatctggaacagtttctataacacaagaatacagtcctttgagggtttgaaataattcacccataaaaccatatgggctgggtgccctttttgagtgggtatagtaatagctctttaaaaacttttcaatttctcctgtgatgattgttatttttagtttgtcacttttactctagtcaattttgataatttatattttcctagaaaagcatccattacgttgaggtataatttatttacatagtgttgtacagagcaaatttttataatttgaataattctctctacctgtggtgttttactttttcttatttctaatgctatgtatttgagtttttttttcttgattagctggttagaagtttattttaaaactttattggactttt

SEQ ID NO: 94864 - DNA, 1012 bp, Homo sapiens
ggtgttaatgaaagtctgtctgtcttggcaagtgggtagatgggtgcatgggttgatggatggatggacgaattttctggctactgtctgtatggatctgaggaggaatctctctcttggctggggaaacccaaatggaaatttcagatgtccctatgtgaaatttagctaaactcagtgctagtgcctctgggctgcttgggtgtttatagctgaattaggcagataatttgccccaaactctggctgcctgctcctggctcctgtttcccggctgctccatgggcctgtctgagattgtgcagggaagtgcagggcctgcccagcaggatttccgttctgtgtgtgctgccctcaaaatgtctacacactcagatggggagggactattttaggtcctgctggccacaagcacagccagaggcagacgatgaggaggcccagcctggccatcctcccggcgttgacatgagggaactggggctgggatctgagccagagctgggcctgtgctgtttgtgggagcacacggccactctggctagagctgctggccagaccagcagcactggtgggagctgggatggggctcctggaggtgtacccacctggggaggggctgggcctcccctggcctgggacaggggaggaggaggaaatgacactgatttgctctgatgggggaggcttggaccttgccctcatggagctccctgtctgatgaaagagacaaaactctgttctcaaaagcctcaaacccagcagggagaccagttctgttctgcagggagccctggccctctggggaagccccttttctggtatctgactttgttccatgtttttctctgagatctattgctctgatttggctgatccaggaaatctttcactcactcgcctctcctccctgtccctggcactctgaaggacaggcgctccaaggccaacccaggaggcagctgaccccgggtgcagttccagtggtttgctagataactatggctgggct

SEQ ID NO: 94865 - DNA, 1050 bp, Homo sapiens
tctgacaatctttactaatatatttgaatttgtttctgccatcttattttgtatctctatcagccttttttcaattaaaatattcccctccttttttccatcccttctcttctttttagtttcaaaactatatatgtttctatttctttagtgattagtatagaaattttaacatggcatatttaacttagcaaagtctaaatttaattggtatttatatcttcctccagaatattacaaggaacttagactgctttaactccaatcacctatcaatttgcaaacttttgtacaatattttagttttatcttttttacctacctttttaaagcattattttattttaagtaatcatttttttcttttagctatattcacatttactttttttttttaatatccgtcatctttttcctgaagtagggcctattgaaattcctataattgaggtcagttcattataaactttctcactttttaactgtttgaaaatatttttttcacccttatcttggaaataatagtttcactaacagttattttctgtcagcactcttttctggcttccattgtgctattgttttcacaaatctgaggacttaaaaaaattttattttaaagttaagtttagttttggctgggtgcagtggctcatgcctgtaatcccagcactttgggaggctggggcaggcagatcattgagctcaggagttcgagaccaacctgggcaatggtagcaaaaccccgtctctacaaaaaatacaaaaaattagctaggtgtggtggtgcatacctgtagtcccagctactcaagaaactgaggtgggaggatcgcttgagcccaggaggttaagggtgcagtgagccatgattgtgccactgcactctagcctggcccacagagtgagaccctgttgcaaaaaaaaaaaaatttaaaaagtaaaattagtttaatttaatttttaaaagatgttatttttattcattctgagcaattctcaaccattatctcttcaaatgttacagattccattctctcatcatttctg

SEQ ID NO: 94866 - DNA, 1263 bp, Homo sapiens
aacgctgggaaggtgcagggagtgtctgcagtcatttctccctcccttcatgttcatcccctggttccaggccaaatagaaatgcctgaacatctaccagggacagtccttttctgtcgtcgtcatcatcatcatcatcatcatcatcatcatcatcatcatcactactctagatgatgtagggtgatcatatgatccatttccctccaacacttggaggtgatacctgttctctgggtatacttaatactacccccctttcactctcaagagtgctccaatttggatttcaaatgatttcatccctgtatataagaaaacaaaagagcctgccaaaggtcacgaagctaacaagcagttcagctggcaccagacccaaaccacatactcctcccaagatgcttcatggcctgcacaagatgctgcacagtcttcccaggatgtgtcacaaccctcccaggataccccacggccctcccaggatgtatcatggcccttccaggatgccctacagccctcccaggatgcctcacaacccttccaggatgcctcaaaaccctcccaggatgccacacagccttcccaggatgcatcacaatcctcccaggatgcctcacagccttcccaggatgcgtcacaaccctcccagtatgcctcactgccctcccagcatgcctcacaattctcccacgatgctccacaaccgtccaaggatgcttcacagttctcccaggatgcctcacaaccctcccaggatgcctcacggcactcccaagatgtctcactttctgcttctccctccacctggcaggaaggatagtgtagatcagtgtgtgagcctgtgtgctgagatcctagactccttccagaacttgaaagctagctagagggagtcagttcaccttctaaaaatctctcctagccttcagggtggggtaggaccctaaatagtttctgaagcctctgattttccttcacgggtgggcagggctgagagggagggatgcaggatctgttcactggtgctctttggttttacccctcaggcttgctcagaatcccaactgtgggaagccttaacttcctgggggtaaaagacacacaggctgtttctttctgttctctgcaagggtgtgtgtggagggtggagtggggcaggtggaccttggagttagtgatgatgttggggcggagtaggggccggagctagtactttgcatactggcggtcttggggcctgggggcaggattttagctgcaggt

SEQ ID NO: 94867 - DNA, 1023 bp, Homo sapiens
acccatcagactcctcagatatggcctcaaatacctagagatgtagaagtaccgtggagggcctcaataagagggcaagcacacagatggctagaagcctgtatggcttctggtcaggatgaacccttggccaagttcttgaggaaaccaggtctatattcctgaagggacagttcagtttgggactctattaggtttcagtagtaatataggctgcttgcatcattttaacattcatagggaaaatctctttgagcaggctataaatgaagctgttgcaggtagggaagaacaggacctgaaaatgggaaccaggaagtgagatcctgttggcaaagggaatgtagagcttccagggtgcattgcccactgttctcattgcataccagtcctccaagtcagtctagccttactgtacacttgacaagtgcttactcagcaagtcccagacccacggccttttatctcccaagactggctttggccatgaccttcctcatcaggcctctgagcacactctctaggaactgctgcagaaattcccctaccttagcctcccttctcccaggactcctctcttgactgcaattgcctcttcttcttcttcttcttcttcctttttgttttttttttttttgcctgcattcacaattacttttcacaaaggtgttggaaatggcatttttattttacacagatagttgcacatatatagagaaaattaggaaagtccatttttaactctaaagggaacttttttctctaaaacttacttgtaaagctactgatacagatgggccgcatggttaggggaaagctcctctgtgaaaagagcatgtttattcctcttgtacattttcctcttttaactgctattaaacaagaaagcctacatacctgtttcaaaagccacggtgttgtctcatgggtattttgttcttccatcctttttgcacagtgcagctgtggttggtgaactggatggctgacattgcatccccactcagctggactgaggactag

SEQ ID NO: 94868 - DNA, 1045 bp, Homo sapiens
gaacaagcatggcatatggcaagatgacagcttcattccaatcccccaagaatggcggtttctttagcctgatctaaccccaggcttttattgcaattttttctagggcaggatacagctaagtagacagcagtaataattggatcccatgtttaactgcatattgccccagctctaggagtgttgagtctcaactcgaagagtttttctggatcttgaaagccagttttcatggaatcagagacccaatcccttccctgttcatctcatttccttcacttacagtcagagcacttggttcaggacataaatcaacagttacttccataggccttcacagggcgtttcagacttagcctcctccagtaatgccattgaaatagttcagatttcggaagcctaaaaatggcctttaccttacccttaggtgtaacctgaggattagttgggattgttcctttatgttttaaaaccagctttttggttatcatctttaaggaaatgtcaccagctctgcactgtgggggcagccatgcctggactggatgcctctagggatggagacattgttaccataaagtcgacagagccaaccatggcttgtggcttgttgcctctggcccaactgtccttcactaaataatatcctagatattattttgttgctcaagcccaaggttcccaccctcttttgagatccccaaagccatctttggccttgtctaagaaagattgcctataatcctgtcctccaaactctaaagcctggagcagcttagcgtggaggctgcactcattgacccagatggactcctgagacttaacgcaagggctttgctatgaggtcagtcgggggaaactgtactttaagacacttcagaaagatgctactggctagtagcagaaagatggctagtggcaagagtataattgtgcatcaccaaacaatgacaaataagccacacaggcatttccagcttggattgatgggaggagagactcatcaaacagaattcttcactacctttgtcagctactgagttgc

SEQ ID NO: 94869 - DNA, 1227 bp, Homo sapiens
cactcctgagagatctagccatgtcagattccttgcttgacacccccaccccatcctaccagtcaccacctacctggctcaggcttagatgcccttcttttgaactttctttgtaacctgttagagtacctgttagggtattcacatcattctgtatcaatttatttaccagactgatttcctcaagactagagataacgtcttaacatcatttcatatgcagtacctagaagagtgactgagacattgttggtactcaatttatgtttgtcgaaataagccctgctttgcattttctacatttgcccagatttctgtgtcaggaagtgctcctgaggagacacaggaggcagactcaggatgcccttctttgaatcacagaggcccagcaccagagacagggagttggaggaaatcttgggcaataaacacaaatgggtcattggtcaattctatgctttttagtagactttacaattgttctcttaatctgctctcagctgctgatagaagctattatgattccacatctgaaccagaaaaacagatttggtgtcatgcctggggtcacactatcagtcagaggaccctcagccttggaactctttttgctgtgctctactgcctccaaaaaaaggcagatgtggatcagtgattatgaaaatactttataatgatgtaattagtttcatcctgtcaaaggcagggagtggacaaatgaagctgctctggggttagtgttctgtatgttagtgaaagtggactgcactttatacagtggccatgctctgaagaggtagaatttttagaatttttcttggattatatgttaagtgtcccagaaaagcatgttatttgaaatcattttgtagtctatcctgtttaacatgaagaattcttctggaatgtatataaagtgcaaattcaggttttcctacatcaaatttacttcaaggatgcacctgctttgggagcgcagttctctacaggactcagtgttcctgttcaagcgaaaacatgcatgtaaagaaaatcacccctggggaagaggggtatggtcactgtcagtgtgtcttagcatctgtgtctgtctgcatgcctaccttagctcatactaccctttgcttcccatggaatctttgcaggttttctggaaagaggaggctttctctaacatgaggtaggccccatgctgcctactaagacccagcccacatgtcaccaaac

SEQ ID NO: 94870 - DNA, 1048 bp, Homo sapiens
cagtgagccgagatcgtgccgttgcactccagtctgggtgagaagaatgaaactccgtctcaaaataaaaataaaaataaaaacctcccaaaagccgaaagaatatgtctgcagctaccaaaggaaagcaggatgactaatggtatgtttgttaaccaaaagacagataatatggaacaaactaaaaggtctagggtttcaggatgttttgaaaatgccaggcagaattcgggcaaaaattgtttcatgtaggatgcttgatcccttagatgagaattctgagaagtaatattgtgacagtttctggcatgaggacagaaaggagattctgatagaaaaggaagggtattcatggtgatggggaatggcggtggagaggaagctatttgtcctactagggtttaggtaatttaaaacctcactgtttctttgagcattaactgcccttggtcattgaaacctgccagaggcccgtagccagccttaccctctgcctataaaaattcatagtgagcaaagacaaagagaaaaattaagacatatctcttcactttccccatcctcccaaatacaaacacgtatttctgaatagtcttcagcaagttttgcttcttagacttggccaagatttttagcaagcacttacctactgggcctgcttgtatgcattgcctttgaggatcctggaattgagtgtggtgctgaactgtaaggtagccttaccctttaagtcagctgtctaataaaatcaccttgaaaatctaaatagaatttccaatcttccgtggtgtgtggctcaatattacagcctagtggttgtcagaaatcacagtgactcactagccagctctgggtgggactctgttctttcgtctgatattcacacttactgcaccactctctcttcatgtggttcccttagtgaattctgttgcttcctggaatctcattgagtttctgctctgctcttcttggaggttctttccagctttaaacatgaataaaggctaggaaagccaggcaatgattcaaccagcccttgtcacac

SEQ ID NO: 94871 - DNA, 1016 bp, Homo sapiens
tcacagaactcacactgagaggcaggaatccattctgtttcttctccaagtccaggccagagttttgaacacaggttgcccctggggaccagagattgacttcagaactcccacgcaaaacttcaatatccccaatattgccctgacactggccatttcacttcctggctcatctctgtgtgtcagaggcaatgcctgagaatttccacaggcctgttttttgactcctggctgattcttaaaagcagcaagagatcttgctgagagtcagagctaagctaagccatcaaccgccttcctcatgtggatggaccctggactttgctgcttttatgggcaaggccttgccaactatagaaacaatgagcctctttagcacccctgtcactgccatagggtaaccagagacagagcgactcctttccaaaggtggctttgctggccagcgcctatcacctcagtctgggcttcctgaccactttttacaattgttttggattaaatagagcattccctggccttttctggttatagaggtctcattgtttcatggtcagcacaggccttttgcaggcgtatcttggctttggaatcctagagggtttaacaaattttacttcagtggaatatccttttttttttttctactttaagcataaaatagtgaatcatagaaataaatgttcttaggtcatctggtcagtctcctgggtacagctacagggtgtttcctttagaacacggtctagtctttatccagtctctgtttaaatgtcccagatgttggggcttcctcatctctcatagcagctcaaagaacaaaatgaactgtgttgtcttgcagccttctttcccctgcctgctgctctgtcagttgcctcatgccctctctcttccattctctctctctctggcaaaagtattatttcagggatacccttcatgagaagccaggagcaaggaccagagcaggtttgtgtttcatctgtagacttgcagactgtctggaaatggga

SEQ ID NO: 94872 - DNA, 1032 bp, Homo sapiens
cacaccttgaaggctccctatcaggaagtcccatcctgaagttctaacaagagtcactgtagagattctaaggcaattcattcctccattttctccatgtccagtggattgttaaatccagaaaggtgaagttgataccacagattgcctctgcctaagtttacaaaacagatggctgtctctccttttcctagaatttctctaggaggaatatttccacctgtttattttttattacattaacaagataaccccaaacttagtgactttaagtaacaaccattttatttgttcattattctgtgggtcaggaatttggccagggctcagctaggcagttttacgtggtattagctagcatctctcatgaggttgcaatcggatggttgctggggcttaaataccaggatggcttcactcacaagtctggtgccttggcagggttggctgggaggctgagacctctctttacctctccagatggctagcttaaccttctttatttggcaactggatttcaggagtcagcattccaaatggtgaagcagaagctagtagtatctgttaaggcccagcctcagaaggtctatagcatcacttttgtcatattctcttgaggaaatcaagtcctaaagctagcccagattcagagggatggtaataggctctacctcttgatgggaaagtgacagtgttattttgcaaaacagcacatgggatgggagttactgttgcagccatctttggaaacacactctactacaccacttaaggttctccttcaagtgcctcttatcctgctatagtaagaactgttttgtatttaacctaagcatcatgtactacaattggtattcaagtttttttgttcactttatagtggagatagagaacataagagttgtcactctccatacattcctgaaaggctgattatccttggcttgagctctgcttctcttacataagatagaagttgtgaggaaaaacctggaaggatacaagttgcaaattcttggtccatttcctcca

SEQ ID NO: 94873 - DNA, 1040 bp, Homo sapiens
tagttttccatggtgtatatgtaccacattttctttatccagtctatcactgatgggcatttgggttggttccatgtctttgctattggaatagtgctgcaataaacatatgtgtgcatgtgtctttataaaagaatgatttatattgctttgggtatatactcagtaatgggattactgggtcaaatggtatttctggttctagatccttaacgaatggtcacactgtcttccacaatggttgaactaatttacattcccaccaacagtgtaaaagcattcctatttctccacatcctctccagcatctgttgttttgactttttaataattgccatgctgactggtgtgagatggtatatcattgtggttttaatttgcatttctctaatgatcagtgatgttgaactttttttcatatgtttgtcagatgcataaatgtcttcttttgagaagtgtctattcatgtcctttgcccaaaaagtagacattcttgttttaagtcttccctttgtgcttcatcttacagtgtctctaccccagaagtttagtgttggcattgattattcattgcttgctagcttggttttgaggggtagaagtgttcatattttccattctcggtgatcgttttcctacctaagcagtaagggacctctaaggatctggacccagttcctttttctgtctttctcccatagatacaagggttttttgttttggtttgttttttattccattcaccacagctgcactgggtcttcccttgtgccctgaaggcaatagggtttgctgccctttctttcctcagcagcctacagcttttgcaatggagaaaggacagaagcacctaaggctaagcttttttcctttcctgcagtgactactatacatctcctcaaggcctccagaaggaggccttttctggtctcctcccctgtttccaatctcttatgaacaatgaagtctataaagaagtctcctaacaggtgcaaatttctcatgtatattgatcccaaaggttctgtactcatggtacg

SEQ ID NO: 94874 - DNA, 1048 bp, Homo sapiens
tcaccttttccttcatctcccttgcccttacccagtttcacctcctcatcttgatgctgttaattggctggctaattcataagagtttccccaaaccaaagagaagacagataaaagaatttagtcacagagtatttatgattttcagatataacgtcaatcaaatagaacatgattttaaatatcttctgggcccaaaccctgagctgagtatagtgacaattcagaagaaattagttctacccctgggtaatttaaaagttaattattcttagaggattattcattcattcacttattcaccatatgtttgctaaacatctgctatgtcccaggcacttgagatacatcaatgaacaaaacaggctgagattcctgacctcatggagtttacagtttagggtagacgagtaaggaaatagataaataataagcataaataatagattctgtagttgtagttgtaaataagtgctgtagaaggaattagaaagcagaaaaagggaaagggattggagagtatggggatttgggaggacaggttgcagtgttaaatactgtagtcagagtaggcctgattgaggtgagagatgacagtgccttgagggagatgaaataggcggatatctgtgagaatagctttgcaggcagtgggagagccatggtttatcatttaaaatttactggcatttttaaatttagtaactaacgtagagtcctttagtcttatttttcacaagtagaaactcgttgtaccaactgaatgtcaatcctggcttaaagtgactttcatttgaggcagatttttgacagaagccattgtgtttgttttacagattggaaaagtaagtctcagaaaagaaatgggaactaactagggtgtgggagaaggatgaagagaagttgactaatggctacaaatacatggtttgatagaagaaataagacctagcgttcaacagatcagtagagtgactatggtttacagtaatctattgtgcgtttcaaaatagctagagagaataacttgaatgtttctagcacacag

SEQ ID NO: 94875 - DNA, 1133 bp, Homo sapiens
gcagaaccctttttttttcccacagagactcttgtgaatgtactttgggaaatagtgctgttccattcctccccctccttactcacctcatttttcctgctttgtctgttccttctttggttttctaactaggtaacattgtacagtgaagtgatcttgcctttttaagatgctttgagatgggaatacctgtcagaaagagtcccctgttgtgatataattatatccagtaccacaaaaatggccaaagcttccctaacagtgtaaattttaaggcaacttattaggtagcacgtggtatccatttgcacataggcaacttttctaaaaaatattttgagttaatatgctatcatttaccgatttgaatcttcattgggaattcaggttatttcttatttttgctcttgcaggtgactctataataaacattttcatacagtattaactatgaatataactataatagaatgaaaattgaatagatatttgcatttgtggattgtctctctcttcatccttttatgggatgctctagagccttcactggggagctccctgcctgtctccctctgataatacctggcttctttcaggtctggaaagaggtgtcttgcttattgttagaaccataaattgttgcactaaacttgtcctgttgtcataaagagtgtagctttaaagcaaatggtaacatgaccctgctttgctcaatttcaggcaacttgaattttctaactcctaatctccgcctgcttctctttgcttcgtaatcttcgtaaatgctcccatcactgttggagttagatcttaacgacgtctccctatttcaaatgtagtatatcctgaactccatgtgttactttttctcctcttctacctgctttaccatttttctcttttcctcctccccattaaaggcatcactactcaatcagtcactcatactaagaaacctgagatttatttgaaacaaatttacaagaaaaaaacaaacaaccccatcaaaaagtgggtgaaggatatgaacagacacttctcaaaagaagacatttatgcagccaaaagacacatgaaaaaatgctcactatcactggccatcagagaaatgcaaatcaaaaccacaatgagat

SEQ ID NO: 94876 - DNA, 1132 bp, Homo sapiens
gattttagggagaaaagggataattgcaggaataatgcccttgagtatacacaaaggagtggaattaagtgcagaaatgatgggacaaggattgttcattcattgtaagagaagaagggggggaaatatgggttcagttgcaagagtgctgatagatttgttggtaataaaattgtgtaaactaaactagttatctaatgttgatgttgatcagatgtgaggttttacacatgctaaacattaaatgaaaaggcttaaattttatttcagttatagttacgctattcatgattatacataatggataaagttccaaaagggcagaaccaaggaaatactaaatcattgtcattgcatgctataatcaatacattctctgtaggaaaaattacaatatggggaaatgtatatttgcctgggactcagttgtctcaagagctattgaaattatgtcttgaaactttatccatcttatttgtcctacttaaaaaataaaaattaaaatgctgtcttcaaactctcacatgtatcccactaactaacctcttagtggttctacccatcttgcaaatgaatacctttagtttcacgtgaataacagtggaatggatgtggttcatatctattcctacccctggagacctaacccagttgacatgcatatgacagcatgtgtgtcattgtcatatccactccttccagataaggcatttaagttaaatattcttttagatcattataatgtggtggaaaacaaattgtgttacctaaacataaattcctgtatacactttgcacacacagtgcctagaaaacctaagagattagtttataatgaaaagcttggaatccaagtaggaaaagttcctcaaagaacaagatcaggaacaaacatgctaagaaataaagtagacagcaaaaggaaaaaaaggcaactatggagacattgccaatattaaatacaaagtaagcaagtaaaggccaaggggggcagattacgtgagctcccgagttcaagaccagcctgggcaacatagtgagaccccgtctccataaaaaatacacaaaattagccaactactcaactaacccagctactccagaggctgaggtaagagggtcaggaggcaga

SEQ ID NO: 94877 - DNA, 1647 bp, Homo sapiens
acttacttttgcgttgctaactaggacctgtgattggaagttaaaggaaagcagcctcaatataagagaaaaaacttgacaatagctggagttctcaaaaattggaacaggctatatttcctttaactagaggcatgccagcagaaaacagattcacatttacaaggggtgttttatattgggtagcaaattatactaagtgattcccaaggtctcttccaaagctaaaagtctgtgattttgtaaataggcaaacccaaactccttccagccttcaactctatgattctaaaagatctgtactttttaaacaaacttttctttaaaattataagtatgagaatagataaggcatgttgttttagaactttccaatctggctggacttctcagtctctgatatgatcacgagttccctggagggggtgctccaaccatgttcttctacttgttccgcctccctccaagcacatctgccacttttttttccttcttcttagtgatttttgtatttctttgaatctttacaggtggtagcaattttgcttcatctgacttgatggtatgaaattctaaatagttgggggtcatttggagtgattacttttttctttgtattctgggagcctgcaagagtatgtttggaactgcttagtttatagaccttgtcaacataaactctttattcatctttccatgtctctgaagaacagacagagggaggtcatgatatcacagatgtcatgcaacagacacatgcagagtaaccagaattatagttgttctaaactgggtaaatttagtaactttcatatttctaaatcaatggtttagagaaaagaaattctgtagattatcaccagatagaaaataagacctcggttttggtggatagtctctttaataggaattctgttggaatcccctcttgcatgtgggaatatcttccccataccatcccttcaaggattaagttaccaagaattgcggctattacaaggaaattgccaaaatcttctctgttctcttatcaaattatctggatggctcatttttactcccccactccccttgccggagtcttctggagcctgtgttttatatgatattcttttccgttacactttcagggtgtttgaaatcctgtctagattattggccatggggcaggaaaagggaatctttgaacttgatctgtgtggtgacatattttaaatcagttgcttacaacttcacagaggttttgctaatgacactctgctcataattgttgcctcgcacaatcaaaactggatacgacttctgttatcctacaggctggatacaaagaatggatttttagaagtaggttacgtattttcttaatgccctcatcaacctcacctcaccctgtgatatcgctggaagttcaacagtctccatggaccatagcatcccccttggatatacacatagttcaatttcccttcatatagctacatttctataatatataattaaattgactagtgactgcttattatcatatataaaccttattatatataaacatgaagagggagctcaatcactgctacattttctttctttctctcttcctttttctctctctctctctgtctctttctctcttttctttctttcaac

SEQ ID NO: 94878 - DNA, 2352 bp, Homo sapiens
cattatcatgagaacagcgtggggaaaactgcccccatgattcaattacctccacctggccccacccttgacacgtggggatcattacaattcaaagtgagatcttggtggggacatagagccaaaccatatcaaggtatatgttgttggtgtttttgtttttgtttgaggcagaatttcgctcgtcacctaggctggagtgcaatggcatgatcttggctcactgcagcctctgcctcccaggttcaaacaattctcctgcctcagtctcccgagtagctgggattataggcacctgccatcacgcctggctaattttttgtatttttgtagagacggggtttcaccatgctggccaggctagtctcaaattcctgacctgaggtgatctgcccgcctcggtctcccaaagtgctgagattacaggcatgagccactgcgcctggcctcaaggtatatgtttatagtaagagaagaaagttgggaatagtgtcaatgttgagtatagaaagaagagactctgggtcccatgaatgtctttaacattgttctcattcagtggatggaatgacagtcttcagctctataggcaggaaagatcaacatggtttagttgagcatacagtatatgacatctgctctgtattggttcattatccttttttatacacttaggtgtagtcccattccttaattcagaaaaaggaagtaaaatgtcctatgccattgaaacatccaccaactctgtggtattctaagcaaactcctttcagaatcttcatagcattctgcctgcctgtctggctggctggctggctggctggctgtcagaatgctttactatagtgcctgtagcagaagctgaaagagacaatttccctttgcaggagtggctgagaacagtgagactgtgcattgtctggatattctgctgtgtggataaagtatttatttactttatttagtggctgtggctgtgactttatcatcttctagctcattttccagcataacaggataagaccactcctgccattatgatttaccatgcagtaaacaatgagggcttttggattgcattttatagaattgctttattcaacctctccttccaacccctttgggaaagaatagacaattgatatttctcttttggatttctcagtggattcagcattcatagatttagtttctatttgttatttggcttgtaaaatttattgctttggggataagactggcttgtgtccagcataatagttttctgcttactagtctacacagtggcaggaggggaaggacaatgtggcttgccccaacgctttctcagttgttcttttcatattctactccaaacatagcagtgccccactctcaaacaaacaaggattaaatatcacttttggccatggagcgtagtctcatcccagcaacctgtcttcagtcatggaaagttcaggtacgtcatagtcaaagtactgcacagctgaccatacagaaacatgcagaccaggtctgacactggctactatcctattgttaacctcctctggcaggctgttatccagagcagctcactctgggagccggttaatttcatagggcaagtttagtccattgacaagaaaggaattcctggatctcttgtattgtgagactttcatggcatttccaatctgatatcaaaaattagttctaattctaaattgtcccccccaactttggatcttgctttcagaggaaaatcttcagtgttaggtatggctatattctgtttatccattttctctaatatcagtgtggcttgtttattgtctacatgtttgtcttattgttagttgctgaatttctttaaggcagaccttattctctttttttgtgaatttgaattctcaatgccttttgtcttattgatttgcagtaagtatatattgaattaattccatatgtattttgaaggatgaatgcaaaacttgtgggaggtgggaaagatagacaatgaaagctcctaagccaaatctcaaccagtatgaaaccagaatgctgttttgctcagtgctcttgaacttctattgccccagacgtaatatacgttgcttcattctgcatctttgctctatacattttatattcaaaattgattaaaaggtgagtatagcttataagccaaggcttccccaccccaccacaactcagaccaatatttaatgctttgaatttcttcagagattagatgagattgggtgcattcagggtggtatggctgtagactgaatgtctttattatttgtaagctgtctttaatatcagggatactattgcctcaataagtttgagacttcagctgggagg

SEQ ID NO: 94879 - DNA, 1003 bp, Homo sapiens
ataaactttatcatagttattttacatatttttctcagtgttcccactgctttcgcatagtagacccgtccccacccccattactgctaaagtggcctttctgaaagacaaattaaattgatcattcctctgcttaaaactcttcaaggtctatcacctccaaggaaggtcctaagcccttgcatataagtaccttctcaggccagcccctgcctgcctttccagtttaattttctaccattctcttggtatatccacatcaaatgtgttgctgttccccaagcatgacatagcaaagtttcttccctttaggcacttatttctctggcaaacatttactcaacttttaagattcaggtcagatgcttcctcccctgtgaacctttccctgactctcccagggagggactggcccaccctctatacttcttgaacaccttacacaaagatttgttgcagcatatcatactatactgtgtttatttgcctgtatgtctcctctactaggctgtgaactatttaagatagagattgttgtcttactcgtttttatatccttatctcagttcctggcacacaacaactgttcaattaatgtttgctaaatgaatgaatgaatgaacaaacaaataagtaaacatctttttaaaaaatagaattaaaaggaagtcaaataatttccaacgagatagatgcttagaaattaaagtattttacattgatatatgtcctgctttttgaactaattgttaaggggcctttgtgtatttcagcagggagttcaataccttgaaatgtatcttgaccatggataccttgatttgagaaagtcctctagtttgagtggaagtgattattgccattatagtttatcacacctagatttcaaagtaggtcaggtgaaaagatgtaagggcagtgtgactgtaactgggagagcagagtctaaaatctcaccttttactttctccttaatgcagtgtctcagaaaatgaacactttt

SEQ ID NO: 94880 - DNA, 1057 bp, Homo sapiens
aagcaagttgaggtaaggtcccatactactcataattgtttcaagaggaatagatggccaagaataaaatatgttattggattctatacttatttttggtctctttaagtcaacttacaaaatgaacaagttaatactatgagcagttgagtcatttatatcatttgaaaaaaataattaaaacaaaaatcagcttagctctgtgaaatgggaaatgagatttccatttcacttcacacagtgtgagtgatgagttaagcagaaagcattcctgagaaaaagctttcaggccactagtttgagattttaagtaggaaaatgggtcagttggtcctagagagcatttttacaaaacttgtcattctggcacacgatacatgtaaaaaaatcacatctgaaatgactcctctcattgatgttaactgggctctttcagcctaaatgataagagaaagagcccttgtctggagaaaacacctacctctctgagaacttccttttctatacctactcactgagagagtagcaggaattcagcttttgtcccaggtcccttccatgcagaatcaaacttccactattgtgatcacttaagaatttaatacaaggctgcttttgagccagttttgtttctggcagtgatgcagtcatcgggtatctagaaactcctgtaagagtctacccccaaagtggaggcccttctcccatgagccagaatcacctcactaaaatggccattgacactgaacccctcaaaacactccagaggtcaggtgttgtgtctctccttcccttttccaccctcctctatctccatctctcttccttctccatcccccactccctacttccttcatagctactaagtgctctctcaggaatgtttgaaggtgaggatttaggtctgggcaacctgttacaaatatgaattgttaccatgaactccgagtggcctctcagctttgctgacagaaatttactccatgtagaccaccaccccccaaaaaaaattaagcaggtaaggtcatttggagttgaaacaagcatgtagtcggtg

SEQ ID NO: 94881 - DNA, 1019 bp, Homo sapiens
tagtagtgtcctgaatctagttgaatttaatatatcctgaggcttaccctggaacaaacccagagccatgagttttttccacactcatcccacagctttaatcccctagaggtgagcttgtatccttgagccttgtggatattaaatacaaattgcctcagtattcaaaattgtggcaatttacttgcaaagtcgatacatttcttttgtatgtctcctttaaccctttatgtacctagggtctcacatgaggccctaaatcaaatatgcactaggaacagtactagatattttcataaatcctattttttatctgaagaataatcttgtgaggtagcaattattatgccacctacagagatgagaaacagatgccaaagtgttctcaatcaatatcatacagccattaagtagcaaattctaaatttgagtcccagtgttttgacttcaagttcaatgttctttttaggaccccagaggatatcaatatatatttggctgattgttgattgagaaggaacaattctcttaaaatgaaaagcagacattaaatgacttctttgccttggtttgacactcaccacctcctttgaatgtcagacaagggaaaagatcagtttaattgttgccatttataagtgggaaagttgagaccaaatatgctgtattgaaggcctcagctttcaattgtccctctacatttctcattaaggaaagttgagatgcatggaggttgtcaccttgttgaaggtcaaatggagtgtttctgcaatgaatagagtctgatgtgatgactagtctcatatgatccctgtgatgactcaggatttctgggtgaatgcagagtgaggaagagaaggagatttcattcctgctcactcaaaatgacaaattctgcactgaaagtaaatttttcctatctgaagcagatagtgtattttttgagtttaatgtagcaaacattttttgaatgcttagtatgggctgtgacttatgagaagaacgtataaacaggccaa

SEQ ID NO: 94882 - DNA, 1076 bp, Homo sapiens
ctgaattcctagcactgtaccaaccatcagttaactggtttttggcaatgtcctgtgattatatgaggtattatcatcaggggaacctccctgaaggatatacagacactctgtactacttctgcaactacttgtgagcctatttcagaacagaaattatattttaaaaaagcaggaactatgcaacagagggacagctactcaattttatggattgatatagaccagtagttatcaaacctggtagatcttcagattcacttaatgggatttataaggtacacacacacacacacacacacacacacacacacacacacttacttctggatcctcctgccaccactatcaccaccatcagatacctatggaatcaggatctctagaaattaagccaaggaatctgtgttttcagaaaattgctcaaggttagaaaacactattacagagcctggttactgagtcaggggtaagaatggagaaaactggtgagtctgttctgtattaacctttgattgtgattctcaaatctgttccattcttgttagtgtgaaaatccttttcaatcctggcaatagattaaccatccgttttagacttttgcactgttaagcgttttaactttttctttaaatttttatgaatatttcaatgggaagttcttgagcctgtgtcattagctactaatcatttaaaccagaagcaggacaatagtattcttgtagatgtaccttgtctttacctcattcacatgtgaattgtgacttgattccagcttttctcagtgagagactgcagacttctactttatttgatcagtttttcacactgatgtggcatcaacataaatatggtttccctcacaattagctaatgagtggaaaacaaccaaggcacaccacagtgaaaacatcagttaggaaaattacatccaaaacctaaaagaggctgtcactgaagttttgtttatgaaagctggaaaagctctcccttctcagccgctgagattcctgatgtattgtttttctactgaaagttatccaaagatgttttcagacattaactgatgaaagcca

SEQ ID NO: 94883 - DNA, 1110 bp, Homo sapiens
cttgatcccaaagctgggtaagctttaggctgcctctgcctatcacagagtactctctctgtagagtgacaaatgcattctcttccttcacagcttggctcaaatgtcatcttctttataaatccttcacaacctcctcaggcagatttaattgtcccccctttgggtccctgacattttgtatgccccttcattacaaatgctcttgtaattacttgtttaatcatctgctttcaccattagcttctgagttcactaagggcaggaaccctgttttatttatccatgaattccccatccctcagtgggtaacatagttcctatttcataattgcttgctgaatgtattgacttaatattgttttgtggcattttagaagtaaatggacctagattgaatttctgaataatatttgtactcaaactcccacaaatagattcatcattttcctcctactccttgctcttcattatcagtttactttaatcttattaaatgaattgcagaggtcacagccctggaaaaggcaaaaccaaatatgggtaaagtgggtaaagggaacttaggtggcagttcctggaacctagtacatgaggactttctctagtgagagctactgaaggagggctatcaaggaagtgctccatgcagctagatggttcatgccagagaggaacataactcctcatctgataaatcactcttactgcttcaacaggagatgactttttagactaaatacttgctcatattcttccagttctggtgagcacctgggttcaagtgtcaggtattgcctttttattcctatggcagccatttttcttaatgtaaatacatgcttggagttcatccagaatttcatccttgttatgtctctataagacatatatagcctacttaactgagctccaaaattatgccagaataacaatccaaactctacaaccaattcaagatgctaaaatctttctaggagtgacttctaaagtagtctacaaataatccttgctgaagtagtgaggagttttgagtaagactgattaatgtgttgaaaatataacatagccttattctgtatgctagaaatataattatcttcatcagtt

SEQ ID NO: 94884 - DNA, 2738 bp, Homo sapiens
tcatatagtaagtgtatgtttaactttataagaaactatcaaactgctttccaaagtggctttgccattttgtagtcctaccagcaatatatgaaaattgcagttgctctgcacattgctagtattgtcagtatttttttcaatttgggctattctgatatatgtatagacatatgtcgcggaggttttcatctgtattaacctaatgactaattatgctgagaatctgtttttgtgcttatttggtgtttaatatatttgttcaaatattttattcagtttcttttcttctgtgtttaatgtatttgtatctcttcttttgtgtttaatgtatttgttcaaatattttattcagttttaaaaataattcttattattgagtagtgaaagttttttatatgttctggtcaacaggccatttccttaacagtatctttcaaaaagcttaagttttttcttctgattttagtgacatacagttataatgtcacttttttcatgtctcacgctctgtgtgtcctatcttaagaaatctttgcctaatccaaggtcacaaaggtctgtttcctatgttttcatctaggagttcatactgttaggttttacacttaggtctatgatgatatgttttgggttaatttttcaatatgatatgaagtatggccaaggttcatatttttatatggcatgtacagttgttccagcaccatttgttaaaaagactatgctttctccattgatgcaccttgatacctttcttagaaatcaattcaccacatatgtgttggtctccttctgcattctctatattatgttcaattgacctgtgtgtctgtccttttgctatgtcttgatcttacttttatattgtcttgaaatcaagcagttcaagtcctccaactttttcttctttttcaaagttgttttgtttattctaagccatatatgtgtaaatatatatgaacaaatatgtaaaactgtatatgtaaatatataaaaatatatatgtaaatatatataaatatatatatcttacaatcaatttgtcaatttcttaagaaaaaaaagcttggctgggagtggtggctcacgcctgtaatcccaacactttgggaggctgaggtggatggatcacgaggtcaggagatcgagaccatcctggccaacatggtgaaaccctatctctactaaaagtacaaaaattagccggttgtggtggcatgtgcctgttgtcccagctactcaggaggctgaggcaggggaaatcgctggaaccagggagtcggaggttgtagtgggctgagatcgcaccactgcacttcagcctgggcgacagagcgagacttcgtctcaaaaaaaaaaaagcttgctgatattttcattaggattatgttgaattcagagatcaatttggggaaaattgacattttgacaattttagtcttctaatccacgaacacagttctgtgttcatttatttgaattctctctttagtgctttgtagttttcagcaaatcttgtgcatattttgtgagatttattccaaagtgttccatattcattataagtggcattgttattttaatgttgatgtttaattgttcattccaaatatatagaaatatacaattggtttttgtacgttgatgttgaatctcaaatttgctaaactcacttatcagatgtagtggttttttatacatttttggggagtttataggtggacaattacagcatctgtgaataaaaacagttttagattctttctttccagtctagataccttttgttttttggtcttattgcactaggaactccagtacaaggttaaataggtgctgagagcaggtatcattgccttgtttgtgatcttagtgggtgggggagtattcagtcttttaccattaaatatgatgatgggtataagtttttttatgccctttgtccgttaagcaagtttcttttatttcttaatttgattaaagtttttattataaatggtccatcagttttacagaccatcatttaattagccattatttctaaacttatatgttatttctaatgttttgtttttatatttaaattattatatattcatatctaaagccttttaatctgaattactccttaatgtaaattatttatataagagttgtaagcattcttatgggttttaaatctattgctgattcttaatgaagggttataccaatttaaattatttcgggaagtataatcatgcatcagttttatagaagcccaaccaacataggttcttatgattttaaggtttttttttttttattaacttcataggtattagagtgtacctttatttcatattccactttttattgctacacataaagtagtattaaatggcccatgaatctcagtaaggatatgaatttactagtgtccatattttcaattcttagtgccctattctctgatggaaggtattttgcaatctgatttgatgcatatctaatttaaccttactgtattacaatcaaataagagaagcagaactaacacttctaaaaagttacctactagaggtgggtggattacttgaggtcaggagtttgagaactgcctggacaacatggtgaaacccagtttctactaatagtacaaaattggccgggcatgtggtatgcacctgtagtcccagctactcgagagcctgaggcaggagaattgcttgaacccaggaggcggagattgcagt

SEQ ID NO: 94885 - DNA, 2266 bp, Homo sapiens
aatttgaaagtttttgagacaatcacatctttatgagaagggacaggagagtcattaccagtgaatttccctgggagtagcagtggtatcagaggctgttgtagtggtactggttgaatgaaaactgctaggttttgaacacgaatctcatcttcgttaactgcactgtgtagctttctactagaggacccttacaggccaaggaaaagccttggaacccatttctaactactgcattctactggtagccggtggagggcagcagagagtgacaccaaaggtccagattgaggcaactaggacatagttcagtttaccaagaaagaagcacccttagctataaaagaattaactacctgggagccacagttacaagcatggatccctggggagcaaggaccaaaaggagaatccagaaccctaatctgagtgttaaaacacttccttctagggcaagtccaggaaccaggaatgggtaaaggtatgaggtaggaccgattatgaaaggggaactggacagcatcagtgaaggtagaaaaccgaaaggacagtctaaagtgtcaagtcccaagaggacaagtgaagatagaacaggaatcaggttgcttctggacctctttgagggttcttccctcgagagtttgtgtctggaaatgctagctcatgaatgagaggcaccgtgggccatgtcagattaaactattataaatggcaggtatgtgaagacaagcagaagatgaaagcccttcggtttgtagcagttctgacaaccttttgggtagcaggagataaaacaccaggcttgaatgaaagaaagaagtacagtgggaggcaagccagaatgaatgagttaaagaggcaaaagtacagttagggagatcgatcctctgaggcaatggtacccaaggaaggagccttgtgtagggtacatatctgcaaagggaacaatttcagacacaaccagctatatctatgggattctcatctcttaaatattaatagctgcttcttgattcgccaggatcatttctttcttggtctgttgattttaagggtaaaataacttgttgagaatgtggagagagtgagagagatgatgcgacattctcagatgcggttaagggattgttgtacatgaaatgaaattcaacgtgggcatgaagcctttctggataacatttgtgtgaaaggacagcctgttttcctagaatagcttttgatattcccttttcatgttttatactgtaacactggctaagaatatacagtagaaaagaaaaatgggctctgatgactagttatataggcaagatcccagtcagtccagagacttaagatctgttcccagtaggttagcagagagttgtgtttggagtctctttatgctgaatgctcagcatttttccaaatccccttaggtatgaagaaagaaaattctgcctcggtctattaagttctagtgtctccctcttttcttcaacccctcaagcatcagaaaaatagggcttctgtaaccacaaatttcaggaaccctctactgggtggcagggcagcatggtgattaggtttggaactgagcagaccttacgttactagctgtgacatttggcaaattatttgacctctctgaggtgtcatttcctagactattaaatgaaaattttaaatagcttataaggcttataatgttggagtaagcattaaataagacaatataattatgttgcttatgattcggtaagcatttaattaatgaagtagctattattgttacttctactattgctgtcactgtactgtagtggcctacttaagaagtctgcctgcatggaaatggtatccagatgaaagtcaggcaacctggagtgatcacttaactcttgctgattcattacatgacaggatacttgtgtctttggctaatggctcatactggggctcctgccatttctcagaaagtaaggaattgagaatgctaactattaaatgttctgagctcttctgagcatagaggtaactgaaaagaaattaagccttgagttaatttttcatgtttaatcaaattacaagtcatttgctttatttttctctattaagaagtactgtttatgaaaatattactatagtagattaaaaatagttatcaaagatgaaaaataagccctaactaaatgttctatcttaacacaattgtttattttgtggggctctttctggtctttttttttatatgcttatttgtaatgcctatgtccttttatattta

SEQ ID NO: 94886 - DNA, 1093 bp, Homo sapiens
aagtgcgtttggaaattctacctcagggcattttttgatttaacaaatagttcatatttggcagaccaggacctcatgaaataatatccaaacagagcagaaatctttggtatagaaaatcatgtaagatgtcatttaagtaccaggaaaagaccaaaatttaatgggccaagtggcatcatagcatgtttggaaggccattttctattcattatcctcttactatgaaaatcattttagcacctcaggggtctaacttcctaaaagtccccatggaattgtttcaggagattaggaatcaggggagagggagtattcgtagtagatgataaccacactaagaccatggtagtcttatgagaggtagactcctttttatttttattttaatggggaaggggtccttgaagggaaggtggaagggctgatgaactccactgtggttttcctcagagagcaagcacacccacttagtagcaatgtaagccccaaacagttggttctttgcacaattgtatgtggtagaaaggtaacttctggacctctttgagggttgttccctggagagtttgtgtgtctggaaatgctagctcatgaatgacaggcactatcataaatggcagatatgtgaagacaagcagcagttgaaggtccttcagtttggagcagttctgacaaccttttgggtagcaggagataaaataccaggcttttgacatatttccccatgaaaaattaatgaggtttggccttctgactcatgggcctcccaggctaagagtttccattgttgctttcaacccatattgccacagtctaaccaaacgctggcttgcccagcactttccgcttcatccttggaggcagagccctactacttagaggttccaccagagtatattatgttggtgcaaaagtaattgcggttttgccattgaaactaatggcaaaaaccacaattacttttgcaccatcctaatagaacaccctttccattaggtgttagaatgaccttttacagaactgtcagtctaatctttgacaactctcctacccctctgcttcagtagaacaatgactgtaacttttgatg

SEQ ID NO: 94887 - DNA, 1109 bp, Homo sapiens
ataaccattaaactgttaacaggaagccatttcccacatgtacttaatactggtcctgaacttgctggaatataacttgggttttgggagatgaactgtagttttcccaagtgtttactgaacagctactgagcagttgatgaagagaagtgtgggggtaggtagcaggggaaagtttttatgaaaagatattcttggtagagaaaatacagttgtttgcaaaccttccagttgggaagtgtacggaccagtaatgttgtcagtagagatactctccaagcgctcagttgaaatattctgttgaccttcagattgtatgtgatgtcaaataatggcctataaaactgggagccatctataccatagtcagaagtcaaataacttgataactcatggaattagaagatgtcattactatgactgttgtggataataggattagaaggaatgagttaagccataaagtacattatcttggaagagattatctgtaccactgatagagtagcatgtatatatgaggagggcagatgagaaatgaaatccagggtcatcatatcccaaaggcatttggtggttagaagaagatatagtattatcagaccacctgcacagatctctttgcagatgcagagccactgcatgtcctgcagaccatatttcagatcttgacatagccacagcaagcacttggatatagatatagacctccctaatcaggaaatgttcattcatttattcaacactgtgcctagcccaggtagtagatacaatgcagtgaataaaacaggcccttacctttatggagcttgcattcttgtataacattctcttctccccatagtctctcttcaggtggcctgatgctccaagggatgtcactttatctagatttttttttttttgtattggtgccatagttccgttttaggaaacagctatagagttttctggcaagatctctagggcaaggccaactctgctgtacgcagatacacagactttcagagaagacattttagctgtggtttagcagcccaacataaataagatggtcaacttcaaaagatggtcctttggtttttggaagcagagttttctggtcgttt

SEQ ID NO: 94888 - DNA, 1862 bp, Homo sapiens
agtaggattgcagtatgacttctcatgcaaaaatcaaatatatgtgtatatttccatcaaaatccaaatttgggctaatgctgaattttgagaagggtagcttaaaggctcatttaattagctatcttgaagtggcatgtaaacaccaagtgctgacctttaatggttcataattgagaattataataaaggaccaatagtagattctcagtacttactttattctttaaacagtggcatggcttatatttttcttccatggttaaacattaagtagataatgctgatcaacactagaatttgattttcatttcagtttattttatcaaagtctaagtgcctactgtgtacaaatcacaacctaagtgttgtgggaatacacaaatgaatatagtataatctgtgccctctgggagcaaaggaatgaccagcaaattcctgattctaatataaggcacactgtgataagtactacattgaaggatgaagccattatgtatgtttcagttagttcggtgacttttgctacaaaataaattaccccatgttggcttaaaacaagaactacttatgaagctcaaatttctacagattctcaatttagggtaggttcagctgggcttactcatactttgaggtctgctgctagattggctagggactggttggtctagcatgctttagctaggactactcttttctactctctgtgatctctcatctacaaacaacctaacctagatttatttacatggcatcttggcagagttccaagaaagcaataggaaatgcgcaaactccttgaagcctacacttggagctagcaaaccatcagttctaccacattcttgtggctgaagctagtcacaagtccagtccaaattcaagaaacagggacataaactccaatttacactctagttgagctataagacatatataaacaatgcaaatgaagagcaagtttgtacctataagtgcaaaaagaggccgtgaagtagagaggcctatgtgtgcctgagtagctataaaatatttcatggaaaaggtgaagagtcacactgaaagtcaagcattgttaagggaagaaaatatttaaagcatagaaaatagcagatttaagttttgtttaaaaacatgggtgttttgtatgttagtttaattaggatctagactgtcttttctcttttaagtattaggctgatctctttaaatccccatttcttaatttctcatattattttttgttgtttgtcttcctcatatacctcttcttttatgtcctatctattctcctcattaaatgctactatttacaggctaccctgaaacatttcacatttctgttattcacattcattgtaagtgcttcttaacttccttggataatagtttgcattatttatttaatctatgatagtttaccttccatgtttggtcaaaggcttgagggtgttccttttcttagtaacatcccattattttctgttccttggccccaacagttatttacttctgatatatacttaagtttttataaagctgaatgaactaggttgtgacattgcatcagatctcgcgaatggagcttgctggcaacgactctcatacagcaagccatcccaagatatctagggcttttttttagattgagctgttgatattccctctaggccagttattccccaatttctaacctacaatctaaagtaaacacagtgcatttccattgcagacacttaacctgccttgaaaacaactataggacctaagagaaatagttgcatgtttcttttgagatgttgaacaaatactgctgctattccttttagaggtatagaggtaaaacccgtacctttggt

SEQ ID NO: 94889 - DNA, 3060 bp, Homo sapiens
gggaagggagggggattggcgttggcgattcacattggagacctaagggttttccctgtatttgaggccacctcttttatttagctatctgggatccttagctatggtggagttaaaggttttgtgggtagaagggaaggcgggggtgggaggagggacccagagtagagggactcaagtgaccctcaagtgatgcgacccattgtgctgttgttggcttttgcagacatagcaaaaagataactcagcaaaccaatgctaagcaggtgcactgatgcagagactgcctgcttggagaagttttgtttgtagataatgtggccagcagcatttaagaaaaatgaaatattttacattctggattgttggttggtttgttgactttttcctgctgccttaagtcttcccgcctcctcctttgtagaatgttgtcagccatgggtaactaagtggtcgtttttgaagatgattagaaaaggcctggaccagtgatgctaaccctattaaagtaatgtgatgaaagctgatacttgggcatacctgagctttgggaagcccattagatagaaccagtcattctataggactgtttcttgcagattgaactgggtgggttggtaggccttggtggtttggatatagggaacagggtgagcgggggcctagtgagggagagagttaactgggctctgtcatctcttcactcttaagatggatggggttggatagaaagtgtgaatgaagtaagaatcaatgactgatgcttctttcctattaaaacaatcttttttttttttgtctgtttaaaaaagggggctggctttgtttctcctgccataatgatgcagtgcctcttgttttcagagctgacatagtttgcattctgaaaacttttagatgcccagggtatttcttaaagctgcaggaccccttgtatcggtagttccttaccactgtgattcgattcatgctggaacagcttttaacccataatggatggcctgagctacccctgaatccttgtagatgggtggtgtaatctgtcatctgatgacaattctggaaagcactgttaagcagaaaacagaaaattgtgtgtctatagacctgccaaagtttgaggattcaggctgtgtcccagaaacgtgtgtcaacttaatatttgggggccaaggtgggggttctcttgcacattaaggattcaccagcatgatcacaaatggaacaatctcttcccacacttaagaccttccacctgtagatgtagcaactcaactgagacattcaggttttaatcccttgactgatgtaagattgaaagattgggattttggtttagggtttgtggagtgatatctgttggattccctcccaccctcctgtttcttctcagaaacttctaacccaattggcttttcttggaaagtagaaattgaatttcactggagaaacacaaccaaggaaaaatgtttccattctcactattcatgagaaggaagcatggttattctctctagtttgtggttttggtccctatggaaaggaactagtgttcacagaaaatgttaactaagggagtaagttagaaagcacagccaaaataaggtggatcagagtcgggaatgaatgtgcaagtacttgtaagctctcagtgagcactgtcatttatgcttaagttcctattttctattacatttctcttcccagagttgcttttataatgttttaatagtagaaacccaaaatccaaaattttactggtaatgaaagagtatgcctctttctattcaatctgtcacctaatttctacttatacctgtctctactgaagcagcttaaagggataatttttctaacctagattgtttgaaaaacttctttagttcttggtctgtagctcattattagtagacctcaggtaggttgagtgattgtgaaaaaaatgatctctccacatcctgtgctgaaaatatttctctctttgcagttcatcttagtcattctcagaacttatttaaagtgagcatcattttaaaaggaggcttctgaactacagagatgttcaaactctaaacagaaaacctgggactatgttttcttaaatatttaggcttctaaaatagaatttttgaattttgggattggaggctaatctcaaaaattatgtagtataacatttggctttatacttcaatccctgtacagcaccccagactttgattgaatatcttccttgaggaggttccactaccctaaagcagcaagttccaccttaggacaatatgattactagaaagatatttcttaagttggctaaaatctgtctcacttaaccttaaccctttaaatctttatatttttatttgggcatccccaattagaggaatgggcttcctactcatcatttattgagcttcctatttgctagtatttgagtctttttcacatgtcacattgttacctatttctcatctagtccttacagggttgattttatggaccaaaactgaatactactctcactggtcggtgtttttctttcagacatattattaagaacacagatttttttcattacataatgacctatctaaacctataactgacctcctgagtcagttatctagcttaactgaattaatcattatgtccttaataagccaaagataaaaatattaaataggaagcccaagttaaggtaaattatagggtacacactcatgtaagaagaggatctgcccccagtgcagtgcagcaaggatattcttttaccgtcattgagtgtatttgccttgctgtcttatatgtgtattctgagcatgcttccacagtgtcttgctttagagagtttcagacagtatcaatttaatgaataattttaaagtattcaaaatgtggaatatttgatgaaatcatctttgtatagactataataacggtcatttaaaagttatagaatttcattaggaagcaaattagatgcggatagcaaaactattcatccttttttacttgtcctattctcacttttctacttcttaagagaaagagagaaatgac

SEQ ID NO: 94890 - DNA, 1055 bp, Homo sapiens
catgaatctgccattgtaattttatagagaatagtttccttgtcctaaaaaatcatctgttttgcacctattcatccctccctttcttctgtcccctagcaagctctgatcctttactgtctccataattttcccttatctagaatgtcatatagttggaatcatacaatatgtagcttttttgattggcttctgtcatttagtaatatgcattttaggttcttttgtgttttttcatagcttgatagcccatttctttttagtactaaataatattcccttgtctggaaataacaccatttatttatccattcacctactaaaggacatcttggttgcttccagatttgggaattataaatacagctgctctaaacatccattcccagattcctatgtggacataagttttcaactcatttgagtaataccaagcaatgcagttactgggctgatgataagagtatgtctaggagaaataggaagtaccaggaatcagttttcccacctaggcaataattacactggcagaatttgtctgatataactgttttggaactgcagagtctataaaaagcttgcaacttccaggggaaggcttggacattaaagtgtggttaacttttatcaattttatttcttagtacactaatagctacccatcctcaaccccagtcccatggcaggcaattgtgcgtgtgttcccaaagcagcttacccacagcttatgggagccagagtgggcaaaaatgaccttgtcctccaaatattgggtaattgtcttctgattgttgaatgctgcttctaatcacagaggttcagatggagatgggcgaccattcttttttgttttcccaggattgttgtttgctcctgctcctctggctaaaatgatgtcaggagatttaaagggcttgtgcttttttttccccctacttctcttcatttttttttctttttccccatttgggagccaaacattaaagactaggacattcaaaagcaactgcataattggagaaaattagaaactaaccgtagaggtccagagaaag

SEQ ID NO: 94891 - DNA, 1051 bp, Homo sapiens
tttataaagaaaagaggtttatttggctcatggttctgcaagctgtacaagaagcatggtgccagcatctcattttggtgagggcctcagtaagcttctactcatggtagatagagaagggggagccagcatgtcacatggcaagagaaccagcaagagaagtgggggaggagccacagtcttttaaacaaccagctctcacatgaactcattactgtggggagggcaccaagccatttataagggctctgctcccatgacccaaacacctcccactaggcctcaccttcagcattgagaatcatgtttcaacgtgagatttggaggggacaaataaacaaacagaaatatacaaataagtatacatatcaggagggaagtctcaatcctcttttccctatcattacctgctaactaattccaaacattctactttctcttttgtttggcaactcattccctaataataatctgtcttaattagagtatgtttatttgcaactgtcttagtccgtttgtcctgctataacaaaatgcttgggactaggtaatttataaataatagaaatttatttcctatagttctggaggctggaagtttaagatcaaggcattgtcgggtttagtgtctggtgagggcctgaaaactgcttccaagatggcaacttattgctgcatcctctggagggttcaaatgctgtgatctcacaaggtagaaggggtagaagggcaaaaagggcctagctagtttcctccattccttttataagattaccaatcccattcatgatggctgagcccttatgccctaatcacctcctaaaaactttacctcttaatcctgttgcactgaagattaaatttcaccatgaattttagagtggacactaacattcaaacaatacagcaaggagcaaaaatctattcaaaccagttcaagaataaagaagggcttattttaaatatacgcatttcatagagtctaagaaaaaggtaaacagcagattagttaggacaaggatcttgtctgccccacccagtcctatctcct

SEQ ID NO: 94892 - DNA, 1052 bp, Homo sapiens
atgaaggccagaggacaacagaatgaaatgtataaaattccaaaagagaacaaaactgccaatgcacacttcagtactcagcaaaaatatatttcaaaaaatgttgaggtagccactaccggccacagtatagtagctagtaccagacttgatctcaaccataaacatctagaatactgtacaaaataaatgaaacaactgtttttaaataccatacagcagggagtgcaggaaagtgatccatgagagaagaccaacaaatgaagtgtaaacccagcaatctcctagaagtactttgtaacactgcagtgcaagaaagggtgaacccaggcaaagcatagcaatactggtaagaagacaacgactggagtttggggacgaaataactgaaatttgctaggaagcagtttggaaatgaaaaagagttttgggaagaataaccttgcattgagattcttttgaggctttggctgaatactaagctattaatgtatagggcgaaaagtccatgaggtcagacaaacaatcaaacaaacaaaccatcaaattgtgagggcacagaagctaagcacaattgccagaactcagatgaagagatgggggtggggatgttcaaattacaacctgtaagaaggtgaaggccccactgaactgaagcatacagcagagacagcaatgagaggctagtcatgggtctaaagcagcattagtcctggacctaatagtatagttttgggcctctacataaaagataattctgatctctgcataaaagtgcataccagtaaactttaaaatttcacactgatccgggagtaacttaattgtttgcaataacaaagcccaaccctccttaaggaaatttaacaaagtactgatattcaacagtaacattcacaatatccagtattcaataaaaaatttgctagatatgccaagaaacaggaaaatgtgatccataacatggaagaaaatcagtccatataaacatccaaacatgacagaagtgacagaattagaaggcaaatgctttaaaaatgcttatatgctca

SEQ ID NO: 94893 - DNA, 1050 bp, Homo sapiens
gatataaattatttaagagtatcctctcaaactgagtgaaatatttacatttcatgttctcttctctacaacgtgattaactcagtggatttctaggtgtatgaaagttgattgttagtctagttcatattaaaattttatgttaaattttactataatcagttttcaagaaatgtggaatatttaattctatctgggacacccatataaaatttccttttaaatttcccttaacctatggacaatacttctcaacatgatgggaatattttataataaggtatctattattcattgagccccaattatgtgccatacactgtacagggctgtatattatattatctcatttgttgcaaacagtctctattaggttggtgacgttatctgcatttcactactgaggaagatcagtctaaccaagattaaataactgtcccaaaggtcacataactaaaagtgtgaagatttgaccctaagttaatatgaacccaaatctttgctatttctctccatatcacttcctttttagtcctatcttgtttttactaccatttcccataatatggatgtgttggttcatgcaccattctcccatattgaggttaattaaagagcttattaagttcttgtaaagcatatcttaaatgatttccctcagagaagcctaaggttttaaatattctgaaatgaagcatttgttattggcagaaaataatgaccaaagcacctacaggatactttagctcaaaaaagcaaaaaagaaactagggctaatgaggtgtttgggaggagaaatgctcttatttagggtattgaccagttagggactgagtaataagttgtatgtggaagttaaaagagactggctggcagacagtcaggcgtctaccattgtattttgtaaactttctcctatggctgtggtgtgttttttccaagcccacttaattttttatgaggtttgtaaaggtcttgaataaacaattgagattatagaggttttcctggaagctttagttaatattttaatactcttgctttgtcaca

SEQ ID NO: 94894 - DNA, 1028 bp, Homo sapiens
aaaatccaatatgtagctgttatgtaattctggccttatgtcctcctgagatctcagcaaaatcagcctaagagctcctctggcttgtttcctgttcctttctagcaccaagagatttccttttttttgaagctcagatgtgttactaaaagtattattatatttaattgatagtgtctatttttgtttgtttatttgttttttgaggcagggtctcactctgtcacccaggctggagtgcagtggcacaatcacagctcactgcagccttgacctcttcgagctcaagagaccctcccacacctccacctcctaagtatctgggaccacaggcgtgcaccaccatacccagctaatttttgtatttttagtagagacagggtttcactatgttgctcaggctggtcttgaactcttgagctcaggctatccaccggccttggcctcccaaagtactggggctataggaatgagtcactgtgcctcacctgtaatttctatgttttatctcagctcagtcggccatgtaccagagctaaaattccttgactactagaattctctcccaatggttatttttttttcttagtagtgttacctatatgtgtataaagtaggtataaatgttatacatatagttcttatatatctataaatcaaaaacaaatttataacttaaatataaatatttacaaccaatataagtaaaattaaaattagcttcataagatcagtgttgttttaccaaagctaaattgctgtactcaacatgaatatagtaatatcttttaacatgtggtgtgtgatttttcagtatttctaccatattcatctatttaaccattgtaagactgttttcatactgtttggtaagctgatttgactttcacctgataaaattgcataaaggcctgtgtatagccttttgcttgtggcagcaatgttgcttacttgatactaacctaagtgttaacacagacacaaattgagatactgaaatcacatagtagttttcagttataactaca

SEQ ID NO: 94895 - DNA, 1160 bp, Homo sapiens
attacattaggaggtgaggccttgggaggtgatagattatgatggtagagcctcgcaaatgggattagtatacttataaaagagacttcagagagctgccttgttccttgtggccatgtgaggatacggggatacaggaagaagactccttttttatttcgcactaggaaataggccttcatcagacaccgaatctgctgataccttgatgttggacttccaagcctccagaactgtgagaattcttttgtttataagctaccagtctatgggattttgttacattattctgaatggactaagatagctcctgtcatttttaggcattcttctactagtgagtctttttctctgaaacactgtgaaactgtgagaaatctccttgcttttcaaagattttggcttaaacccttattttcctcagccgtttagctttagaattcagtaaatatcttgagggtaaaactagtcctcaaacctctaactgtggcactctagtctgttggaagcagcaaagattccaagtttttttcgccccctagtagttagtctctgcctggttttaagattctcagtctgttgcccttgtctacgttcctcaaatgcccacaaggaaagctgcagattttcacctcacctttaaaaggttttgtcctctctgcagttttattccctttagtcttcattgcttcacagcacctgatgccttttaatatgttttttctacatgttttacttcctctcctagttgttcctagtgggagcatttatctgcagaaaattatgtcattttgtctagctttatcctgataccaaagccagacaaaaagagcacacacaaaaaaactatgagttaatctcacaattatggataaaagtaaaataaataaaattttagcaagtcaattcccagtgttttaagaaagtaattttgtactagtgtgtaggatttattccagaaatgcaaggatggtttgatattttaaaaaaatatgttaatataatttatcatattactaggtgagggagatacagtttcttgatgtattctagaaagacattttattacatccaggctacattcttgatttaaaaacaaagtttactaaattccaagcagtataatattttaataacaaaataaagaacatctatttgaa

SEQ ID NO: 94896 - DNA, 1224 bp, Homo sapiens
ataagattttcctcactctcttacaaaagagaatgaaagtgtttattaatttactccataataaatattgcttgtgtatctactgtgtaatcatctggtagattcttggggagagacagaaaaagtactttgtccctggacttaaagtttatgatttacagagaagacacccactatactggaataatacattagatgtattcaatctctcatttattgaacaagttttaatacagtgtctactacaaattaggaaaagtttcaggcatgaacaaaaaagtgagtctcctcactttacagagcttatattttaatgaattagtggatgataaacaaacaaaaaaatctaatgtaatggcaagtagtgataagaactagggaaaaaaaaataaatgaccaaaaagaagtgagaaattaaatcatttggatttctgatggatatgcattcctgtcaaaggggacagcacagtggtaggtatggatgtgttcaagaaatagtaagggggtcagtctggcaatgatgtatctatcactaatggtatggacgataagagatgaagtattcaggagttaaattatttctggccttgtaggccatcataaatactgtacattgtattctgaaatgagatgtgatgtcattagaagattgagttgtggggggtaatgatctgagttatcatttaatgtgatactggtttttatgtggaaataaatatattgtaatttaataaaaggggaagaagaaagtctaattgggaggtagttgcaatactccaggcaagagatagtggtcacttggactagagtggtagaggtagaagtggtaagaaatatttttgaaggtacagatagcaggtcttagtactagattgggtgtgtgtattaagagaaagacaggagtcaaagatagttccaaaacttttgaacagaacactggatgaatactgtttactgagatggggaacacttagagaaaaatgcatttggaaagcagaaatacgatcaagacttccatttttgatacattaagcttggtatgtttaattcatagctatatagaggtattaaattggcaggacaaaatcatagctagagataaaaatttagagttcaccagtgtaaagatgatatttgatggcacaggatggactttcttctgggatttgagtatacatagaggaaagatgtgaggattgagcaccaggggacttcaacattgac

SEQ ID NO: 94897 - DNA, 1086 bp, Homo sapiens
gggtccagttgattgcaggcccagaatcttatattttagtctaatgtacacaatcatgcagcacttcagagctgccatattatgcttatgctaaaaggcactggcagagttatttagatgagtccataattggaaggtacaggacgtagtattagtttcatttaggctgtgtgatctaaagaaaatcacttcattttcatttctgttataataaaatggaagttataattatgtccctttaactacttttccaagtttttgggaaaacagtgtaggaaaatgaatcatgaaggtctttagaatccttaattctatacagacaataatagttattcttctttatcttcctcttctagtaatttatagaagacaactttttttttaaccagtactgtctttttaatgatctgttctatgtaagaaaagggaaatagtgttgacaacagaatatttaatcctcacaataactctgtgaagtagacattattattgacattttacagataaagaaatagggttataaaagataagaaaatttcacaagatcagtaagtaataataataaagtaagtcattaattccctggttactttcactttgatgcccatgttctttcttccacaaactgatgtagtttattaacatattgtaatctctcctaacatctctgttcatcatgcctaattttgaaacgtcttgttgccattttaatgattcctgttcttttggtgatcatttatttgtttagttcatttggcaatgttttagttggaaggcatcatgctaaaccgtagcaatttctgttcttagtctaatcttttttaaacagaagaaaacatacctttagaatacagtgataagtgttcccataatatgggggaatacaaaatgttttggaatgctaggacgtattagtccattttcatactgctataaagaactgcccgaggctgggtaatttataaaggaaagaggtttaatttactcacagttcagcatggcttgggaggcctcaggaaacttataatcatggtggaaggcaaaggggaagcaaagaacttcttcacagggcagcaagaaggagaa

SEQ ID NO: 94898 - DNA, 1101 bp, Homo sapiens
atcaaacaagaaattcaagattttgagaaccctaattcagataaataatagcaacaacaagaaacaaacaaaaatatttaaagacatcatattcaaactggtgaaaatgaaaggtaaagagaatgtttagaaggcattcccaaaaataaaaattacatgatagtataatgataagaattataatagacttcttttctgaaactatgcaagccagagaaaatggagtgacatccttaaagtactcaaagaaataaagaaaaaaaaacagccagaattctatagacagaaaaacaattttcaaaaatgaaggcaaactatttttttttcagccaacaaaagctaggagagtttattatagtactttttctgacttacaataagtattatttgctgctgctattattattttattattattaccacgaataccactggcaccgtttgtttgccgaaataattctgctacctgctatgactgactcttaatgcttctttttcagctcaactgaagttgatgacatgattcggaaatcaacaaacctgttgctaaccaggactctgagcaactctctgcagaatgtaattaaaaggaagaatattgggcttactgaggtaaacctgctcctaatgaaggcagccgagccagtatgtgaacagatgtcctaagctctgggccttatgtctgaattcgttaaaactttctacatgctcttcctgataggcttctaatggtgaaagtgcaaaatgaaatctcttgttcttttctttggtcacctttgaaaaatttatttatttttttctaaaaaagtcgtttttctctttgttttcactagcttaactggttttcctttctgaagttgttagaatacatttctgttacctggcattgattatacacaaatatttttgtttgtagaatatattgagcatcaggttccaatcaagtgaatggcagttcatgtacaacgtagaatatgaaatcacattttgcttgcatcagttattgatacctaggataatgcaatcatagttcttggttagtgtcagactcagcctttatttttaagatatctcatatgtatgaaaggtaaattactcttt

SEQ ID NO: 94899 - DNA, 1037 bp, Homo sapiens
aatataatagggactgggaaatgttcattttgggttgtggcatatatattaagattggagttcatcagaaaaatatttgtgattaacccaccttccctctgttcccctcccctacccccccactttgtctatccttcccttccctttgtctatccttccatttatagaaacatacttgattctgacaactacagtcctataccagtaacaagtgaagagatgtacaaaaaggtggtaggacaattcccatttcaagatatagaactggaaaaggtaaggaatactttaaaataaatttctctggttgttttggcatcctcttaaaagctttcattggatcagtttgattgaaagcattacctttaactcaatgggttagaactctaaaacaatttcaaaggattcttttttctttttctttttttcactttaatcacctttctgacgatgaaggattctttttggggaagaccagaatttcctgatttgggaatcagcagatggctttggatcctattacctctgaagtgtttggaggattgctgcggatgttctaattcagtttacactttgaaatacttgtttttattaaaatttaaagacattttttccccacaacataaaatttacactttgtggtgtacaattctgctgattttgacaatgtattgagttatgtatccattaccacaatgttgataccaaatagctctattataaaaaaaaaattatttaatgatgcccctttgtaatacccctcccttaacccagccccaggacagcagaaacctgggctctgtgcatctacttttgcctttttcagaatgccatataaatggaattgtgtagtatataacttcttgagacttacttctttgatataacataatgcttttgagattcgtccaaattgttgcatgtatcattgttcattcatttttattgctgagtatgtaacacaatttgtttatctctttccatgatgaaggacatttgaattattgttttatttaaatttatgtctttttaatatcaga

SEQ ID NO: 94900 - DNA, 1502 bp, Homo sapiens
ttagagccctttctctaagggcctttattactatctctctgctaatgattatgattctcttaagctatagacgcaaatatgtcagttcccaaacacttggcacttggaagtcatcaattaaatatgcccagtacagaagtcatcattattaatcttcccaaatatagtcaattctcattattcgtgatagttatgttctataaagtcactggaaacactgagtgagcgaatactgagccattgcttttaggagaaatacaggtttagtttcctgtgagcttctggtcacattttcatcaaccaatgaatgcataaccttgatttatgagtgtttctgcttaaggacatgttatttaatatatcttgttgattcattaacattgaactcatagcgaacagcactatactcatgcctgagaggagttttatctaccatgttggttttcactgtaaggcacatcacagttttcttgtgccttctttcaaaggcacatattgtttcttgagcttaggaacactagacagcacgttggtactatggttgggggccattttaaacagcaaaatcatcaacaaaaagtgcaaaaatgtaaaaaatgtggcactggatagactatgaaaatgacacccgtttacaatatgaaaactaaaataagaaggcagagcattgccttgtttaaaccttagctaggaacatgtgcattaggcaactcaaatttttcacccctctgcacatgtctgttgaatgactatgaaagaactatgagtattgcttttgggtttacaaataaattttagcaagtaggcaaattcacaaatacagaatctgtgaataatgatgtactgtttattccatctacttatgttccctctctcacagatgaaaccactgtcaaaccagttacccaggttagaaactttgtatcagccttctttccttcctattctttatcacccatatccaattaatttccagcttaaacctcctaaatacgtctcagattctgactgatcttttcaattttaatttttccctttctttactctctgcagtacaacttccaaaatatctaaaactcttatggtcgctacagtacaaataccttaacataatttatgaagctttcctgcctcatctcttgtcagccctgtactttacacctcaagttccagccatggagaacttctttcagattcttaggatatgtgatgcctttttttccattcagcctctttgtctcctccaggaacacttttttccctttctctctttctggcttattcttctgactcattcgtcaattagaagtataaacatcatttttcgaagaagctttcgttgacacttcccccacccaccacacacacacacacacacacacacacacacacacaccctactttaatccataggattctgtagttcattttaatataattgcttgtttgtcagtcttccatagtctataaattcagtaagtacaggtactgttctcagtgtg

SEQ ID NO: 94901 - DNA, 1047 bp, Homo sapiens
cttttactctacagaagactctgctgagggtaaaagatacagtggagtgggagaaaatatttgcaaatcatatatccaggaaatgagtccttatgtatctagaatatataaatactttgaagaactcatcagtaaaacaaataaacaaaaaacaaaagaaacaatgcaagtaggaaaatgagcaaaagacatgaagaaacaattcaccgaggcagatatactgatagcatataagcacatgagaagatactcaacatccttagttgttagaggaattaaaattaaagtcactacactgctataagaatagtgacatcaaatgctcgtgaggttgctggtaagaatataaaatagtataatgtaaaatggcatagtcactctggaaaacaatttggcaatttcttgaaaaattaagcaacaacttccatatgaccttgcagttgcactcctaggcatttgtcccagagaaataaaaataaatgatatgaaaataagtagatttcaggcagtaaactacacaggagtgtttataatagcttcatttataatagccccaaactggaaaacaacctagatgttctttaacaggtgaattgttaaatacctgtggtacattgatataatagaatactacacagcaatataaaggaaagaactattgatatatgtaacaaactggatgaatctctagagatttatgctgagtgaaataagctaatcaaaagaggttacatactcctttccgtactcctaaaaacttaactgtatgttttaaaataacttaaaaagtgtaactggattttttgcaactcaatgaataaatgcttgaaaggatggataccccattaatttcatttttgtaacattcttaaaatgacaaaattatatgttacatagaaatgaatatggaaatgatatagaaattgagaagaggttagtggttcttagcagtgaattaggaagtagagatggagagcagtcgatatggctataaaaagacaacttgaggatccttgtagtctggaaatgtgcgtcttgattttatca

SEQ ID NO: 94902 - DNA, 1034 bp, Homo sapiens
tatttattaagataaatacttttttgtctgatacgtatgttttgaaattcatgcatgttgttgcatttatcagtattttcccttttgatcctggggtgatatttcattttataaatattgaagaacattgggctgtttccgctttggagcttatagcaaatcaagctgctatggcattcttttttatttttatttttattttttttgagaaggagtctcgctcttgtcacccaggctggagtgcaatggcacaatcttggctcactgcaacctccacctcctgggttcaagcgattctcctgcctcagccctcccgagtagctgggattacaggagtctgccaccacacctggctaatttttgtatttttagtagagacagggtttcaccatgttggccaggcttgtcttgaactcctgacctcgtgatctaaccaccttggcctcccaaagtgctgggattacaggtgtgagtcaccgtgcctggcctgctatggcattcttacacaagtcttttaaatggacctagatactcttctgtcttgggaaattacctactcgctatcattttgttgaggatttctagatttccactgaagtcagataaaataccctgcatattttaacactttgaaacttaaggagattttcttaatggtctagcatacagtataatttggtaaatgttcagtatgcgcttgaaaagaatgtatattttacagttgttaagagtgttctataaatgacattttgatttgccggtactttctgatttggtgctgacagtatgtagagaaaatatttcagacaattgtattataaatggaggaggatagagatgtaaagggaagtaaggtttctactcttccctggaactggtaaaatggaaacaccagtatcctatggtaaattatgtctatataatgtaatatctacattaaccacaaacaaatgtataaatagatacacttgaaaacactacaaataaataaaaatggaattctaaaaaatggttatttagggaacccataggaa

SEQ ID NO: 94903 - DNA, 1049 bp, Homo sapiens
ttcacttgatggtttagggaattgaggttcagtgagattaatttatctgctcagtggatcacagagatagtgactggcaaaacttggatcaaagcctgttcttatgagtcatattcgaaacctccttttactttatagtatcattgatgtttctgttacaggggcaaatactgtgcagttaagacaaagactttttctaaaatgatacattctgaaggtactattaaaaaataaatacattggcattatttttcattaattttggtatttgaagtgtgaggagaaagagctgtttatacaatatttaatgaaataatgttcttggtagtttctggaaaaactacactaaaaattatagtcatgccctaccttctaatattggcaagaacttggaaatcagatacaaggacctggagaaagacagtcatataaaccacattggttttggcttagaaaaatgactgggtagtgagagatgatgggcaaatatgtttaacagtttgcttcaaagattgggagtgttgccttatgagaaactctaataatgtgttagtgtcatcatacaaggtctctttgggcctgtcagaattctgcaactgtgatgtaaaatttcagccttgctgagacagttctctaaagttcatcctaaggatttatttttaatgagaaattatcctgtgctctctgctcttcaatgtagacctgacttgcttgggaaaatcaggaggggaggggcaggtgctaatactgctgttttgaaaggatcactgccagatttaagttaggcacagccaagctcattctggactagtcttagagtagatcatccttcactgaattgccaaatagccctcataatgccaggttattgtgcagtttgttccaggatcaggctgcatttgggtcctcccattcagaaaagagcaaaaatttcccctctttccaggcattgctttagtaccctcttaagggagaccttcagatatttgactatttcaaaataacttttgttgaaatttaggaataattttagggaaagttattatagg

SEQ ID NO: 94904 - DNA, 1046 bp, Homo sapiens
ggttgtaactgccagatttgtttgttcatttttaaattttcaaaatttcagaggtttttgtggcttgctcaagatgccctttattacctggtttaatatttgtcccaatagttttgaatgtcatgatggggatacataaataactacagccagagcctcatgatctaaacagtgaaagatcatataagggagaaaaggagtttctttttcttttatagatgattttggtcattcagcagcatataccaaaatgatcttcttaccagaaacaaataccatagctggagctcatatttatttacagttggttatagcaggtgtaatgaaggatttgctttttaaccaatgaatagaattgatttattttaaattgtgaaagtttgaaaaagctgagtttggaactgtaatagattctttactttttcagattcttataactcaaaccaacaatctagaggtgaaatgctagaaactccagaggtgaaactgaaaccagcaatctggaggtgaaatagtttaggggcttaatactggactagaagctcagtctcttcgcctgtccctattcaagactttctcagggaatgtaagcaagatccatctcattttttttttacttcagaatctttaactagagtttctgaaaatctagaattctgggttattctcaccacatagaaggagctgaataaataattgtgaaatgaatgaatgaatgcagtacttcagaaaagtactatgtgaaaaattaagagacctgtaaaaggctatgaagtatgctaagaagatgtagttattttgactgaggttagtatagtttgttgttctattaaatggagtgttaataactaaggttagagatttctcattgccctgaaattataagaaatgttgatatactttttacagtgtgaaaatgaggtcagctgggtgtggtggctcacacctgtaatctcagcactttaggaggccaaggcaggcagactgcttgagcccaggaatttgagaccagcctgggcaacatgacgaaacactgtaaataatag

SEQ ID NO: 94905 - DNA, 1058 bp, Homo sapiens
tgtgtctgatgaagacaaactattctgtcttgtagatatttatgaactttattgattcagtcggccctaatcctcaaacccagctcaatttggacaaagatctgcatgtactttaagctcctttatacaatgaaacatctttctgaatctgctttcagttcactcctcacccttctatcactggaagggtgtatgtacatcccataacaagtagcttaggtgtcattaggagagactagaggggcaaacctataaatgtatccataagcttagtttgtgagtcttgtatgtgatcttcttgtggtttcttgatctcagctatgtacatcatcttctcatgagcagtttaaattcctagatttaaaaaatgttgacaaaatgttcacctttgattaatgttcttttctgcgtatgtgttatactataataaaaagtttaaagatttctgacatcttgggtccagcgatagcaattaaaatacatggacatttttagcaatcccccagtattatatgaatcataagaacttcatttttattgaattctgctccattcactacaggagactataaaataccctaagatataagggaattgagaatatcattgtgcagtgaattcattattacaaaggctctatcaagtacagtatttctcttaaattttcttaatcaaggggcctctgagattttacaaaagctctgaatgctttcaccaggcaaaatgcacatatgtgcatgcatgtgacatttggcttaaaatttcagaggcttcgccaattccctgaatctcatccatagacccagaaagaatccctcctctaaagggaagtacagagttaggtttcaggtatctattgactacagacctttgccccagaatggctttccccaattccatttgagtatctccttgtataagcctcataagaactctctaccaccttgtctttttcttaaatttggaagccttgccaaaatctaaatctaaaagcatatttcaaagtgaccttatttctgtgtcataaatctttattccctgagcagccattatgcatg

SEQ ID NO: 94906 - DNA, 1056 bp, Homo sapiens
cccatccttgtgggctttgtgccagccttggtgtatatcttcacggtttattaattctatggctaaaacataagaactaggtctttggaaacctatttttttgtttgttttgtatttctcacttacaagctagaactggcctttataaaaagaaccaaacacttgagtagtaacaattaatgtagttgcttttaatagctttgtttgaatttttttgttataatcttgtgtttgcaggtacctggggcccaagatttggtggatttctctccagtttatcgatgtctacatatatattctgtcctggtgagtctttatctggctctgcctaataaagatgtccattgagttcaaaactttgctctctcaacttttggtagtttttctgtttattattaagagtgaaaaatgagaaaactcttgttgtttaaggactgttaattataaaaaacaattttgaatctcatgtttttatgtaatatgctatggctagtgacatttcttagtcatcaataaatcagtagcttatgactagaaatagtcatacatccagatttctgtttttagtttaataatgtagttatttaaataacaatattctgtctttacacattaaaatagtatttgtgaaaatgtttacttttttattcctaatgacaattactccttttgtcatataaagcatatggaaaagggaacctctctgtgtgggggatattatagatgttaataatattctaagaaatgatccctttctccattttggtagtacactcacatgcagacacatagatacacagaaagtaagtcaaaaattaaactctagcaaccaagacaaattggtgagagaagcctattatcgattttttttacagaaactttcagtgatgcttatatcaggttgtttttaatatgttcaagtatgtcttattgcccagtctcttatcaatttttatttgtgtatatatatatcttttttttttctttttgagacagagttttgctcttgttgcctaggctggagtgcaatggcatgatcttggctcaccacaacct

SEQ ID NO: 94907 - DNA, 1078 bp, Homo sapiens
tgtcagatttatctctctagattttggtgtctcttttgaagtatagaatcaacaggagggaattgttaatttaaatacaaatgccatgtaatagaaagccttctgggatgtcttgattattgttgtgctgtagtaattttgaagtaatgagatgtattaatttgctagggctaccataacaaaatgctggagaatgggtgatttaaacaaaaatctgttttctcacatttctggaggctggctgtccaagatcaaggttccaccagggttagtttctcctaaggcctctctccttggcttgcagatagttgccttctagccgtatcctcatacagtttttttctttgcttacatcctctttttataatgtgtgtcttcctctttttataaggataccagtcctattgaattagaaccccattcttatgatttcatttaattttaattacctctttaaaggcccagtctccaaatacagtcacattgggactaaggacttcaacataggaatttgcgggggagcacaattatagtcataacacaatttagtcataacacagggtgtttggaaagtatacaaaaaagatttattttagaatgtacaagcttttttctttgtggtattgggacaaattatgtaatttctctcagcatcccttttcttacctatgaaatagtgacaataattatgtcaaattgcttgtaaaaaaatagtggttgtgatatttgacccaaatttcaaaatattgattgtaaaactttctattgacagtaaggtaacagaaaatgaagatgattccttgataagttaaaggctactttagaagtttagagtttaaacttaaacttaaataaaggctgcctttagaagtttagagtttaaaccagaggttgcagattggcaaccgatgggccagaaacagcttgcatactggttgttggcctacacaatgcttaaaaatttttaaattagttgccaacttctgcaggtcaattagattcacataaaaatctagatttctaatttagttttttctaagcatggtagtaatagactggccttgagtagcagtgttgc

SEQ ID NO: 94908 - DNA, 1055 bp, Homo sapiens
agaaaactatttgtctatttatttgttttaaaatatcacatgaaacacacatgcatgtgttcacataaacacattcctacggacaataacatacaaataacttttttgagattatctgaagatggtctttttccttcattttaaatcacttttttgttttgttttcattttgtttgttcgaatctgatactggagtgggttgccaaagaaagatgtagtccagagccagtcctgataagtgtgaaaaaaccctggtttgaaactacagcttttttacagttaattttgtttggtgagacttgaagtggcatctttggattcttcctatcttgattttgacatttattttcatggttatcctttgggcttcagacactaaacaagggatcacaattccactttactgtattgttgatgggatgttattgtagctttggtttctcttagcctgcggagttgatatgtgactggtttattcaattgtatgatctcatggaacagaagtaagagttaggaggaatgaaaagagaaggtgggagagtcagtacaatggtataatgctagggcagtctggttgcttaatccatgggactctctgagaggacttttggaactgactatggaaggaacaaagcaaagaaacatttctgtcagctccttttcaagggttgttttacttccagattgtgctgcaggagtgctgagtacttcttgtggggttccacattctggtattagaaaagtcctagggcaggcagcaagaagtgtactgtaagtatccaagtatccaagtaacctgatgtcaggttatattatgtgatgcttccaggcctgttcagaactggttgctgatggtagctggaataagaggtgaaacagaggatttaagtggagcaccaatggtgtccattacagaaacataacacttgaaatgtatgtaaatgcaaaatttgttatacagtgatattagatgtcattaattattatgtatagaaatattgctgggtttcagatgtttccatagtagatagtgaaacaagattcctggccgggtg

SEQ ID NO: 94909 - DNA, 1988 bp, Homo sapiens
gcccacagcataagactgaatatatattaggtggctaacaaatatattaaaaaacaatataaaaacaaaaaaggggttttctcccatttaagtagattctggcatagtggggagggaaaacgctcttccttctcatacttggcagtgtttaatggtatgtagaaattatgccagttagataccaaaaagtgttaaaaggtcataattttgtctttgtcgttattatctacttgagaagacaaaactattacacatagaaactaacatgatggtatataaatagcaaataaacacaaacatcctaggcagttcctagtgaaggtgatcagaaaagggagcggctactgttgatggaatggtcaaggaaagctaaataagagaattcatagcatctcacagtttgaaaggactccaaaatcatcttgtctgataacccatttaaatctagagaagatacctctaaaaattagaacctaacatctttggatgaggctaaatcataaaatatttcttaatttagatttgagatctattatgccagctatttattattttcagatgaactccaaatacaattaggagttgctgaaatcttgttagacagtgttttttctcttcttgattaaatacagctagatgaatgctgaaagagcctttcacttctattgttgaatgtgagttcatctacaagaatgaattgaggattatctttatttcactttttcatattctttatgtgaaaaaataagttttgaaaattttttattatttttctgggtttggtgaggtttctgggagattgggaaaaacatagctttagattgcttgacttatgtatatagtcctgatgtggaaaaggaagggctgctgttaaattctgaatgagggtaaattcaaaaggaaggaatagattagtaggaacttcgaaggatagccagaacatataagtttagtctctttgaaaccatgtaaaagtaatagttttgtaaaaaaccacagtaaattcagttgaaaaccattgtttagtgtaaatgatgaccacatgtgaattggaggtgaggatattcctgaacataggtttgtaataatccgctgtggtggtcttgtagcactagaaggaaaataggaatatcctctgatatttatacaattcagtaaaagaccagcagtctcaagagaatacattacatttgggatcttggacaaaagtgtaggaatttggaggtaattggtatggcctggagcctttcttggcatatgctagcaaatttgggaggaaaaagttctctttccagatgtgttacttgtgagtttctcattatctgctggaatgaggacaataggggaaactagaaactgacgtttccttgtcctctttatggacaggaaagggggccaatccctctccagagtctggcaatcaattttgtgtgagagagaacagtaagcagtgaaagtagcagagctgttttgagggttctggacatgtgtttaactatgtaattataggcaaatatgaaaagactatttcagtttcatttagaatttgataaatgaataaatgttaaacagtactgaaagtcttttttaggtatatatatatatttttaggtatatatatacacatatacatatatattcatatatatatgtattttaaactctctaggctaggtgtggtggctcatgcctgtaatcccagcagtttgggaggctgatgtgggaggattacctgacgctaggagaccagcctgaacaatatagcgagattctgcctctgcaaacaaaaaacaaaacaaaacaacccaccccccccccaaaaaaaaacttctatatgttcttgcataaataaaggtttggaaagacaggttgctaggctgttatcattgattaggaggtagaagagtataaaatgctgtgtggactctataggcagacagtccatttcaaatctgaactttgttacttgaaatttatgtgaccttgta

SEQ ID NO: 94910 - DNA, 1063 bp, Homo sapiens
gcctggaggcattggaagtcttggcttcctacttggtttttggtggggtaatgatggggctgcagtattttagttgtacttagcgggaagaggaggaaaagtgcatctattctgtcttcttgaaatgaaagtctgttttttcattagcattttttacagctcttacaaaatgtaaaaaacatttttagcactaggattgtacaaatacaggctatagattggctttaagtcatgggctgtagtttctcaacatgaaagctgcctgtatcttactagtctcttcttgagtctttctcctacttgctcagtttgctgcaaccactgccttcttcttttcttctttctttttttaagctaccaatgttttgcctgtctttggaccttcacgcatgctctttttttttcccatctggatcgtttttattttcgttgtcctactctcctatttattttaaagattttaccttaaatatgtttccaaagggagctttcttgatcctcagcaatctaagtcagatccctgctctacttcataacactgttaacttttacttcatagtacatattgcaatatcttatgcaaaatttattagtgtgattacttgtttaaagtttatttttattctcagaaaactttaagttatttaatgggacagaccctgttttatttatcagcttatactgtcttagacacttcagcagtttgattaaggggaagtgaaccttatttgagtcagctccatggtactgttccaggtgttttacctgtatttacatatgtgcctatgtttgctaatttaatgtttagataaacctataaggcaaatattattctttctcttttacaggtgaacatgctgaagctctaggagctaaagtaatttattgaaggttggaaagttagaatggaccagagtccattttgttttaattacaccaggggttctctctgaggcatcaaaatcttgatggatatagggcatgggggaagtgatattaaaacagcagcagcagtagcaacaacaacaacaacagcatacattgtatgatcctgcctaatttc

SEQ ID NO: 94911 - DNA, 1062 bp, Homo sapiens
ctattgagaaataactaatgtcagaatctgagatgttaataatcaatatacagagagctatttttggtgtaacatgagcctagcaatgttgacttgaatgatcgatatgtatcctatataatcagcagaatgtaaggtttagctttctgtgcagctgcaggagacatatttaattaatactgaagcaattatcttgacaagtaaatcaaactcaattagatttcaattagaacactaacattttctcaaatactgcatggttgccagatggttacacatttttttggcctcctttctctttcaaaggttgacgttcctgctactgtgtttattaggtataattactcaggcttttttttttttcttatttgtggggaggagggtggaatttgaaatttaatacattatatgtcgtaattcttttacctggctctgtatggttttattttatagaaatttaggaaagtaaaaatattgactaatttgtaaaattaataaatttgaaactagagatcacagattatttagaaagagaattttagaaggcatttaattcttacccctaacagaggcaggccaaattattatactggatctgtgtatcattgtgtcatatatatatcttctctttcaatcgaatggatgtctaaatctttttaggctcagtaaaaaacgtaggtattccagccgaggtgggcggatcacaaggtcaggagatcgagaccaccctggataatgagaccaccctggataacacagtgaaaccccgtctctactaaaagtacaaaaaattagccaggcgtggtggcaggtgcctgtagtcccagctactcgggaggctgaggcaggagaatggcatgaacctgggaggcggagcttgcagtccagcctgggcgatagagggagactccatctcaaaaaacattccagtcacaaagtgttacttagtgctcactaaataagaaactattgtattaggatggtgtgaaagtaattgcagttttgctgttttaatggctgaaaactgcaattacttttgcaacaacctaataacatctttta

SEQ ID NO: 94912 - DNA, 1064 bp, Homo sapiens
ccaggcgttggatactggagtttctctatttttaggttcttattttgatttgttttgtgtttgactggagtgcatctttgaatacatgtactttttcaatacatttacattaaatggagtttatgtgaatggaattgttttggaaccaccgtaaatctgaagacttctttttctttttttccccttcttttacaggtaacaactttcttaaatatagaaatcttgtgccacatgtttttttctcttcagaatgtatcttcctccattgtcttcttgcatttatggtagaagtctgatgtctgcctgatttttctttttagtttgccctttaaaaaaatctataaatttaaagaattaaaaaaattcttgacagttttgaataagttagcatgcagttattaatagtatgtatgctttaatttttaaattgacctccatattccccatctattgaagtaagtaatcatagggagttttgcataaacttcttctagcattttaatagagtgattactaaaatctgtttacttgtttgaataattgattcagtaattctggacactgaatatgtgtctcacgtaagttggaaaaccatacttgttctcctaaggaagggtattagcagaagtatggttaatttgtgaaagacttgcacaggtaggatttagacttggttctatatgggctacaaattttcaaaagataaatatgtgtaaataatgagaatgagttaattatttattactatttatgcgtggtattacatgttttcaatcagtattcctgtctctttattggaaaatatttgacatagttcatgtagaataaagcccaagaaaacatgctcagtttttcgctttaattaacctataaaatcataaagcctactaacttcctgagagatttttgtggatggaacatttgtggcagtcttgatgtatgggtgataatagctgttgggcactgtatttttggactgaaaatttacaatagctctggcataaagttttatcatcaggaaaagaaagaaaagattcctcattctcttctctgtgctcagcatc

SEQ ID NO: 94913 - DNA, 2497 bp, Homo sapiens
tactttttcagagtctttaaatagctgctccaatacttctgtcatcattttataactatttagagaagtttcaatatacttacctcattttacctgaaattagactccattaaagaaagtttacaggaaatgagctaaatcacactctcttgtgtgtagaccaaataattacagaataaatgttctcttgatgttgccatagttataattgagaatattctctgataggataattaataatcaaatgcattggtggagacaaagttttgttaggagacattgaatgaggataatttttgtattctgcttctgagcaaaattctgatgacacaacaggtaattcttctttatctgtgccattagaaagtgttttatttctatactgttcttattaatttaggagaatagaaaagactaattttcctaaggctgagaaaggataatgctttcttaatactcttctacagatgtcactagaaatatgtacaataagtattttttgttcactccattcaagattgttaaattaccaatggctttatttttttttttccagctttttgatgaggtaaatcatggttttaaaacattaggatagtactccctatttagtagactgtattttaatagccagtcctttacactcactgtaaaaaaaaaaagaggattgatgtaaggagagagtaaggtggattagtacaacagacgatcataccagtttatgctgtgattccttattttagattttgtccatacttgtctccatgggatagaccttttgctgtttttggattgcttgacccttttgtaagctaaagattttaagagtctaacattacaaataccttaggttcattggcatatgcacaacaaatgtgaatcaaacataaaaatgattcttttaagaattgtatttattgatgtggtagtgaaatactatactgtttacaatacagagctaagtgggattttgggtatgctgagaagttgacagtttgtggttcctgaataaaatattgtctttgcaggataaaatagggaaagatgtgttcttgaaatgattatttataaattttttgaaatcttgttctggttccagcttaggagccattttccaacactgtggtcactgcaatagtgaaattttggatgcaaaaaaccccaatcaaaacaaacaacaacaacaaaaccctcatagaagcctgtctgcagttgtatagcaagatacagattccttatatagacttggggaaataaaatatagctgttaacacagttcttcaattttcttaagataaaataatgaggatttggaataaaaaattgtaggagttcagtgtaaagtgaatcatgagtagatggaaaggtttttgcctaacatagagcaagagattaggggtcttctttttttgaggtcagttgattcaaccaagagatcccatgagagttacttgcaagagatcccatgacagttatttgctagagatctcatgagagttatttgcttcttgtgtgactttatcttcttcagatgggagtataatatctcattttaggctgttttgtaaattaaaatgtagtcaaaagactgtattgttttcatattgtggatattccagtttattaattcattgtatgtttctacctacttccaaaaataatttgagatactgtctgggaaaagacagactataaatactggagttaaatgaacagtaatatggtaatgaaaatgatggtggataggaggtacgactaagcggaagaggaaataaataccaggaaactgatttaagaaatgtactatatttcgtgctttactctgaattttctgtaaaaagacatcatggtttgtataatttttatcattatctgataaaaacaagtgtgtctttttcatctggccattttaagagaatgcagaggatttttgtttatttgtttttatctaaaagtaactcctgattatggagtggggtccattataattatggtataaaataataaaactatatttgtgaaaaatgaaaatactaactctcaatagaagtatatacgcttactagaaagtgtttttgtagctctcttctctttctcagtttcttgtcaattagaatgataacattcaaatggccagttgtgtagggaaggcaagtggaagctctatgttgactctagtactatagtgtcagagtgattagttatatataatttatatttagagatgatcactgatagaggaattagttgatttgctcttccttggatccattataatatttgaaaaacttagacttcagccatgacactaagaacaattacaaattattttaacagaaagaaaaatgtttggtgcacttaacattaagaaaagtatttttggtccctgtaaattattgagctttttttggttgttacattgttaagttgattttatcctttttttttttttttttttttttttactagtttttagtttttttcccctagtttttat

SEQ ID NO: 94914 - DNA, 1136 bp, Homo sapiens
tatttataggccttgaaacacaaattggtaactgtgttacaaatgtttagcgagccacatttcatgacctgctttgcaagaaaaaattgaaagtgtgaacagctgttggtacattgcatttgcatttctgaaatttcaagtgaagataaaacattaacagctgtgatagattcctgcagttgacctagtgcctcaggatgtgcaatacattgatgttgtcaggctgtcagggtcctggtgagaactgtagagagagggagaatctgagagggaaaacatgtttgttattcttttaaatatttttttttaattaaatctagagagtcctactgcaatctagcaatcctctattgtcactaaaagagtctttgatttaggaattccagtggttgattgtccttagaccatgcatgtcttaaaaataatgaagtagttaacttcctcatggattgctcatctttttattttgtattttctgagttgtatgtcgttaagagacttcaattctgttctaaatgtgcttggattttctacatgtcttcatgttaggcactgttgagtactcttttatgaaatccaaagacttgaaggcagaattaaactttgttgatgaaattactttaagcaaacccacctttgatgatatttgtgaataaactgcattttttctctctcctaggagttaggaagtaaactgtcaaagaatgtagcactgtttgacttctaggcccactgaagctcaactcagagtgttttggacaggatccagatgaaacagaattaaaagtgtgaagagtagacttgaaggtgtttggtgtctgaagctgtagaggaaagagttggggagggggaggaaaggatcagtcttgactgttttgagcagatatttcttctaagtttgctgatacttattatacctttttcctttttttgtttttttttaaatataaaaataaagatagggtttcaccatgttgcccaggctggtcttgaactcctgggctcaagggatctgcctgccttggcctcctgaagtgctggattacagatgcgagccattgcacactgctgatacttactctttgctatcctacactcattcccccatctgtgtacaactacaggaaggaagttct

SEQ ID NO: 94915 - DNA, 1035 bp, Homo sapiens
cacacccgcttacatacaactctgataagtttatgccttcttaaaaccttcaatgttagctttaaggataaaattccaatttctttaatttaatatataaagtctatcatgatctagctgcaacatacccctttgctctcatctttcaacacacatccataaatatacccttcactcagacctcagagaattacttgtccaagccctaaaatagaatattctctttgcctggaatagaatttcacccttatttatctagccaactcatattcaccctcaaaatttatctcagtctgatgcaggtgccgctgtgagcacaccaaaactctatatgcatgcctccaatatggtatcatactataatcactagtctgttatgtttattaggttttaagtcttagatggcaagagtcttaaatgtcttttaaggctctgaatcccaacacaaaacctgatataataagggctttcaattactgttaagtgaatgaatctcttgacaaaaaagcaatagtttatagcagctcttagccacaccctgattagtcctaaaagtccagtatgtgtgtacacataggataatctattgggtaacagatgaaagcatttgtcaaatacagtggactatatacttgagccaactctatacttaagcaagtatataaaatattagctgtgtacgttttaatctttaaaaaaaaaaactagctctatgactcaagagttcagaaaaagtagatggcagtatagttggtaagaaaggggattcccctgaacacatattcatgaatttcctaatagacaatagccacaacaatagggtagtcttgatttattaaaaacaatataaatcactaaaaatgcttttgctgtcatttaaaatgacaactcttccactaaatcccttctctccactagccaagaaatagaaggaaggcctaattttagttcataaagttatttctaaccagaatctcttaaaaaaaaaaaaaaagaactaatacaatctctctctctctctctcagaaggcttta

SEQ ID NO: 94916 - DNA, 2110 bp, Homo sapiens
ttggtgccactgtcgtgagaagtcagtcaatggttgatgtattgtaagagctgctacttatatacaagttctgtcttgtaggctttgtcacatataaataaaccccttcaaaaaaatgttaagtgatttccataaaaaacatttattctgttctccttcttaagccaaattcttgttgtttatggcttcctgtacccaatagttcctgattgtctcaaaaagcaaaacatgtcctgcatggattaagctgctgaaatgccttttaggcattgtttatgagtctgcactctttattttcagagagaaagcgaatactttaatgtcttccatattccataaatctgtcccatgttacaattcaaggctgtgtgtgtttttgttagaaggtacttctggttgtacttagagtagaaaagctgcctaagaatgttagtgagtatttgggtggtagtggcagactcccctaaaggggatctagtactggttgaaagtactgttgttttttttggatcaaaaaaacagttaccataggtgctgttacagtcagtagaagtgtagtcactctgattgctttgcatcagtgactgtccttttcggctcatcctttgggaccaatcttccctctggacaaacttgctaatttaccacttttgacccccactgctaagtagcacacagaatacgcctgcctactgctctaagtagagggaaattgactttgcttgccacaaaatgagactatatctggagactgagcaaaaagtaatttgacttggagatcaaagtttactttttttttcttaacatttcattttgaaaaatttcaaacatacagaaaagttgggaaaattgtgtagtcaacaaccatatttacttaccacctagattctatcaatatgattaatctcttacaacttgctttattatatatccatctattatccatcaacccatcacatcttatttatgcattttaaagtgagtttgagacctaggtacacttcacctctaaacacttcaggatgcataatattagttagaggtcaatatttgattttttttcttttgaggtaaattttaaatacctcaaatctacgcaaatctgaagcgagtttttgacaaatgcttaacctaaacccctatcttgcctgcttaacctaaacccctatcttaatagttatagaacattaccatcatcccagacttctctcatttccctctccactcagtcctctccccttgcctccccatgggcaaccattgttctgattttttccactatagattagttttgcctattgtagaacttcatataaatggaatcatacagtatgtactcttttatataaagcttcttttactcagcatgataattttgagatgcctctatgttgttacatgtttcagtagttcatttcattaatgagctgtattctcttatatgaatttaacaattgattcattgtcctattgatggatacctgagatgtttcagtttggggctattatgaataaagctattatgaacatccttatacaaggtttttttgtggatatatgtttcatttctcttgggtaaatatacctagcagtggaattctggatcagaattttatgagatactgccaaacctttttgtaaagtagttctaccatattttgtttcctcaattgctgtacttccttgccagcattatttgttgtcagtcttttaaattttagttattctggtgggtgtgtagtgttatctcatggtggtcaacatttattttggtttagtctgggatatgaggaataagagatgaaagggatataagaataaattgcagtctggcacggtggctcatgcctttaatcccagcgctttgagaggccgaggcgggtagatcacttgaggtcaggcgttcaagaccagccaacatggtgaaaccccgtctgtactgaaaatacaaaaattagctgggtgtgctgatgggcgcctgtaatcccagctacttgggaggctgaggcaggagaattgcttgaacccgggaagcggaggttgcagtgagccaagattgcgccattgcactccagcctgggtgacagagcaatactctgtctcaaataaa

SEQ ID NO: 94917 - DNA, 1038 bp, Homo sapiens
tcatatccctttagttcttaccttcagtgcatgctgactgaaccttcagtttgctagcacctgcatctctttgccaaagggctttctctggaagccagaaatggggaattaataccacctcttctctcctcctgccccctgcccctgcccctgcccctgccccagtagtcctcagctcataactcatggaagctggtgtataaatacttcagcttccttgcccaccaggaaggaggatggtgtggaatacctctgaggcaggtattctatgccatttctgagttccccatgaaaataagttttagttgacctaacttgcttgataacatatcctttattgacttcttttcctgtctcacttcctcatgtctctacttatcctttctggggtcctctcctaagtaaatttcttggactcaaatccttgtttcagattctccttctgggggaacttaaaataagacagtagtcaagagcattgaaaagtctggaccctatttctgtacatgctcagcaattaatgtgggtttatagtggatccaagacataggatacttaatgtcaactcccatcgaagttattctcccattccctccctttaatactagggtgatctgggtggacagttaccttggtggggctgggagtgggtcctttgtcagtatcttttggtgattttttttggaggggctggtaaaattaccccaacaatgagcttctagaatttttcttgcatgccagcattttaagatgtctgtgtgtggtgggggagggaagattggggatatcagcatgcactatgtaagctctcatacttaatcccctgttttcagaatagtgtccttctcctcaattgtgatagctgtgccagtcaggagatgctttattttactgtacatagtatataaagaataaatctccaactttttgctgtggtgagagagggacagttgtttggcaagatgaagtgagaaaggtgatctcagggtctaacctcctcttaagcagactttcagcttaacccctttaagcttcatt

SEQ ID NO: 94918 - DNA, 1046 bp, Homo sapiens
agtgagccttagagcccttttcaatgcaaagatctaggctagccttcagaaatggttagtaaatgacacctaagataatttttttttattcttgttatgagagatgagttttacttgtggaagaggtacaatattcatatattttagaataggcattttaggaaagatcttaactctgtctatgtgggtgtctgtgtttgtgtttgggggtttgtatcctggagttagggagatcctgactttcatctctgctttagctatttgtttatttttggatacttatggagacacttcatctatgctttaataatttttctttttttgaaaaaagtatcaatgacaacttttctttggtttctctgttcaaaaaaaaaccttaaagaatactttcatatatttttaacttgtatttatgatgaagaaaacaagtgtttattcctaacatatgaggtttgttttaatcctcttgtctacgcagcccagttcacagttgcagtttcctgatgtacgtgaatttgctgatctgagttctttggcttttcatacgtggttgtcctattgtactgcaggagctttgtgcttttactaagtttactactagaaaagccttgctaaaattctagtgtactctcagctacttctcttatagctgtgtcttggtgactaaagagaattcttcttccatgtagccagagagattaacagatgtccgagctgaaccccaaagcatccagccgtctttcccgctttgaccctgtaacctctcccctggttggcagtgtgcctgtgttgacagttctcctggttcagccaaaggtgaaagataattgcttgtggagtagcggctgggatggtatgtgtttttgtagcaagcatccccacccccgtctccaggcaaagccttgaatctggtgcatatttcaaagcatgtgttaaactttatgtgatactgattaaaatggagggctccagggtgaattggcagagtcccacaactgcatctgccaaatgacatacagagaaaatgtcttgctacaaatggaagg

SEQ ID NO: 94919 - DNA, 1054 bp, Homo sapiens
gatcacatggacacaggaaggggaatatcacactctggggactgttgtggggtggtgggaggggggagggttagcatcgggagatatacctaatactagatgacgagttagtgggtgcagcgcaccagcatggcacatgtatacatatgtaactaacctgcacaatgtgcacatgtaccctaaaacttaaagtataattaaaaaaaaaaaaagaaatacaagtggcttgtcatgggagataattgccttctgtaccagtgagaggttaactggaagggaagtagaacattcgaaagcccttgtttttaaaaacagtttgcagtgctgatggttaagatatgttctggctatggcacaccaccatgaagaatgtggactttaaattacataggactcacttgcagaatactaggtgacaaagtagctctggggcaggtatttggaggagggaaacctgtaggtaagatagactccgggaagtagaattccttatgataatcatttattgacaatttcttgaggacatgaatctgaattgatttcatctttttgttcccacagaacctaggtgtactgccttgcttttcttttttgacatatgcatttagggacagagactctccatggatattttaagagttttaatattttcctgcctttcttaggtgtttactttgctgatgagacctatgactattatattcaactttgatatctctagatacaatttatctttgaaatcccaggtggaattttttctcttaggtacagcttttttttttttttttttgaagatggagtcttgctttgtcaccaggctggagtgcagtggtacgatctcggctcactgcatcctttgacttcctggttcaagtgattctcctgcctcagcctccagagtagctgggattacaggcacaacaaccatgcccagctaatttttgtatttttagtagagatggggtttcactatgttggccaggatggtcttgatctccttgacctcatgatccaccttcctcagcctcccaaaatgttgggattacaggcgtga

SEQ ID NO: 94920 - DNA, 1049 bp, Homo sapiens
gggggaacttggaacatatcttctgtggataagaggttggcgggctactgtagtgaattttaagttaagcagtcatatttttattttcaacaaatcttttaggttcttacattgcgtttgttgttgtcattttgtttttaacatagaagtagattgaagcatttagtggacatacatgtaggttctgccgtgtgaaatagagccatctttagagcagtagaaaacccctccattttatcctattccattttctgtgttgatcttcttcctgtgtgtttccaaaatgctgtgtatatcttattttggaacagtgactttagtttgaagtgatttaaaaaaaaaatcctcaaaaagttctgttaattgtcgactgttttctagttttccttttgaaatttatttctggatttcacttattatggaattgatttgtacaggagagaagatctgtatttcttattttgattagtttgctttaggctttgtgggactaaataacatttgtaatgtaatcattcttgtctaggctgatttctgtgtgagccttttaacaaggggaaggatttatttacttttacaattctaacttgcctttgccagattatatgggttatgtaactgatttaaggaaatgaactaattgcctataaaagatattgaaggctcctaggcattattccttgagtaaatggttttaaaagaactgacccttgggtaagattagttgtcatcatggtcctttcaaacctttgctttctgtggttaagtcttcactacagcaaaatttactctttaatgtatggtgtagaacatcttttgacttagatctggcacagtactattgactgagttcacatagaccatgtattcaccaccacgtaaaagtattgttgaagcctcttgtatgctagatattatgcaaaacatgcacagagtgtggtctctgtagtcaaagaagttggtctggtgttcctggatttactttcttttctcttttcttcttgattttgatatttgtatatttgtaccaatttttgcttcttactctt

SEQ ID NO: 94921 - DNA, 1413 bp, Homo sapiens
ctggatttgtgttaatgcacagtgaaaaccaattcaggctagacattttgcctaaccctaaagaaaactgagtgagctaaaggtgatcaattccttttgtaggcattatcctgcactgaaaactctggaacatctagagcatacctacctgcctcaagtaagccactatcgattctgcaaggtgatggtggacaacatccccaagcttcgagaagaaataaaagatgtttctatgtccgatctcaaagactttctggagagcatccgcaaacattcagacaaaattggagagactgccatgaagcaagtaggtcttgggtttatgataggttggccagtggctttatcagtattgagttaaacacaggtttctctttgccaagtgtctagtcattatcttatccaagtttcttatcattttagggaagtccttcatatttatggaaacatatgattaaaaatgttttcatttttttaacagagcaatggacaatttgctctgtagatgttcagtaaatattgatcagttgtgatggtttacattgaggttatgaagaaatttttctactgtttgtatacttcccttgactttgcatataatttgtagcttaagatattttaaagttctccttctagttaatgacctaaattgtactgcatgtgtctttggctgattatttactacgtaagcaagatagcatgttatatatgcatatttctgatattaataggtatcagtgaaaaaaggcctattaggaaatgctttgaattatgatcaaagaaaaggatttattaacagcttatatattaaaaaatatgttagcagtatatacatttgttaaaaaaatcttcattcctaagtcaccaaagtcacaaggaacatctaaatttctttttttaaattatgaatgaaaggtcagtaatgttttataatggcatttgctcacttgaaatttgtcacattgattttattaaaaatttttagtatacctgatgatgtagcctacagcaacaaatacaagagtcagttgtttatggaaagtactttttggttctgtaaacaatagtgttcttgaatagatcatttgtagtttttatcattctgtgaggaatgagggaatagattatatttcaaatcatattttaggtctcgactagccttgataatctattcagatgtctatttgatctataatatctatttgatcctccaaaagagattctccagttaccctttcctcagggaatgcagatatttcccttttcttcctttaaattttgtcagtgttatacttcacaaagtgcagagtttaaaactagatgataaacctgatagaaataattatatgatttcattgcttatagtgatggagaaataaaattaatcagtgacaatataccttagcattgctg

SEQ ID NO: 94922 - DNA, 1022 bp, Homo sapiens
ttctgcattgctctttttttggggaactctgccacacaacttcaagctgaatcaactttcctgagctactatcactgattctttaagtcagcaaggctgctgagctctgttttgattttttctggctgtgcccatgacctagaagtcaactttaggtagataatcctggtaattattaaactcaccttgtttgtttctctttttacagagatagcagttctatgttgcctgatgtccaatgtctgaaaatggctgtttcatatatttttgccaatattctacttgtttataaagtgagagatcatgtctgttccttgttaggctttcgtagctagaagtcttttttttttttttttttaagctataaatactgatttttctactgcattttgtgctccctagggaaagacatctgaacatctttctatctctagcgcacagaagaaattacgtatttgttaatgatgctctttgattaggaatgacactaatatttttctgtgatgaaagtttttatttcatattttatcatactctgaattttaaaaaatttcttatagatagttgcaatttgctttcaaggatcacttcctagaattttagaaaccatcactgtgaaagaattccatggtatggcaagaaagtaccaaaatttaatttgcttggaatcaatattcttcttcttgctttagcattcaaccatgtctgttattctgatcatggttactcagtttgtaggattatttagaacctctttccctgccttcctcccttttattctctgcttttattttctttactttagttctgattgcatctctgttaaggagcctgcatgagaagaggggagagagtgaccacacatacaagtgaaacttaggaatttgccttttgattcagttttaataatgtttggagattgtcaaaagtacatcaaaatctaattttggatttccgtggtcactggacatattttttttcttttggtgcctgctatacaggtgttagttggctatcattct

SEQ ID NO: 94923 - DNA, 1069 bp, Homo sapiens
taataagcaaacagggaaactttgacttgagttaacaagttcagtgtatacccaacttttctaggaatacattggtgaaatgaggaatatctgtataaaatttgtactttctattttatttttctctcccctttttcctcttgtctccccaaagttaaagtgcgatctttagttattatggtagcttagtttagaactgttctaaactcaccatatttgttagcaaatttttcttttcaaaaggtcatgcaaacatccagtagaaaagttgacataatttaaacccaagagaatgccactggaccaatatgtagtggagtactgaaaatatttaactgcctattcctaatcttttcatattaaatttagatctttttcaactattgtctaaatgtttgttttttatgagtttaaattgtcttctctccacagaatcaagtgacggatactaatagaaaactacaacatgagggaaaggaagtaagaccagtttaccttttgaagaaatcttttctgtttcatgccactctcttttaatgactatgttattcatttagtggttaagactgtaagtagtatgttggaagtacttggacattattgttgcttttcctaatgtttatctgaattaaatgaacatagtcactgggaagtctaaggagacaggatacaggcttcttagttgtgcttttaaatcatcgacttgtcataatacagtaatgctcttcctctgcctgatatgttatttcctcaatattcaccttcttcaaatctttgctcaaatgttgccttcttaatgaggcctttcctaaccaccttatttgaaattgtagtctcactctcacccgtgcattcttttgatcctttcccactttttcttcattgtgcctgtcatgctctgatattatatttaacatattttttacttatatttttttttgtatgtcattctccattggaaattaaactccatgagattaggaatttttgtttgctttattcattgctgtatcccctccatctacctaaatagtgactggcacagtgtggatgctcaacaaatatttat

SEQ ID NO: 94924 - DNA, 1046 bp, Homo sapiens
atgtgagatgggggaatggttgtagtagaattatctagcgatattgactgcctaatttagatttgtagttacatggctaccctgagtctagccagcacagctgtgtgttttttctctagctgtgttcaatttcttgaatatgctcatggagcaattggatagttgaatttaactaaaattgagcttttctagactagttaaattgaaaaagaaagatacaagggagttgtaattcagtcttttaattttatgatgagaattttgtgacaaatactgtcaggcagtcaaatattttggaatgaataagaaagcaaaagtttcgattttccttaaaaatactcatttaacaataaggcatgttaatatacagttggattattttgtggcttatgtgccctaaatttgcttctggatttataattttgtttttccttcttagaagtaaccatggtataatcttcgtgccatttttttttaaaggtctgtttatgatggtgaagaacatggacgtttcatggagaagcttgaaactcgtatccgtaatcacgaccgagaaattgagaaaatgtgcaactttcattaccagggctttgtggactctataactgaactgctgaaagtgagaggagaagcccagaaactcaaagtaagaaggctctaagagatactgtttctccgtcctgtgttggggttttgattaggattaaaggattaaggattataacatagaacacatatttgtagtgaagatttttgtataattagaaaggaatttatactgaaacgtacattcttgagagtatggctttttagctaaaaacaatacccacccccccttttttttttgaggcggagtctcgctctgtcgcccaggctggagtgcagtggtgcgatctcggttcactgcaagctccgcctcctgggttcacgccattctcctgcctcagcctcccgaatagctgggactacaggcgcccaccaccacgcccggctaattttttttgtacttttagtagagacggggtttcaccgtgttagccaggatg

SEQ ID NO: 94925 - DNA, 1050 bp, Homo sapiens
ttgtcctgcccttccagatcataccaatctaaatcttacatgtattgattgatgtattatgtctttctaaaatgtataatagcaagctgtatctcaatcagcttgggcacatgtcatcaggacctcctgaggctatgtcacaggtgtgttcttaaccttggcaaaataaactctgtaagttgactgagacctgtctcagatattttgggttcatatattcatttttgatagtttttttttcttttcttggtaattcctttttatatttctttaaacatcttacacatttatttttaatgtatacatattaattttaagccattgcaagcctgattttgctatttgtgtttcttctgattcttgtttttatactttgtttccttgtatgttttatgacttttgatacttaagttccagttcaatggagtattatttgtgagaattcctagaagtataggttaaggtatatttctctggagaagatttgcctttgcttcagttggttatttgagggtattaacaaccatgctgggactactttaaaaataaattgtcagttgagatttctcagaccacagaagattgatagtatgagtgtagacctcccttctgtgagaaggctggcatgtgctttcaaattatcatgggagttttctccttccctcacccagagctaacaccagataggcaagtttacttgcagtctccctttatgaggaagtgtttttctattttatcttttactaatgatgtattctggggtatcttcgcttcattcatttgaaggcctctgatttgactccccatcttgtgtgggcaataggccatgtctctttttctctgtatggctataaaatagaagcattaggtcagaggtgattagagagattaggttagaggtggttagaggtgattaggagtttgatagtagaaatgtttttcacagtgtatccaatcttccatacggttcatggaacttcatcctattttgcctgctttgttctttattatgttttaggatggaaactactctgatgcctttccatccat

SEQ ID NO: 94926 - DNA, 1062 bp, Homo sapiens
tatttttctcatttgaccatgcttgatttaaaaatttttaatatttatagaatgctttctgtatgccaggtactgttcagaattcttacattatctcatttaatcttcacacagcaactgtatgaattggttcctaccattatctgcattttgctgatgtggaaactgaagtatacagaggtttaataaacttgcccaagatcacacaactattaagtggtagaactaaggctcaaatcctgaaagtctggctatgaagcctgtgttcttgcccactgtgctatactgcctttgttgttacacttaaagaaaagtgactgctggaacatgtccagagggtaaaactacaattgaaaggctgtttatatgtagaatagttgaataatttgagattgtttagtctggagaaggagaaaaagggatcaaggacttgttctcactggtcctttgaaggcaaaaataagataaatggtgaaaattatagaaaggtaagttttagttttctataagaactttgcaacagctgttgaaatgggattggttgctttgcagtgaacttctttttactagagatgttccagcagaacttggactagtatttatggacatagctggaaaatttgttatgtctgtgaaattgggctggatcatctctgaggttccttttttccctgtacacttcaatgttaaagagtttattaaaatgggctagtctatactgtcctcagacaaatgcttctagaaaaaacacacaaaattgtttcctaatggaaacatggcacctatgatgtgagaggagggggaccagatttatttttgtctaaaatgtttctttgtaaatagctttatgatgtttgtagggagttttttttttgcatatcttgtaagtggactaggaagcaaaagaaagtggcttactttttcagttgacaaatcaagttatttagtaatagaacagagattccatcataataaccattgaagctactctcttctttccccttcccatttgagggataataaaataacattaacttatgggttctgtagttgcagtggaag

SEQ ID NO: 94927 - DNA, 1061 bp, Homo sapiens
atcttaaaatatttgtattgttggtttagtttttcctcaacttttatggtttgagttttgttatcacttgtgttaaattttattttcattgctctaggaccattttttcaaataaattcatgtagatcaaggttgtttcaggtcttttttcttttcttcttcagtgttaaattaacttgtctacatgctcatttcaggtcagacatttgatgaacattattacatgtttcacgttttagtcgtaccattcatagtattaaaaacaaaatcaacttagtattatttatggagtttaacatatagttgatttcttgatctaagtagaaagtaaaattattgaatagaatggacactaagatgacttcatgtagagacagttgacaaaagtgaagtcttcctctaagtctgtgaccatcagtaaactaacactgtcttgaaacctaaaaggttatgtagcaaagcttactctatgatatgccagggaagtttgctgggagtatgatccagatcattggttctggatgctaacatttggaaatgattttttttggtggagcatctgtgaccttggaactatgaattatcttaaaatttcttttcaagagaaggagcatatgagaggaagggtaaacaaaatattttgtttataatttgctataacaatgatttaatacagcttaatattaaacagctctggagacctaaaatttatctcacttggttttcactggtgtttctctctgacacatggtgtgaatcaactgtccttccaacttgaaagagcagagagttcactgacgcaactcccttgttctgggaattgttactactgtgccttcaaaaggtagggacattaaaagctttggcttgtggcaaattctctccaagttggacacagttagggggctgaatattggcttaaggaagtgaggttggtggctttttctatttcctggactttttctaaagaatcaatattaactttttcaagtctctacttgatgttttgtgattaacagtcttccccgttaaaattggaaaccagcaaatctccgtttaaa

SEQ ID NO: 94928 - DNA, 1050 bp, Homo sapiens
cacagcagatcagttctacacctagacaaagggttcacggttctatatctaacaagtggccaggctgggatttgaacaaagatttttttcactgtgctgttattaatgattaaatttgacttggaagtttttagaaaatagttcttagtctgtattcagaatgctcttagaagtaattagctgagatgtatcttgagaaaggtctactgaagaacattggattctatccacttccagggaggtgctccatcattccatagctaggcaacagaacctggttgaactaatccattttattccaggcatctaggataaattctttaacagagcccagactgaaatgctgaagcttggattttgggaaattatttggaatctatgtttcagtgaattcaagattacaggcaaaaacttacagggctggctgctgaattatatttcatgttgattcattatatgttcgctgcctttgatgtttattgtggtgaggccagatttgatagtttgcagtcagattcactatttacttgaaggtttaaaaagatgacttcattaaagattgcttatccactaggtttgtagatacatatcctttgggtattgactacttcccagctttcacatcatttgttctcacatcattattatttgttaataagcatttatgtggcccttgatcttaaatttatttatttatgttatttttagttggcatgtaataattgtacctatttatatatttagttttttgagacagggtctcactctgttgctcaggctggagtgcagtggcactgtcttggtttgccacagcctcaacttccctcggcttaagccatcctcccagttcaacctcttgaatagctgggactacaggagtgtgccactatgcctggctagttttgtttatttttttgtagcaacacggcctcacgatgttgcccaggctgggcttgaactccacagctcaagtggtcctcctgcctcagcctcccaaagtgctgggattacaggcacgagccagagccaccacacctggcaaagtgtaca

SEQ ID NO: 94929 - DNA, 1002 bp, Homo sapiens
agtaaaatatacatatgtggccgggtgcaatggctcacgcctgtaatcccagcactttgggaggccaaggtgggcagatcacttgaggttgggcgcttgagaccaacctggccaacatgccaaaaccccatctctactaaaaatacaaaaattagccagccatggtggcaggcacctgtaatcccagctactcaggaggctgaggcaagggaatcacttgaacctgggaggcggaggttgtaagctgagaccgtgccactgcactccagcctggacaacaaagcgagacttcgtctcaaaattaattaattaattaattaattaataataataattatcagcatatgaagaattttgtttcatccctaccccccaatggaaaaaactaatcactcaaaaaagggatgatgcaacaaatttcacttcctatatttctaatattttgtgaactgttgttttccttgagaagaaaaatatatctgacattcagaaaaattacttaacatgattcttcaagttaagaatttgagtatactgccaaagataatcccaataaactctgctctcttaattttgtctttacttcccttgggactaacacagtaactgacaaagtagatatttaagaaatgtttataaaccaaataaataagaacacctacaaagacaaaaagtaaatctggccattttccattctgaagatttacctcttgcaaaagacaaacataaaaaatgagaattcattctgtgtaactctagagagcagagaaaaataattacatctaatttttaacaattcttaagctacatttatcacaaactcatagtcaccttaaccaaattctaattgaaaaaaaaaaggcatacaaaatttgaatactttttttaaaagttaaactctgatctgtaacatactggcctaaaatagcaccatgcgagacatttttaatactaatcaaaataactatgtggagactcaaaagtgctaagtagcacatattt

SEQ ID NO: 94930 - DNA, 1043 bp, Homo sapiens
cctgcctgtcctgtttttaaaataatgttcattcctgctttgtgttataaatactaaaattttgatgacaaatcatttatgaacaatagctccctgttttcatttttcaaatcccatccctatatctctacttttcctttatatcacttactcagtagaagtcatttcttcacttggtactctgggtaatagcaattaacattcagtctaattgttgtttaagattttgttttcaaacttaaaatttaatattgaaatacattgccattaaaaaacaactatattgagatataattcatgtatcatacaatttacccatttaaagtatacaattaaatggttttgggtatgtatattcgcagagttgtgcagcaatcaccacaacctaattttagaaaattttcattactcaaaaagaaaccttgtacccattagtggtctctccattctgttccctctctctccctaggcaatcactacttttcttcatgggtttggctgttctggacatcgggacattttgtataaatggaatcaaacaatatgggtttttttggtaactgaatgttttcaaggttcatctatgtggtagcatgtatcagtacttaatttctttttatcgatgaataatattccattgtgtggatataccacattttatttgttcatcagttgatggacatttgggttgtttccattttggggctgtggaacaatgctgccatggccatttgtatactagtttttgtagagacatatgttttcatttttgttgagtatgtacctaggagtggaatttctaggctgtaaggtaactctatgtttaacattatgaggaactgctagactgtttttccaaagtgcatgcgccattttacattcctgtagcaatgtatcagggttccaatttttccacatccttgtcaacacttgttatcatcttttttactttgccatccttgtgggtgtgaagttgcatttcattgtagttttgatttgcattcccgtaatagctgttcttttcatgtgcttattggtcattg

SEQ ID NO: 94931 - DNA, 1067 bp, Homo sapiens
gctcacagttttgaattctccagctccccgtgtctcccccactagactgtaaggcctctgtcagacattaagttagactttattattcgcgccgacggagccttggcactttgtggcaaaggtggtaaacaagaatttgtaggtttagtgccactgcctgacttgatcatcactgtttacgcactgtcgttaactgtttttgcttacagtgggcttcaactagtatttgcggattccatgtatgaatgaatggaatccaacctagcatttcccagagaactacaaatcccagcggacattacgcagaacgccgacggacgcggtgacgcaagggggcgtgtcgagcctgagggaggggtcggcctgcgggtagccagaggctggggcggctgtggagcctgtggtgggagcggcattgtggggcagggaaaaggtgagccgagccgacggaggggacgcgctgcggggcgcccccagtctatggagcggggtaagatggcggaggcggagagcctggagacagcggcagagcacgagcggatcctgcgagagatcgagagcactgacacggcctgcatcgggcccacgctcaggtaccccgggtgccgggaccacagaggggcgggaacgggcgggacggggcaggctcctctgggtcgggcctccggccggctgtccccaggtccggcgccggcccctcccttcggagagaccctgcataccgggcgaggcgggtctcccttcgcagccccgacgcggggtcccttcccggcgccctacagcccagtgactcaggaccctcccgctgcctccctcggggcaggagcagccttcgttctccctccgaggctggtccggcgctggggaacgagagggcgcccgacagatggtggtggctcccggcagatcttccccctggggacatcacccttctccctccgtctctaactacgtcctgccctagacaggagtcctgctcttcagacaacacagaatttcactccatggtctagtgctcgaaatcaaagtcttgcctcagaatcacagccacttctcagaaacgagtc

SEQ ID NO: 94932 - DNA, 1447 bp, Homo sapiens
ttttagtagaatgagtttagtagagggctacagaaggagctgaggcagggagagaagcaaggttgtaaaaagggcctgattgtcgggatgtgtagatgctgaagggtcctacctggtgcctggttggctctggggacgatgggggagggaaggaggaagtgatggacgttttgagtctgggaaaagaatacttcattaatagaaatgggaatgtcaggaggtggtgctggttggacaggagatgagaatcttggttttagacatggtagtctagagggtccatgttcagtgggcttttgaatttcagtccagaacttgatggtgacaaattggagcctttggcaaccctgaccacacatttcagccaagatgacgtgtttcctctggccagacctgactcagccccacccccgacataaaacagggacctgaaaccttctgtccctgccttggccatgttccctcatcgtctccttttcatcctctaggtcctctggacacagacatgcagcagttggcccgggagacctccgtggacccagacatgcgaaaagggctgcaggagctgaaggcaaaggggaagctggtggattgcaaggtgtcagcccagaaactgctgagcttactggaaaaggacgagttcaagtctggagcccacgtggacttctatgacaaataagcccatgtttttggcttcctgaacctttttgcccccacttttagacataccccagagccctgtggctccccacaccctgccataggggcagtcctgccttacacatagaagcattcatgcctgctgccctgccctcaggcacagccagctgtgagctcccaggtcattggccttaccagttgtcaggagtctgtgctgtgcaccctgggttataaggaggcttaggagagaggttatgggtattggtgtctctatccccaggaatagaacttaaggggtgggaagaacaggaaaagaagctggaacacagaagagaggaggttgtgtctcttgctcatagcaagcctgtgggtagaggaaagagtgatctggtgtcgaataggaggacccatgtagattcgcagatggcctggatgggaggaagggcagacggtacatgtcccagcccacatagatgccccttgctgagggtagcaggaccttctgttgaactttgtgtcctcactctgatgtctccttccttcagaatctaccacccctcccccaggctgggagaaggggctcctgggtgtctgtatacacgccaaaggcagatacaaataaaatacagattgtcctttcttcatgcttgctttctcctctgatacagggcctatgactgactgcctggttcactgggcccaaggccattcccaaggcagttaacccaaaagtgaggtgttgtccttatttcctagggagctttccgggggccatctgcctccagtc

SEQ ID NO: 94933 - DNA, 1050 bp, Homo sapiens
cccacgctgaccccagccttgatagcccttttctcaccctgggctattcagaatacccatcttttagggcccagcttacagcctgccctccacatggccctaaagcctgggtcctttccccaactctgtggattgccaattccaccccctgtccacgtggcaatgctgtgaatggatgccagctgctattggcccttttggcattgtccatctggcccatggtccaggtcgtcagtggggtgggcttaggaccagcatgcctttgggggagatgggcaagattccaagaaagggaagctctgagaaatcagggctgcaaccaagccaatccttgtgcaggttggtagacataggctgggctgcgagctccacggcagtggtggtctgcagccagcaccctggcccctggccatatttgggagaaggaagcgtggtcccctgcccgctgactccaggactcagcctgcctctgagtgtgcagaagggaactcctccttgtgctcagcagagggcgcatggaggccgcgccttttgctgaagggcaggccctaggctgaagctggcagtgccctgcctgctcccctaggagggaatgggcgaacttttacctggtccagcagatgccttgccctcatgcccccatcgaagtagaaatcactgggctcaggttcctgctctgccacagctggtaacccagggcaagtttcttctctgtgcctcagtttccttatctgaaaaatgtggattataatggcacctaccctgaagggttattttgaacattaagtgacctaatgtttgtaaatgttcagcacagtgctagcattgtggtaaatgccctgtagatgctaatattatttattgcctttaaatatcaagatccagctcatcctggaactctgctggaagcctcctctcctctagacagttcagacatcctcccctgcctgacttgaggcaaaaactctcactgtactgcccctattcagcctcctggaggtgagggtggggtctggtctggataccttgtcttggatttacaggaaaatg

SEQ ID NO: 94934 - DNA, 1050 bp, Homo sapiens
gctcagcttctggtgaggcttcagggagctttcactaatggtggatgtcaaagtgggagcaggcgtgtcacatggtgagagggggagtaaggggtgaggggaggtcctagagtcttttaaacaactagaactcagagtaagaactcacccattaccaagaggggggaacatagccattcatgagggatccacccctatgattcaatacctccatgaagccccacgtccaacattggggatcacatttcaacagagatttggaaggcacacacattcaaaccatatcacatgggtatagatagtatcactgggaggctctcacacccaattattttggaagctgattttaataaagtgtatggctgtgtctacactggagctgctgacacaagtggaagatttaatgtgttgccacaacgtttatggaagatgagccaagagctttatacacacattgtcatgtacatcttggggatttattggtgttgagatgtgtcgggatatgaaagaactctgaagtgatctcagtactgtcaattatttgtatgacactattgatgcatctctgaaaagctggcaaattttcaaaacatttgtaagtggagtgaagggatactggaaactccagaattgttgaaaatgtgttggattattggtcatgattgaggggcttctgcaggttattcaaacatggaaagatgtgtcaagctattttttgaaatatacaggtggctggtgcagtgaggtcttggctgattttggtttccaaatttgaattcaccttttgtttataaattttaacaaaatgtaaacaatgggctaagtattacaggcactggttttctaaggagcttctaattgaaactatagacattcttctctttcccatcaaaggttaaataagcatttcatgctttgtcatctgaaagaagtgataaatatttttaaaccattcgagagagaatggagaaattatgccaataagtaacccccaaaggtttcaaagtggaaaaaaattcttttaagaaaaaaaaaagttcatggtaacta

SEQ ID NO: 94935 - DNA, 1077 bp, Homo sapiens
ctccccccttttggattatctgtattttttataactctgtccaatagacatataatgtgagacacataattttaaatgttctagtggccacatttaaaaagtagaaagaaatagataaaataatcttcttaagatatttcattttactcaatatatccattactatgtgtaatcgatataaaaatattaatattttaaatgttttagcactaagcctgtttaacactaaatgcagtggatattcacatttacagaacatctctgtttgggccatccacttctcaagcaccacattaccgcatttggctcctagcacggctctatgaaataatagcagttaatatttatcaaaagcctactatgttccaggcactgctccaagttcatcaggtggagattataactcattaggtctcaataactccatgaggttgaacttattgtgctctccacaagcacgtgttgcttgcccttgtcctcataccataatgaaatgtttggagcttttgcaaaagccattttcctaatatgatgggcatccaagtctggttgcaaaggcttggatagagggcaagtgagagaattggagagagactaaaaatcattcaagaaattttgtggtgaaaaagacaagtcaaaagactgagagaaacatgaggacagaaaactctttgtaaggcaaggagacataaagatgaagtcaggctgaataggaaagaaggaggtgaaaggtgaaagagagatggctgggggtgtggctggtccaaattctcacaagatctctgttggagaaacattgcctggcttgtgctggtggcgagatgtacatagcagcttcccagctagagggagcagggagtcatggccttgtgagggagacagatggagacacacacaacccccatcgcaggtgaatgctatgaaagaatggggtggagggcttcccagggagatgaactgagttttaagaacgaagttagccagcaaagaagcaaaaggaagaggatatagacttgaggattacatcactggatgactgagccactgattggatgtggaggatgagagagtgatgct

SEQ ID NO: 94936 - DNA, 1286 bp, Homo sapiens
ggctgggtctctgacatctttccagtgagttccacattgatcaagcacccgacattccaggtgggaagaacagcatgagcgaaggcacagcacagggaaaacctgtggctcactcagggacagggatggggatgctgaagcaaagggtaccgggagcaaggcaagaagatggggcaaaggggctcagaagggggtgagtctgccctgtttgggtgcaaggaagagaaacctagctgcaacatggagggcctcctttgaagtggacctcatccttgacattcacagaaacctccctagaggagcagggcccaggccaggccggtggcagagggagctgggcaggggggtagggggtgctgcattagggaggtgtggttgggaagccagtctagactcaacccactagatgggaatggatggggctggggaagaggagaggaagcttgaggaagattcccagatttcctgtagcttgggaaactgtgtacatgtctaatgctgtttgtcgaggtgggtgatcctggagaagcacagatgggtaggtgcgtccggctgtggatgtatgggctttgaggtgctgaggggcagggggtggagcaggcagctggcttgacgggtctgcagctcagcagaggtcagctaaagacacaggccagggagccaaagagaagtcctggaagtggatgtgatccccacaaggcaaaggacataatgaggagtcagggagagcaaggactgacctgggggtggccagaggtgacaaggcatggatcacactgaatgaactcaggctgaaggaggagtcagagctaccgaaatgaaggcagagcggggtgggagaatccaggagggcatagccaacagatcagggagcaggtgaacccaacaggaagtggttgagtttggccacaagggggtggccagtgactgtggttggtgactgtcattagcaccggcagaatggtggcatggaggccaaagagcagaggtttcatgagcacatgggaggtgaagaagaaagagaggggtctggatgtcgtaagggaaagacttaggaatgcagatttgcttgtcaggaaaccttcatcctgacaagtgggacaaacagaagggcaggtgaacacaagagctcagcgggccctggcacgttgctctttcttgggctgaggaggccctgagtcactggggactggttgcaggctcagccttaagccctgtctctgcagtctcaacctgcccagcggttctccaaggacaggtgagcatcctggtgggcccacgacttc

SEQ ID NO: 94937 - DNA, 1042 bp, Homo sapiens
tccaggggaaccccgtcttccagtgcctattctattccagtgctcttttctttctgcccatgtattccacactgagggagcacctactgtggaccagcattgtgctaggctttgaggacacaggggcgagacagatccgcacgtccgctgcctcagggagcttgtgatctaatgtggagaggtggggtatgagaagttcagggagctatgggggccacagaggtggccacgcccagcgtaggggagggaaggtgtctaaagctgagacacgaaagatgatgagctgaagacgggagagcagagtaggggcaggaatggaagtaggacggggtgtctctgaacaactcaggcaaagactggagtggggacagagcccagggtgtgcgaggaaccaaaatcagtccatgtgccctgtgtctccagtccaaggagcagggtggcgcgggagtctgacttgatccctgaggatcagggtgccatggagccatttcacagtgaagagaggcatgggaagacttgcagtttagaaggccggcactggctgtggttggggacggactgggctggatgagaccttgtggggagggacggggagaggacgcaaagaggctccagagtctttgggcagagcaccactggatggcggcgtcattcccgagatggagagctgagtggggccaggggagagggcaggttcagttccatttcaggtgggttgagttcaggcgcctgtgagacatccacagcaaagtttggcaggcaggcggctgtgaacctgaggctccagggagaaacaaggctgcagaaatcttgtgtgggggtaacccagggcatgtgcagagaagagggcccagccagaccaagccccaaggaccccgaggagcatgcagtgggtgtcgtgaagtggggggtggcagtgaccttggagagaaagatttttctggagtgtggtgagaacagaagccagatttactgtgggttgaaaagtcagtgggagggaaggaggtggacacagccagtgtagaccaagttttttaaagaa

SEQ ID NO: 94938 - DNA, 1031 bp, Homo sapiens
attggttttcctctggagtcgggctgcttggtggcccaggctctcctccgactgccccagccaaactccgcatcattctgcccgtgggtggcctgccggcgtctgtcaatgtgcccttccgccagcgtgctcccctcaacgtcctcttgctgtccagccgcttgtgtgttcctccactgatgtgctcctctggatgtccagctgcctgtgtgtttgcctgctagggtctcagggatttttaggtacaggatcagggggtgtggcaggccagggtggtcttgggaaatgcaacatttgggcaggaaaacaaaaatgcctgtcctcacttaggtccgtgggcacaggcctgggggtggagccctagccagagaccgtgcccttcccttccccccttccgtatccatggcaagtgggttgattattctgggactgaacccgtccagcctgggacctgcctagtgtctgggtgccacatactctcacatctcaggctccaaaggagcccctctgataaggtgatgagaggtcagagtttggtgctcctggcagcctcatgtttcactggtccttccctgaagttctttggagggtccctggggagaagaaaagttcagcccgggttcccccaggaagatgaagatgaataagacccagtttgtgccttgaaggcttgctaatctcacatgtactctggaagtgcaggactgtgtggtagggaggcagggcagtgtagcagagtgagctgaggctctggtaggaaaacaaaatctaggttcctgctccacctctttctgccagtctgatgtggctgtggagcctccctcagcctcagtttcccacctggaaaatgaggacactgccccttcatcaccttgtttgttggggctttgcattttgcaccatccagcagctcttttgctctttgcagggtccgtgccacgcaccctatagcctttgggtgcaggggcactagtgcagggcttccgctgaggaggctgacaaggaaggcagcccccacccttggggagccc

SEQ ID NO: 94939 - DNA, 1006 bp, Homo sapiens
tggtgggcaagacccgtacccaggtcagctgcaggtgagagcaggcagtgtgtgaacttggccaaggtgaccttgagaagaggaagcactgtgggcctggcagcaagaagggctggtacccagagaggggctgcggccgacccagagagcaggatagaatttttgtggaaaggcgggctttctgggcagggtgcaggcctgtggtatagacactgaggtgtccagcctggtcaaagtgaagtgcgctcatgggtccagctgatgaggggtcctgtgtgcccagctgaggtgagccctctctcaccctagaagagggcggaggctctgggggtacctgagcatgggcatggcatggtgagcactgggattaagaaaatgcgtatggtatggaagtttgcaacagacaaaaataaacagggcaggctcttttgtgcccctgactctcgtatacgtagccccttcgtgaactgaggttgtccctgaataccagtgactgcaagtacacacagggagcaagcggggcaggtgaggaaggtggttcttctgtccttgagattgctgagtcttgaaccttggaattctgaagctggttcagtgagcagtgcttactctgttacttgtaccacaagtccagtgaggtagaacactcgcacaagtcaagcgaagcaactttattactcacagataggcctcggggacaatggacgcctaccactcaaggcaagctggtgccccatggctcgagaaagctgcccagggaggatggagtctcgtccacccacgtaccacatcacactgcaactgagggagcctgggagcgctccaccctggggtttccaccctgggggacatcagcttactgtgctaaagtgttgcaggacatcctgttccagaagaggtaggaacatgagcccaggctgtctcagacaggccctccttatctcaagatgttgcattcccaacacatcctacagctatcctgagaactacaagaaggcggggggcg

SEQ ID NO: 94940 - DNA, 1055 bp, Homo sapiens
aggtaatataataaagatggtgtgacaaaggcagtggggtctgcaggggcagtgaatgccatcattccaagagaggtgactgtctcaggatcaggtggactactggggtgcgcaggaccccattcaggaaccgagagacttcccgagaggcagggcttccagtgctaacaccagcacagccctgggcaaaccaggacggtcagtcatgctgaccggcagcatgggcggcaccatgtgagctggagaccgcatgctgtgcctttctggggatgtgtggcctcctggggtccaggcctggcttccagggaggtgaccactccttccctgacttctctcatcattgcctttcagtggctgaaccagagccacaatgcctgtgtcaactatgcaaaccgcaatgcgaccaaggtgagcatcactgccctctccccagtggtggggttcaggctagggaggcccagtcatcctccctacagcgtgacatgccaccatcagtggctgcctcttggttaagcatggccctcctctagatatcttatttaaaatgccagcccttcaggtgggtggccgactcagacatgactcagctgaggtcagctgcagtttctgggccaggagccctctggggaggggctgtttacatgaagtgaagaaggcccattaaatgggagcagtgcaagggatgagttcggctggctttcagattcttcttgggtagctcttacatttgggttttggatcatgatggtatcagctacttgggggcaaaattcccataaagcttcctccaaaatttctggaagctgccttagcgctcccaggtcccgactgctggccacaagctgaagggctgctcctgagtggggagggtccagggctggtaactcccccccagagcccctgcactccttggagagcttgtggtggaggcccagtcacccttctgttgtccaggaagggctgctgggcccctgctttgctggcaaggccacctctccccaacttcaattcaaaggcaaagaaggcaggatgcatctaagtcccctttgggggcc

SEQ ID NO: 94941 - DNA, 1062 bp, Homo sapiens
ccagaaaaaacccgccagcgtggttgcttcttatacacggcctctcccttcccaggtttcccctaagcacagcactgccgcttccatgcacgtggcctgggagaggcagggcccggcttggccctggtggtccggccctcgtcctgcctgccctctccatttctcctctgctcctgcgccctcttcccttggctgctgcggaatgcctcggatgccagggcctgggtttccctcatgggcctggggctctcccagagagcatttgtgcctctctcagccctgagctccccacagcactgcttccctcccctctccttctccccgctccatgtcatgtcgaactctcaaaacttagggaccaaatgcctcatttccagcccagggtgctaaggagggcagaccatgaacacctagttattgggtctggtggccttaggttaagtctaaatccgatttctgtcttgagacattaagaacttggactctgtactttgcactccttcattttaacacacaggtgatcacatgggcttagagactctaagtatcagaagatgctggtgtcggccacttcatctccaggggtgtttcccagggccctcctgacatctcccaagccgcctcatccctcctctgcttttttgcacatttaaatcccaatcccaatgttctccctggccttcctccagcattaccagaccccagccatgttgacctagctcaccacacaggaggtgtcgctccagtgaagctagaattgaccggtctggggtaaacattcatttgacagagattttctttaactggctgacatcctttaagtagcaacaccccttatacactgaagtgtaactttcagatcattagccacataaatcagaagatggagacacagtagaaggaaaaaacaggacaattgttgtgtgttggggtactgcggcccatggtggatgacaaagaggaacattttggagttgagcgagtcagtgtggcggaaggggatgagatgtaaagacacttgctctacctgggaggctcccgggtatgtggggaggcagcgtg

SEQ ID NO: 94942 - DNA, 1076 bp, Homo sapiens
aactggccacaaggcaacatacagccactggtatctgaatcttcccagagaagttgtcttcttcccttcttcctcccctaatgcctctgcttttctccctcctccctcccccttcccccttccccctccctacacccccgtccccaccccattctctgttcctgcttttgccaggctattctacatccggacaccaatgagaagatcttcatgccatttagaatgtcaggtaagctcctggggcccttctggttctggtcagcctggggtgcttactccagtcacagttccaggagcatccagatgtgctggcctaaggaggggacagagcctgttacaatcatggccatatttgcacctctacattcacctcagctcaactgtacaaggcgctggccaggcctcagaatactctatggagcttacctgccttttctgcctgagcagttggggtggaaccagggcttccacaggtgaatctggtagcccccaccaccacccactccacatcactcagcgcacactaggacagcctcagtgatgcctgctgtaagcaagccctggcttctgcaagtcattccccctctcaccggtgtgtgacctgctgtttccttccaagtcctgctccctgccctgccccttttaggcagtcagtctccagcctaattctctgttctctgatcctgccattagccctcccttcagaatggatgcactgttgttgcactgctgtgcacatacagaaggtgggattcctgttctgtggagaccaggaggcagagggtgatacaagatccctgccccaggaaatcccactggtcactgaaggggcagctgtgcctatgtgggctttagggcttagaaagcactggcatgtacacgagctaggctggcatgcttatccccccagcagttgtgagagactctgcagagtcacactcatgggtgtgctgacgcctccttcttgccatttctcagtgcaatggggcacagccaccttgaattatgagggtggaatgggagggcactgctgctgctgccttgggaaggcctcgggtggctggagaaaggcggtc

SEQ ID NO: 94943 - DNA, 1048 bp, Homo sapiens
tgtctgtaatctccatctctgccacctgctcacacttgctatcctcttgtcctggtctattttccctagtttcctgaagcacttttccttctaacatatcagaaaatgtgcttatttattgtttgtgttgcttatcgtttgtctgtctgtgcaaccctctaaactcaacaaaagcagagattttggcctgtttttgtcactgatgtgtccttagcacctagagcagtgttcagcacatagtagatgctcaataaatatttgttaaataagtaaatttgttaaattaattattaattttcacaataaccttgaaaatattcacatcctcatattacaaatgaggaagaggaggctcagaaagattaagcgtattgccctaaatcacatagccagcaagcgggagatctagaatttaaacccaggtctggatagaaacaaactgcgtgtatagggaagttgcaactgctgctgtgtgctatgctgcagaactaggcgaagagtccctcttctttcgtgagtctgtagaattgggggtaccctcacctgacatagacttgcaataggtacatattacctgggagtaaccatggcaacaaaattaatggtgaggtataatgcgattggcccaactgataaattaggaagttttttttgtttgttttatggaggcattctttgccttacagaaggatccccttcaggctctgtttaattaccttctggaggttgttttaaataggctctgtctttgctgccttgggaggtttggagaagcagcttggaaggaggcagaggggaaggggagcgagccagattgggggtggggctgggctgttcctcctccctctgggtgttgggggtgtgccccgctctgcccgagaaggccagttggtgagtgtcctctgcccctcccttggactctacaccgaacttcaggtaggttcagatggcacttcagctgagatgctggctgtttttgaaattagccaacttctgggatcttccagccacctctcacccggattgcttctccacacctgctccatgt

SEQ ID NO: 94944 - DNA, 1056 bp, Homo sapiens
gccctcttccagtccttcctctttctgcaagtcagagtcccaacagtgcagatctgatcaagggactccctacgcccttgtagatttaaataccctccaatggcttcccctgcttctgagataaagacctcacttctgaaggggcccccaaagtatgcatggcccaccccactgactacttcttccttgaatcccaccacccacccacccacacttcgcaccctccttcacatcacactggctgcttttcagcctctgaacccaccacgttccctcccaccactgggccatctgcttggaacatcacctcttcctctacccccaactcttgttcccattcttcctcatccctggtgtatccatgaagcatcactttcttggagaagcctcctgcactcccaggttggatttttgagtgttcgcttactgcaaagtacctttctcggtgtatacattgatttgtgatgagtatttctttgccatctgtgtctctctgttgactatggactttgcagaagtgggggctgtgcctgtctttactccctgttgactctccaaggctcagcacagtgcctggcagttaagaggtgcttaatgaagatttgttatatacatgaatatcctggagacaattcagtagggctttgcggacttgaattaaattgacttgtaaggttgtgactggggaggtggaccaacttttctccaaattgtcccttagggatcttacaaaattgcaagtggtgtcatgtttgacagtgtaaggttcatcagtgctgagacatcccagagttggggtgtctctaaggaggtgagtctaaagacacaaaggttggctacatatgtactgggttgatgagctcctttagggcccagcccacatctctgtgtcctgccctggcatgtaatagttgtgtaatatatatgctcatagtaccttgtgctggcctgacagaagcctgcttcaaggtggttgataatccagggttcattcccagcacccatgccagggacatgacccttattccccaattaatctcaccgctttctgcagga

SEQ ID NO: 94945 - DNA, 1026 bp, Homo sapiens
tgtgcctttggtgggcggggtcaagagcccctggatgtcgacctctcccgctgtgtggcgtccccctcccacctgttgaatacatagggatggctctctcagggccctgggaatgggaatggacagcactgctgtgggctgttcccctcccctaaagttaatctcttggtctggccaagttgctgctccctcaaccttcctgctgtcttcccctccctcaaccccaataggaggatcccaggataaacactgctgggcaggcgggcaggcaggcctggggctgccctgctcactctcattgtctggcctcaggacttagccatactagaccagtcagcttgcctggaagagggaggtcccactatgcctttgggagacacctatacttaggaaaaagcctttgttgtcctcccatccatccattaagctgctatctcagcctgtcccttctgccccaggggcttgcctggcttggctgcagtgcactttgaaatgaagtatctgtcctttggcccagcccctggtttgcttgtagaaaacatggtaggcttccccaaggcatctgcagggaactttggcagcttggggcaccctgaattagcaaaaatggggggtgatgaggtgctgaagaaggatacttaacagcttagtgaggaggcaagagctcctctgggaccaccacttcttcaggagagggcctgtgggcttgcttttggaaggcctcaggcagacacgtgccctctgggtgatgtctgtctgctgccaggatggagcagaggagcgccacacatggaggaaagcccctgtaacgttacctaccttaaactccactcatcaaatctgagaaaagtatccactggtccccagggtttcagtcatgcttttgggggtcattgggtattagagaagtaagtatcttttctgagagagggggagtcaccccccctactggggattcctctgggctttattcactcccagccctggccctgacctttgtgggcctccctaatgcccagggcatgg

SEQ ID NO: 94946 - DNA, 1590 bp, Homo sapiens
gaagttgcagtgagccaagatcgcgccactgcactccagcctgggcaagagactctatctcaaaaaaaaaaaaaaaaaaagggatgtaaggcgctttcagattagttttcccagatgtaaattccttgttgagtagaaccttagaagcttcagcatgggatagaggaaagaacacttggttaggtttggatcggatcctgcctatcagatgagatgatttctctctggggttggagtgagcattaaaatagctttgcctggcatatttctccttgggaggcacttgataatgttacatgttggggtcttccctctgtaccctggcccaagtaggtaaatccagcctatgtgtgtgttatggcccctggtcccgaagcagggggtggggcgtgggactcaggggcctttccagtcttggcattaaccaggaggctcacggttttgtctccctccacagcctggacgtgtctcctcaggtagaatctgacccagctgctcttcctcaccacctcccctgctccccctgggctccggcccctcccactcctgctcccactgctgctcccatgctaagcactaacctttttgcagccgcctcccccgctgctgccactgctgccgctgccgccaccaccgccgcccctgaagccaccccacctggattattgggtcttaccaacccgttcctcacctctttgcagagcaaccccttcttcgaggagctcatagccgacatagcactaaactctccttcacctgctccctctctccccagtgcctcgagggccagccccacccccctggcctcccctgggaaagccctgcctgagtgggacaacaccttcaacgtctttgctgccagcaggctgcgtccagaggccaggagcgagatcctggcccctgcaggagtggggctggaggcggcagggctgcaagacccaggccctggggccatgactgcgaaggcagctgagccccagggagagcctgggggaggaggaggaggaggaggaggaggaggaggaagaggtgggagcagcgtgtggctggagcccagggttcctctggacttgggaccgaaccaccagagcgcgagcgcggctgacccagggctcctcgggtcggtaggggctggcctgccctcctcgtcagcccagctacagctgagagcctcaggctcagaaccagacagggaactgccagccccggaagtggaagcagggcagagtccggcagacagtgggacatctctatttagctccccagaagtgatcagtgtgtgggagaggctgccgggcccagagagcgctgctgagggccaggacgatgagtcctcccgaggcgaaaatcagctttgccctgacgtcgagacagctgatgatgcctggccttgggatgtggtcaccatttctcctgcagctgagacagcctcactagtctttcggggagagtctgatgagcctgctccccaggtgcagcctgaatcaccagaaactgtgagccccaaggggagcgaggggcttcccccaccggagcccgagcctaaacccgagtgggtgtctgacaaggggctgcagcccagcaccccac

SEQ ID NO: 94947 - DNA, 1010 bp, Homo sapiens
cagcatatattgctgcccccaccgcttgggggtggggagagtgtgccaggccggcacagtaggttctaggatgcagaggtgtttatttgttctcagagcatgacctgcaaagacaagcatacgtgggaatatgttcctgacctgggccaggtggagtgggagggagatgttttgaagtgagaaccttcagaatgtgcacttggtgtggagcaaggaagaggaaggcatgaaggagggatgtgttaccagataggaggatggacagatgccctcagaagtactgctggctctgtaaagcctgccaggcctggtgcttggagtcccttcctccagggagagccctttgctgattctatacaaacaggtttgtgtgtacctctggggagctggccgggagagggaggttgccgagcctaacctgaggctcccagtctactcccctgccgctcttgtccctgcagttctgactgccagccaggttgctgaaagactgcaagggtgagtgcaggccaggttagggctgagggggcagagttaagcgtagtgcttttaatgttgatgggactctcttccttcagaccactgtggcctattgtcataaagggggctggggagagaagcagctcagagtgctctagccctgttcctgggggcccgggtcctgtagacagggttgggctgggtgtggtatggatgcactaatggcaagtgggctgaggtcaggctcttgacctggtggtggtgtatgttgcttctcactccccttggtccccacagcaggcatgtgtgccttggcctggggcttgtctggaatgaagggagaaagggcatctgctggggttgaggctctgggcccacgattcttcctcttttggtatcttcaccatgtccatagaagcagggtagtagtggaagcccaggtggggtgggaacaggtgggaatttttacctccctctccctccatctttaggtggaggggatgagactgagaatttacctttggatgggg

SEQ ID NO: 94948 - DNA, 1063 bp, Homo sapiens
ctggattgaaaggggcacagagcacaggctcagtgtggttgtgcgtacggtgtctctgggccttttctggggcaaggtgaatgctggggccatttgtaggtgagtcctgcccaggctttgggcttggactcccacaggctgtgagtctgtggggttgtcactggcctggggcacttacagtctccatcctctttctcctgcttccccatatctcctaatggcctcttggaatctggaggatttgggtcactgatggccataaggaagctgaggtttctgtcctgctgtcacttgaattctgagccttgtctttagcaggatggagggcactcagcatccctcccaagatggggcctatttgcaggtggcggctgcagggccaggctctgtggccgtgcatgcagatggggtgggaggggctgtgctttgggtaagatggcctggcctggacagatgtgacacctggcctttgagctcaatcagcagcatcctggccttgtgtgccttgcagggaggggaaggctggcctggaagaaaggactgttggcgcttccccagagggcttgcttagggcctctgaggagagaaggagaggtgggctgcctcatggcaggaagctgtgggttagacccagaactggagtgactgaatgtagctgcaggatctccagctggggcctggggagcctgtccccaggtccagagaatgggggcctctgccttggggctaccattgcagattgtgggatgttcctcactaggaagaacagcggcgccctctagtgctcccatgtggcactgatgccccacagagaggcccggggctgaacgtgttgagtatggtatccagagaaaggctgctgccgtggggaaggaacaaatgaggctatacagggctgagaagagggtcctgctgttcctctgatgtggcctttgtctgctgggggccatggcagtcacactgggcccctaccagtgtgtgctggagcagggagtaggtagttgagaccaagcttgtcttggccacaggacttagcctcattcccctgccctgttatgagcca

SEQ ID NO: 94949 - DNA, 1028 bp, Homo sapiens
cacctggcccctatttacttttgagtagttcacctggtccaaattctaaaggtacagaagggcacataatgaaaaaaatttcccttgacccaccttaagtcacctagctcctctcttcagagacatccaacattaccagttcttgtgtaaccttccaaaggtgttttctgcatttaaaggcaaatgcgttgtgttttttcttccctccctccttgttcccaaatgcaacgttctcaccacacagttctgtacttcccatgagcctggcagggaagttattgtttgtttccccctgttgtggggtctgaactgagaccttggcagaggggaccatcgccacttggttttgtcttcctcaacctgagtctcctggtcagggtgaatatggggttaggagcacactggggagggggatgggttaagtggaatttctttatttttccacctgccagagatcccctgagagaggtcatcttgcgggttctctccttcctcctgggcagggttgttgctttttggtcctgggccacctcacttatatggggctgatgatggcctgtaaaaggcctttgatagacaataaacccacatctttctgtgtggtttggcctacttttaagggtgccttcccagtatcacctcatttcattcttccctgagggcagacagggggatcaccatttttgcgaatatggagactggggtctcaggaggtggaatgacctgtccaaggtcacacaactctttagtggcagccagatttctgatgtctaagcctgatgcttttctccctacactgtgctatcaaccctacatcttttctgttgctctctgtggtttgacttgtctccagccatttttgcagcttttccttgtgctgggtgagctgacagtgacagacctttggagcctacagcattaggatgaggattaaaagtgcttgtgcccaggagggagggaggctggacctggctggggtctgaggagggatgagtgagctgtccccacagaggcagggggaactcatg

SEQ ID NO: 94950 - DNA, 1024 bp, Homo sapiens
tcattcttggtttgcagtgatattcttcacctttttcttcattagcccccagtctctcagccccttcctttcttcatttcttccctctcgcttcttcacttcagccactctccttgcacagttttcctgtcccaggcttctatcaaggccctagctgattgccctctccttgcctacatctgatctgctgctggagaaaataacatacctgcctggacttggtaacagcatggattatcctgggctttttgcttctctattcaaatgagattggtttgtgatttttttctctgtgttattttcctcaagttgccacatgagggttatacttgtttttttttggtaaaacagaaatgctttctgtcattacattgtttaaatagcatgagcattatttattctttaaaggtttgagagaattgggtcatgaaactatatagaccaggggcctcaagtgggagtagtttttgactactgtttattgcttctgtggataggaatgacttttcaaaaatttatcaactattatgccagagacatgaccagtcagaacagaaacctcaccaggtccagtggaagccagctggattaccatactggtgcactagccggatagcagcatggcttattgtgggctttcttcttttaatcaagattttaaaatctactacatagtctgcccgggcatggtggctcattcctttaattccagcgctttcggaggccaaggtgggctgatcacttgagatcaggagttcaagaccagtctggccaacatggtgaaaccctgtctctactaaaaatacaaaaattaggcctggcgtggtggctcacacctgtaatcccagcactttgggaggccgagaggggcggatcacttgaacttgatgtcaggagttcgagaccagcctgaccaacatggtgaaaccccatctgtactaaaaatacaaaaattagtcgggcgtggtggtgcacacctgtaatcccagctacctgagggccaggcacgagaattgcttgaacc

SEQ ID NO: 94951 - DNA, 1366 bp, Homo sapiens
caagaatactcacttggcaatggggacagttctggtggaggtctttgcgcacagtgcacagctctgggtgaggcagaacctggcctggtttcccggtcagcctctgggcattctcctctgccttctctagtgccctaaggcagtggtcacaggctgacggtgagagccagacacaacaatatcttgagagcagaggccacatctatccctttcacagccctacagagcagctgctatgtgccaggcaccattctagtgtttcataaaggtttggaaagtgagtaaatgaataattacatgcatggatgaatggatgaatgaatttatttcatgtgcatcccaaggcagatgatcccctcctccctctcaaggacctcctggcccttattgtctaactttccttgcttcttaatcagactcactctgtggggctcccctaccacccccaaactgggcttttcccatactctggggccaactgaccctcctttcattgtgtctctctagcttaagaaatgtgtgggttgggcacggtggctcaagcctgtaatcccagcactttgggaggccaaggcaagtggagcacctgaggttaggagttcaagaccagcctagccaacatgttgaaaccccgtttctactaaaaatgcaaaaattagctggacatggttgtgtgtgcctgtaatcccagctactcgggaggctgaggcaggaggattgcttgaacctaggaggcagaggttgcagagagccgagattgcaccactgcactttagcctgggtgacaagagcgaaactccgtccccctcccccagaccccaaaaaaagaaaagtgtgaaaaaagcatgtggccagcaaagctaagggcatcgtacttgtgctcacccctaactcagccttctttgaacaagggccatgtagcctcctcttggtggaggactccactttggcactgggccttcagcatgatgtccctcataccatggaatcaaactcgcctaagtcctgctgtgctccctcagggagcacatctgaagagcctcccaccacaggaataagcctcaaacacctgagactggacagaggcatggttctcaggcacagtccttcaatggaagacagcatttcctcccaacacccagagttccagagacgtcagccagtagggatgtatgcagctcacttccatgcacaaagacgactgggccatgaggagtaggagagatgtactcacctcggtagcgataaagtgcattccagagaaactgtgcagccaccaggggccgttctacgaagatggtctcccccttccggatgagctgtgtggcaaacagcccctttccctgagagggcagagggataggat

SEQ ID NO: 94952 - DNA, 1045 bp, Homo sapiens
ctcctgttttccaagtgttgttgaattggctatcttggctacaactggggagatggttgtgggtgggcagcattgggaggaagcctcaggcagaggaagggcccctataagttcctgtgtagtggtatttcccaagtgggcgggagtgccagtgagaaggtgggtatctgtgacccttaagtatgtttgttcactgcaggcgaaggacaaggaccgttggatcagactcttttcccagttttgtaacaaaacagccaatgaagaggaggaaattgtccataaacttctgggagacaaattcaaggttattattctcccgtggcctgtctccttccctccccaaatatcctaggatgtctctggccagctgtggggagcaccacatttgatcacttctgagctacaggaaggagttagaacttgggtccagaaatcgattcagaggagttacattcctgccactgtttacttcatgacctcatgtggacctacagttgggaagtggggtgacaacagaggaagggcatgtcagatgccttgccctgaaagtgctccctaactggtgttagaaggcaggactcgtcataggatagcagtgggcaaatcaggtagaatggggccgcagaatcagagagcagtgtgaaactgcccatgtcctgagaacccgttcccaatcaaagagtatgggtcctcactgaggacagcagacttccctgcaggagctgcctgagggtggaggcaggtgtgtacaaggtttgcatctggggtgggccctcttgcactgaacttttataggaagggagtgggagagcccagctggtctggaggccaggtcaagggagatttgatggtggtggtgtggatagacatttcaggctgcctcagccttgctggtacaagtgctggaaaatggagagaaatttgggtttgccaccccgggttggaacaggccggcagactgccaaagctctttggaggtagactctgtggccttcctttgcccctacggaaagctcagtctacagagctggccctttttccttcc

SEQ ID NO: 94953 - DNA, 1002 bp, Homo sapiens
cgtgagcagcttgacgccttcattgaccagctatacaaggacatcgaggcaggttggtgagatagggccttggcctcacccagccatggcgacccccccagtcagatggtggacacaaagtctttccccagggtgctctgaattaatggtgggggaaggtaatccctttgtgcctgtggggagcttcagatctgtccacagggcacacaggtgagaaacagccccaagatgtatccagaggcttgatgctgggaggaggggggtgctggataaataggatgtcttgtagacagaaaagcaaggcttctgtctcggagaggcaagtttaggtaagatggtagggactgatgccttagtgtggtggggttgcaggacagtggagacagtgcctgtccgtgtaagcctcgtttccttttcctgcctttaaaaatgggtagaataatgtgtgtgtattactgtcttacagcaactggagagtttcttaactgtgaaggatctggcctctttgtgcttcagagctgctgtgagtcatggcgttgaggagggatggtcccaggcgcttctgcctttgccaggtggccttgcagccacagtttatctttctcagttggccctttctaggctggtagggttgagtctgggagccccattaggtctgagctcccacaggaattcccctgggcctttttgttctatcatttttttcatttgttcatccaactgtttgtgctataatacctgcttatatataaaaccttacaataggccaggccctgtactaaggcaggcatagagctctgattcttgcaaagggatgcatgggctttgcaccgtcactgccttgtgagatttgggagtactgggagcccaggctacagggcgagtctcatcagcacctgatgagaaggggcagattcagctcagacaactgccttttccagacctcagcttcccaccccctggtttcctcactgcaaactcctcctcccaggctccagggcc

SEQ ID NO: 94954 - DNA, 1016 bp, Homo sapiens
gggcaggctgccccgggcgtgcagcaggcacaggtgggtgcaaaggaataccaattagaccaggtaatggtaggagatgggagctccaggctcaccagcttgggctcacctctactgttatttacaccctgctatgcaaatgttctaatgcccaagagcaagggtcctctgaggtccagtttgggtggtttttaaattttgagacagggtctcaccttgtcacccaggctggcatgcagcaatgcaatcatagctcactacagccttgaacttctgggcccaagtgatcctcccacctccgcctcctgagtagctgggactataggctcacaccaccacacccagctaatttttaatttttctgtagagatgggatcttgctatgttgttgccaaggctggtcttgaattcttggcctcaactgatcctcccacctcggcctcccaaagtgctgggattacaggcatgggccaccatgcctagccctgaggtccagtttggacccccagttccaggctctaagatgagtcttctcctgaggggctgaactctggcttcccagggcttccttggctcctagcaggaagctgtgctgggatctaagactagcagtctgagcactggtcccaaatgacctaggccagtcactgtcctctgtgggtgtttcctttcctcagaacgacagtatgggacgatacgagtgagtttgaaggtcctgcccacccgtgtgctcttattctaggacacagttgcaaccctgatgagaagctttattgctaaaaagtcagtgagggtttattgagtccccaaacaccagctctttaaaccactccaacaactgctgtgaaggtcactgtgcagagaccctgggtaggggaggctggagccaggtgagtgtgacaggtcacagatggctctcaggccacctgccttcagctccttttgtttcgggttctagccagaagccctggggcctgtctcttgcctcttcttgtagcatgagacacccttggggg

SEQ ID NO: 94955 - DNA, 1087 bp, Homo sapiens
cctcttttgcttgccgcctctgtcctcgcccagatccccagcttaggggcgaccccagccagccgcggcctggctcggcccgagcacggcgctggagccgttggcgagggctgcgtggggctttagaggagtctctgggctggccggttggggactacaagtcccagggtgcttcgggcccgcgaacccacgtcggggacctcttttttagccccgcatgatcgggacttgcgtgaaacgagtgcaggtcggccgtggttacgcggtcggcagctagacttggaagctggggctgctctgagatttgcgggctgtaaagacgtgtgcttcttggaaccggcacaggcacattggggacctcatattgtgcccgcctagggactcactatgttcactcgctgaccctcaccgcagcgtgcagagaagcagacgccttccctagtacttttaattcattcactcattcgctcagtcattaaataaacgcgtctttagtgcctactgaatgtaccaggccctggtggttgctgggggttgcagcctctcagccaggagaacgggaaaggtagatggagacactgtatcggaggtgggaagacccaggctcggactctggtgacataagaaaggcttttctagttggctacctaactctgggtctcgttttcttgaaatttggggcgagggagttgctgtgagtcctggagccacctaaagtgctccttgtagccctacttcccacacttcttttctctgtctctcggagctttagatactttccgtgggtcccaagcctcgatggtatctcctgggttgttattgagtagggccagcttccgaggtggtgtttgaccctgactgagatactgctttctgtgcacttggcagttcacttattcattttggcctgtccgactctatcttctgctcttttcctgcttcctgcagcttttctctgtcctgttagggacgcagacaccttttaggtgttctaccaaatgccctatgaatcccgcttgtacccaaggtagaaggaaattagcatttaacagtacttcctctcccctttatgtctctagcattgctc

SEQ ID NO: 94956 - DNA, 1504 bp, Homo sapiens
gaaagtagtctggtttgctaagctgagaaattgctctctctgctaataatggtggtcactagagcaaagatatctgagcgggccctttaaaacaagcaagtatccctgtttctcagtttctaaagcaggtctgcaaatgaagcccttacggggatagggaatgttctggagaccaatgcaatatagaaagaggaaaacttctttggggtatctgattggaaattagtcacacagaagctttattcagccagcatgagagatggaaacattgctgtatgaattagatttgccatcatttttcaaaacagggcaaaggtgctgtttgtttctctgcctgttttcctacactgcagctgaacatcactgttacataaagctgactgcctaggcatctctaggacaacacctcaagctcttggcatcttgcattttgcatcagtgtcccatctgcttctctaagattgagctgtaacacagacaagtggatgttttgctgcggaatgaacacttagcagggtctgcctcttcctcctgtgttgtgacccaattcctcagcacagggagtaaggtcagaagttgaaaaggccatggtcattcagctgggtactggagaactcatgattttttcttttagattaggtcagtgcttctcaaaccattttcctgtctagcatacctgcagggtaggctaaatttgatagtgtctctggaggtagaggctggttggggaatggatgtggtagacagttgggggaatgtggtttaagaagacctctagataattctgttaagggagagatgggagcattttcccctttcccctgccagtctcattataatagatgattattaaaagcagttaatttctttcttttctagcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggtaagtctacagagttcctcaggcctgtgtgcaggaaaggaggctcctgagggggtgtttgggactagcataggttggtatcagaaatcccactgcttttaagatcgttgaaagatgactcactctgaagcagttccaattcttatattgtcctgactgctgagcccgtgtgggactatatgagagaacctaggctcaggagcctgttgcctcatagggagacgtggcctagaaacatgaaatagaaccatctggagtttcctgtgttcacttccattgttatcaagatgagaaaattcctgtttatatcttggtatattaattgatgtgtgagggtatcaactgtggtaagaatatctaagtggttacttttatttaaaaaatcttttctgtatccagttgacctgtattaattgctcttcaaggaaaattgggagtctgtggtctgcaaaagcttgtgattttagaccc

SEQ ID NO: 94957 - DNA, 1755 bp, Homo sapiens
gtcagcctggtagactatgatgtagacatagtcttttagtaaggactaagagactcatggcatactactactacatgctatactcaagcacctcatggtgtatattgagacctagctattatttgccctctaaccttcatttgtgatctggggcaagtcatttaatctttctaggccttactttctttgctatctctaatttgagtggtgacattaaaatgaaataatatatgaggagtactttggaaaaaaataaaaagtttatatatttgtatgcatattttatatataactaatatataaagtgctagaagttgtcgtaggtgtttttagtaaaccaggaggtttggcttaatctcgtgtcacagctgtttccactcattcgttgtagcgtgttacctgcagacccagagcaaaatcttggaagcaccctgattcttcagaactgtatacccactctgcatttctgacttggaattttctgaactatagagttttacatttttctgagcagttacaagacctagaagtgttttttcagctgtagagtagaaatgcttaggatttgggagtgaacagactcaggactattgagagattgaggtccacttcagcagtttgtctttagcatgagagactcattcaacttctgttcttggcaggcagttaacaagatcaaagagattgctgtgaccgtgaagaaggcagataaagtgtaagtctgtagtgggtttttttttttttttttaaagagacggagccttgctgtattgcccaggctagtcttgaactactggctcaagtgatctcccacctgcgactcccaaagtgctgggattacaggtgtgagtcaccgtgtcaggcctttgtcagaaccttgactgacttcctgtggccaaattggatgcagaagcatgctgcaatccctctatgtgcctggggctgtttggctcctgccagacccttggctgtgtcccagcccacagagcacaaaagaagctgtcgactgtagtttaaaagctgccacatatgagatctttgactgcagtcaccatctgtcactgataatctgccctaaagatacaaaaggtgaagttggagagggctgagtttagagactggaagggaactacctccacactgtagtagaatcagataagagggatttggttttcaagacctgatgcagattctgcccttgtgtcccagggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggtaagcctgctgtggccttcctagacagctcttgctttcatattgacccttcagacagcttcatatggcagaggggtactcattacaggaataaagagaatgcatgttaggcaggaagtcagacttacattgtactttccatactgccattagaggctgttactagatgaacttggtaacctctgtggatattatttgtcagcagagtagaaaattggactgtatgattttcagaatctcaggttctctgtgtcagtgggtggtggaggggtagtaggactagctcaaatcatcaatgacctcccaattaatacatctgagagggatttttcagttcactgcttactcctaagtgatactgttaagcttgccct

SEQ ID NO: 94958 - DNA, 1014 bp, Homo sapiens
atccattgtacttatttactatttgcagggtgaagtttcctactttattcttctgcgtaaagccttctgatatctacattccctatacaaagccaggcattaacaaagcctgtaagatccttctaaactggcccctgcctacttcccctctctcttcttcactggctggttcttaccctctaaattctagcaacttcaaatggcttttcattctctgattccacaacactgcctcccacctcttaggagaaccccttttttccttttttctctttgactaatttctgctcatctgtcattcagctcaggcatcactccctttaggaagctgtggatttgaatgatgcaggaactggggacagatactcttcacccatgggttacagtattatagattagaattgtagatgagcactggcagagaaactaaaggttattgaactgaatacccttttttatggtgtgggaaatgactcggtcatttagtaaggaaaagatctgagattggaacctaagtctcacggtagtgctgagtcagccctgggtgcagtgtgctttctattatgccctgctgttaaatccaacccacagagaagctctgttgcagaacaagtggtagaagatccctaccttgagggattgaggtctgaggagctgcagtgatagcttagaaattatgcaggggatttctgattcttaagaccttttggcatcatcttctggagggaggaagcgtcaaggctatagtatccatgctgttgggggtgtgggggtggagggtgcagtgcaaattatgggtacatggaggtgtacaggaggatacttgagatttgggagctggggcatagaagagggtagcattgcacagcttttgttttgccttctttgtaaacacctggctcctcttctggcatactttttggaagtttgtacagcattatccatcggccagtgctgcagaggccagtcttagaggacagcccagtaggcctttaccatgctttgcctctgcta

SEQ ID NO: 94959 - DNA, 3346 bp, Homo sapiens
tcaggtgatctacctgccttggcctcccaaagttctgtgattacaggcatgagccactgtgcccggccaaaggggtcttattgggaactccatgaatccagcacctcagaagagtctagacctcagccagtttaaactatttctcgcatctggacagcaccagctgtggttctcagccttggggttactttctgcttttgtgttggggagtttcaggtgattcctaagtcatctcatggggtccttatttgcttggactgaggagtagctattctgtttatctctgttaattcccagatgaatcagcatgttttatttggtgggggcagatgggtatattttaccctaccgtatatgtcaaccttcaccccaaagcattctcatccttttctgggtctctccaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggtaaccagattttcacaggctgcttctcggcctttgtggccctgaagggttttcactgacccctggtataacagagtgtactgtcaggttggcgtgtgaattgagccctgttttttttttttaactcttttttttccaggacacattccatttccatgtgtgtgtgcccagtagcacaaactactttagtctaaccaaaacaagtccagaaatctggtttgtgagagaacctagcagtaatgctatgattagctggacaaactcaaatattgattcttccagccagattttttccctttcatgagcatcccacaaaagatacttttaggtttaaagtactcctgagttcagttgctggacccagtgccaccctagtttaggggagggagtataagctgaattgaatgggtccctatctccttttaacttcttctgtttgcctttgatgtgttttagttctattttgttttttttttgctctttcagagagggggaagggtcgcctggaagtcaagggaaagggcgggtaatgtagaggctctgggggcatgcgtgggaattggctttgagacgaggtggcaggaagctgcctggcctcgggaaccttcactgctagatcttgccttccttgctccctaggcctgtggaggctcaatccagaccagtgtgaatgctctgtcagcagatgtgctgggtcgatgccaggtgtttgaagagacccagattggaggcgagaggtgagccgtgggcccaggccgagctcacaaacctgcctgggtctggtcttctgccatcttttggctgtggtatacagcttttacaaagtctcacctttgtgtacaaagtggtatacagcttttacagagtctcacctttgagccataaagagctcagataatatacaggattacaggaagatctaaaagccttgactccacaatcttttatgccctagtggtacagctgcagacctttccaagaaaatgtctataaggttgggattgggtaacctgagtgaagaatgtaagagcagctgctgagtgttgggggggctggcagtgaggacaatacagtaggatggtggcagacaagagttcatgtgtgtactgtttaatcctgggcataggtacaatttttttactggctgccccaaggccaagacatgcaccttcattctccgtggcggcgccgagcagtttatggaggagacagagcggtccctgcatgatgccatcatgatcgtcaggagggccatcaaggtactgggctgatatcctcctgcttgcacagcctactctctcctatctccctagctgatcagaccttggatttgtgtggtgattccttctctatataacctgccctttcctgggtggtgtggtgagccctgatttgccccacaaatggtagagaaactgagcctcagtttctcaaaaataggtcatcctgccttgaaagctaagacttgttcttttagccgggcgtggtagctcacacctgtaatcccagcactttggaaggccgagatgggagggttgcataagaccaagagtttgacaccagcctgggcaacatagcgagatcctgtctctacaaaaataaaaaaattagccaggaatggtggcatgtgcctgtagtcagtcccagctactcgggaggctgaggtggaaagatgccttgagcccaggagttggaggttacagtgagctatgatcacaccactgcactccagcctgggcaacagagcaagcagaagaaaaagacttcgttttgttagcaaactggagctaatgtagtcagatattccagtaattgtgccagtgtccttgagctgcaggtgaccttgaaaatagtcagaaaccataaggttcaccaggttgaagttgggatgttctagataggggctgtgtctgggcgtttggggcttgggatggaggaaggaatgaagaaccactctttctgggctgaagggacctactgagtggcccagcatggaagcttggaccaggggccctcttacattgagaggtggtctgatctctgcagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggtgggtcctttctctccccagggttcagggtttgggcgggtggggctagattctgaatgtgagctgtgcttactcaagctgtgcacgcctggcccaggagataggctgcaactccccccagcctgtctgcctgaccaactccctcctctgagggcagaaggaaagccatggtgctagcacaggagatccagggtttcttcattgcttctaccaagagtatgatcgtggccaggtgcggtggctcacgcctgtaatcccaacattcgggaggccgaggtgggcggatcatgaggtcaggagttcgagaccagcctggccaacatagtgaaaccctatgtctactaaaaatacaaaaaattagccaggcgtggtggtgggcacctgtaatcccagctactcaggaggctgaggcaggagaattgcttgaacccaggaggcagagcttgcagtgagcagagatcgtgccgctgcactccagcccgggtggtagtgtgagactc

SEQ ID NO: 94960 - DNA, 1361 bp, Homo sapiens
tttgttaagtgcttagcacccagtgaatgaccctgcttctggcttgtattaggacttttgcttaaagtcactttacctctgtgtctcacttgcctcatctgtaaaatcgggctatttgaagcaatgagatgaaagatgggatagtatttttgttattcctgtttatcttgagaactcattgtttgatatatatatatatatatatatatatagtcctcaggtgacctgaggatggggccgccccaaaacacaacagcttgcctgggagaagatcccagaggtcttgtgtggtatgtccagggctaaggggaggagttggcgggagtaggggtgtttccaggttcctggcatgctcataggaagatgcagtattcttcagcgaaatgccaccaagttcagagagtctgcgggttcctagcagtgtcttttggagtaccagtttacaagaggaaagttgaaagtagttccatattacctcctttcttttcctactcttttaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttcagataactttgtaaattattttggcatggtactcataaatgtctggctgtagctcagaattttagctttacatgcacttgtccaacagggagacaagagcatcctggggtgagctccactagagtggcccgtctggaagtttcactgtggttgcattctttgttccagaagtggctggacaacacgcagttgctttcttctggcatcatcttatttagccctggcctagccagacactgctctcagggtttctctggtttgagtaaatgggttacattaccttgtctgccccttctatctccatattcttttggtttagtcttttgttccctcttactcaagactgtgagaagggtgttttagggagggcttatgctctctaaactctagtgatcccttggaagtctactaaggagacgactgaaagcacccacctagtcttttcagttcagcccccagtgatcttggtccttctgctttcttgtgaccaatggga

SEQ ID NO: 94961 - DNA, 1103 bp, Homo sapiens
ccatgttggacagagcagataatggaacagttccatcatcacagacagtgaaggtgtagagttttgtcactaatgagcagtagttgttgttttgtctggtgaatattccagggggtacttaattcattgaacatgtattattagaattcaccatgtgccacacattgtgctgggtgctaaggaaagcttggtgaacccaaacatttttggtctctgccttccttgtgttcatggtctagacagggaggcagacagatttcagatgatcacataaagtgaaactaatatatgtgctaatattctatgaaagcataaagtaagataatctggccttgtcagtgaagttgggaaagccttcttgaggaggttatgatagagctgatatctgaagacagtttaaggttaatcaggcaaaggggagggaaagagccgtctagctgagggaaaaacacatgaaaaggtactgttgatgagagagagcatggcattttccaggacccagaagccaacgtggtttgagcacagactgcaaggctttgtgtgctatgccaaggatttaggggctttatctctggagctttggggagttgaagaaaatatttgaaacgaggggatgtatgataagttaggtgtttcagaaaggtcaggtgtatagcagagtgtggaacagctgtgatagcaaggtgggatggggagcagtagccataggtcaagggcataaattaggagaccattgcagcattgcccggcaaaagatgatgaaagtttggaatagggaagtgttggtggatacagggaaaagtggactgatttgagagatatttaagaggcaaaatcatcatacttaataacggatgggatgtgaaaggtgaagtagccaggtgttaggttattgtttgaatggttgtgccaatattaagatatggccagatttatggtggaggtggtggctgtgagtgggtggtggaattggttgggtgagtcttaagattatgagtttggttttgaagattgaaggagaaggctgggctagagatttcaagttgtaagtcatttacatagagaccataattaaagccacacttgttgactaggtcttctaa

SEQ ID NO: 94962 - DNA, 1055 bp, Homo sapiens
aatccagtaaacagaaaataacagtaccatgggatttgtattataatggtgtagagcaggagtctgcaaactatagcttacaggccaagtcttgattttgtactgtccatctgctgagaatgatttttgcatttttaaaggattgtaaaaacaaacaacagtagtatgtatgaccaacaaaaccgaaaatatttaccatctgaccctttattaaaaaaggtttgctaactcctagagtttaaaatggatacataacttaaagggaagctatttttcaaattgatgtaaaaaagagctttctaatagagccatttaatactaaaaaaggctatataacaacaacaaaaagtgagcttcatgtcactgcaaaatgtctagcaaaattctgtattaggattttagcactggggaggagattgtacttcgtgacctaaaatgttttctaatgtaaagttttataactctggcttctcatttactatagttagggcagaacattttaaattattggagtagattcctggatctcataggcagaggaaattttatcattgctgttttgttacgcataagtactaacattgtgataaataggctctcgccaatggcaaatgtaattgatgatggctggtgccagaatggttagatacctcaaaaaagagggatgcaagccagtaacagatatccacacttgaggaaacaagaagcagttgaaagctgtaagaaaaaggcatggcaagtaaaatacaccaccttcccatcacacacacacagataatgttgtacacttgagaatcattaactcttcagctttggcctgctcctttagcaaatacatttgcctatttatgtgatttaactgtccaactccaccctgagatattcttaaatatttaaggagatgctgaaatgctgcttgtaacttacttgttacttactattccttacttatacttaaatagctattttaggtactgaggatttctgtaggttctgaaacctagttagggttaactctaattttttttgagaaaagactgtcagattctttaaat

SEQ ID NO: 94963 - DNA, 1001 bp, Homo sapiens
gaagacacgaaaagatacacagtggcctgaaaacaatttagctgataaagatcaagtttcagttgcaacttcatttgacataactgatgaaaacatagctactaaaagaagtgaccattttgatgctgctcgttcatatgggcagtattggacacaggaagattcatctaagcaggcagaaacatatttaaccagtaagtaccctgattctttttcagattcatctgacacaattgataaaaataaaattcccaagggaagtaacaattttagtgtccccttttcctatgtgccatggaacaaagagggaactttgcaccacccagaaacgtgtgtaatcagtaaggactgtttttcctttccatgtgaagttgctgctcatcatcatcatcataaaatgtcatattctttcttgtgttgtttgttggaaagaagaggaaaaggggttcccttgacttctgatagtcattattttgagaatgtttatttaagggctccagctgagattgaggtgaaacaaaagatggattctttggagggttatgaaagaaatgaagaaggtttacagaaagaatcatctcaatgttttgaactaacggagactagaaataatttagtatcttcagaagtgcaacccagattcttagaaatacagtatattaggaatgttatagctcctgataattctgtaaaagtttcagaagcacatgtactctccaggggacataatacctctaaaatggaggcttctggttggattgttatatccaacttggatgagatatcagaacaactgtattttcaagaggaaagaaaccaaaagggaacttctctttttggtgagaaaaatattgatgctgctgaaaatatagcctttgaggcagttattgcctctattgagccttctaagaaagagagtacagtaaatgaaatccaagctgacatcaataaatatttaacagatgacagccgagagagagccaaaaaatccagatctttct

SEQ ID NO: 94964 - DNA, 1079 bp, Homo sapiens
catctacattaggtatttctcctaatgctatccctcccctaaccccctaccccgcgacgggccctggtgtgtgatgttcccctccctgtgtcattcttttatagaaggcttttatttgcttggatccttggatcccttggcattaatgttcctctggtcccgttgaatgaatatcctcttttgttgtctggtactgtaagtcccaaggtgggccctacttccttgtgatatagccttatatcctgttattcattaaatacagttagataaaatagtgatgtacttaatgttacttctcttttcctatgtataagattggtatgtttttgtaaagctctattagtttgggttacaaccacatttagacctttaggttcagattgttggtagaaaatgaacaaagatattatgatgaacttttatttataatttattacatttattaaagtttttttaacacagaatcactaggtttattttcttcagtattccaaactaggcattttttaattttaatctgataactggggatgaaaatgatagttaacactttgtgctcaagtactgtgctaagaggttacatgtatatatcaattcgtttttgtcctctgtcaatcctatcaaatagaattgttagagattattatcatccctattttgcaattgacacttagaggatttaggaacttgctcataattattcagcaattgggggaaccagtatttgaaactaaccatatctgtgtacttaaccaccataccataaactgttccccctccccccaccttttaactattcttggtgaaactaaggttaagattttgcattattttggcaagagtagaggttttgaaggagattgcctaaagttgagttcaataacaatgagaaacaaagtaacaacttttaaagtgttctaaatttttaatactacttttgtgacttacatcaacctttcatgtagataaaatgtattttaaaaataaagatatataggttcagttaatgtgcagagactagctttgaccactgctccaaattttaatctgtccttaaatatagcctgaagtattattct

SEQ ID NO: 94965 - DNA, 1048 bp, Homo sapiens
gacggggtttcaccatgttggacaggctagtctcgaattcctgacctcaggtgatccacctgcctcagcctcccaaagtgctggggttacaggcgtgagccaccgtgcctggcctaatatgctattttagtacctcttgttttggccatttagctctaaaaattatttaaggtttaagccttagatttcttttctctccccttcatatccccccacctttggagacctagttgcctgtctctgtgtggatgattatcacctctgtttttataccctaatatttgtctaatttattttgcatgttttcttgtgaacattgtcatcaccccaaattcaacttgctctatagcaaaataactcatgtttttcctaaaattagactgacttgtagagttcctgagtttttatgaaaggtattagtatttttctggtttcttggtcatctttcattctttcttcattattgattaaacattgggaagataaacgaatcttgatttctgttttctcctggttctttccattttcaattagcaatgaagatctgctggtttcttaaataaatacttctcatatttttcattttacattttcttttgtattacctactttttttttttttttttgagacagagtctcccactgttgcccaggctggaatgcagtggtgcggtctcagctcactgcaagctccgcctcccgggttcacaccattctcctgcctcagcctcctgagtagcttggactacaggtgcccgcccccatgcccggctaattttttgtatttttagtagagacggggtttcaccgtgttagccaggatggtctcgatctcctgacttcgtgatccgcccgcctcggcctcccagagtgctgggattacaggcgtgaaccaacgtgcctggccggtattacctactttaatagttctatattttgaaactttaacataatgaaatttttttgacgtcaagcttgtaataaaaatttttctttctgtgtttgaaagctgtagaagaaaaactgctgtaaactataaacacacact

SEQ ID NO: 94966 - DNA, 1079 bp, Homo sapiens
cctagtgttttgtacccacaggtgttatcagacagtcatctacctgaagagagtctgaaagtttcagccttccctggaccagctgaccagatgactgacacaccagcagtaccgtctactttctactcacaaagagagaagcctggtattttctaccaacagaccttgccagagagtcatctgcctaaagaggctctgaaaatttcagtagctcctggactagcagaccagaagactggcacaccaactgtaacctcaacttcctactcacaacatagagaaaagcccagcattttccaccagcaggccttgccaggtactcatatacctgaagaggctcagaaagtttcagctgttactggaccaggtaaccagaagacttggataccaagagtactttctaccttctactcacaaagagagaaacctggtattttctatcaacagaccttgccaggtagtcacatacctgaagaggcacagaaagtttcacctgttcttggaccagctgaccagaagactgggacaccaactccaacctctgcttcttactcacacacagagaagcctggtattttctaccaacaggtcttgccagataatcatccaactgaagaggctctgaaaatttcagttgcctctgaaccagttgaccagacaactggcacaccagctgtaacctctacttcctactcacaatatagagagaagcccagcattttctaccaacagtcgttgccaagtagtcatctaactgaagaggctaagaatgtttcagcggttcctggaccagctgaccagaagactgtgataccaattttaccctctactttctactcacacacagagaagcctggtgttttctaccaacaggtcttgccacatagtcatccaactgaagaggctctgaaaatttcagttgcctctgaaccagttgaccagacaactggcacaccaactgtaacctctacttcttactcacaacatacagagaagccgagtattttctaccaacagtcgttgccaggtagtcatctaactgaagaggctaagaacgtttcagcggttcctggaccagg

SEQ ID NO: 94967 - DNA, 1031 bp, Homo sapiens
gaagcctggtagtttctaccaacaggtcttgccacatagtcatctacctgaagaggctttggaagtttcagttgctcctggaccagttgaccagacgattggcacaccaactgtaacctccccttccagctcatttggagagaagcccattgttatctacaaacaggcctttccagagggtcatctacctgaagagtctctgaaagtttcagttgctcctggaccagttggccagacaactggcgcaccaactataacctctccttcctactcacaacatagagcaaagtctggcagtttctaccaactggcattgctaggtagtcaaatacctgaagaggctctcagagtttcttctgctcctggaccagctgaccagacaactggcataccaaccataacctctacttcctactcatttggagagaagccgattgttaactacaaacaggcctttccagatggtcatctacctgaagaggctctgaaagtttccattgtttctggacctactgaaaaaaagactgacataccagcaggacctttaggttccagtgcacttggagagaagcccattactttctaccggcaggctctgctagacagtcctctaaataaagaggttgtgaaagtttcagctgctcctggaccagctgaccagaagactgagacattaccagtacattctactagctactcaaatagggggaagcctgtcattttctaccagcagaccctatcagacagtcatttacctgaagaagctctgaaagttccacctgttcctggaccagatgcccagaagactgagacaccatcagtatcctctagtttatactcatatagagagaagcccattgtcttctaccaacaggccctgccagacagtgagctaactcaagaagctctgaaagtttcagctgttcctcaaccagctgaccagaagactgggttatctactgtaacttcctctttctattcacatacagagaagcctaatatttcttaccagcaagagttgccagatagtc

SEQ ID NO: 94968 - DNA, 3784 bp, Homo sapiens
atcaacagtaacctctacttcctactcacacagagagaagcccattgtttcctaccagcgagagttgccgcattttactgaagcaggtttgaaaattttaagagttcctggaccagctgaccagaagactggaataaacatcctgccctctaattcctacccacagagagagcactctgtcatttcttatgagcaggagttgccagatcttactgaagtaactttgaaagcaataggggttcctgggcctgctgaccagaagactgggatacaaatagcatcctctagttcctactcaaatagagagaaggccagtatttttcatcagcaggagttgccagatgttactgaagaagctttaaatgtttttgttgttcctggacaaggtgaccggaagactgagataccaacagtacctttaagttactactcacgtagagagaagcccagtgttatctctcaacaggagttgccagacagtcatctcacagaagaggctctgaaagtttcacctgtttctataccagcagagcagaagactgggataccaataggactgtctagttcctactcacattcacataaagagaaactcaagatttcaactgtgcatataccagatgaccagaaaactgagtttccagcagctacccttagttcctactcacaaatagagaagcccaagatttcaactgtgattggaccaaatgaccagaagactccatcccagacagcttttcatagttcctattctcaaacagtaaagcccaatattttatttcaacagcagttgccagatagagatcaaagtaaaggtattctaaagatttcagctgtccctgaactaactgatgtgaatactggaaaaccagtatctctctctagttcttattttcacagagagaaatcgaatattttcagtccacaggaattgccaggtagtcatgtaactgaagatgtgctgaaggtttcaacaattcctggaccagctggccagaaaacagtattaccaacagctcttcctagttccttttcacatcgagagaaaccagatattttctatcaaaaggatttgccagatagacatctaactgaagatgctctaaagatctcaagtgctcttgggcaagctgatcaaattaccggattacaaacagttccctctggtacttactcacatggtgagaatcacaagcttgtttcagaacatgtccaaaggctaatagataatttgaattcttctgactccagtgttagctcaaataatgtgcttttaaattctcaggctgatgacagagttgtaataaataaaccagaatctgcaggttttagagatgttggctctgaagaaatccaggatgcagaaaatagtgctaaaactcttaaggaaattcggacacttttgatggaggcagaaaatatggcactgaaacgatgcaattttcctgctccccttgcccgtttcagagatattagtgatatttcatttatacaatctaagaaggtggtttgcttcaaagaaccctcttccacgggtgtatctaatggtgatttgcttcacagacagccattcacagaggaaagcccaagcagcaggtgcatacagaaggatattggcacacagacgaatttgaaatgccggagaggcattgaaaattgggagtttattagttcaactacagttagaagtcctctacaggaagcagagagcaaagtcagtatggcattagaagaaactcttaggcaatatcaagcagccaaatctgtaatgaggtctgaacctgaagggtgtagtggaaccattgggaataaaattattatccctatgatgactgtcataaaaagtgattcaagtagtgatgccagtgatggaaatggttcctgctcgtgggacagtaatttaccagagtctttggaatcagtttctgatgttcttctaaacttctttccatatgtttcacccaagacaagtataacagatagcagggaggaagagggtgtgtcagagagtgaggatggtggtggtagcagtgtagattcactggctgcacatgtgaaaaaccttctgcaatgtgaatcctcactgaatcatgctaaagaaatactcagaaatgcagaggaagaggaaagccgggtacgagcacatggtaagaagaaagtttcaggcttataaacgttatagtttaataatgtgtttaaagttagatatttatgttttgaggaagcttagccaatgaaaaatacaagcaagatcaagaaaaaaaatgaagttagatatttggagttctaaatgtattttccaatagaattgttagaatgactatatttcttctaacaatccataaaaagcctatttaaccaataatgtagttaagttacagtattaatagtaccagcctgagtttacgttcttgttcttaggagaagtagattctgatgtatgacagagagtaaagaggtcgcttgggctcctgagctcctaaagctatcacgtttctctaatcctcccattatagtatccttattctgaaggcagaaagagcctccaatttgctgtgctctaaattgctttttgtcctaaaactacatatattttctctttcccttttctaatagaactcttggtgttgatctcagacatttgaaaaaaaaatcaatgtattttatactaaaacttgggttagaggtttaaaagagaatatttacaaatctcattaatttctaatagaattccattaaaaacaaaaatctgtaagacaatatggggaatatattttgggaggcaatttaaaagcaatttaggcctacctagaaatcgtcccttgaggttaacttcctacgctgttccctgcacatttttattctacaaaaaaacctccaagttgtatttattacttttaaatatcagctgtcatggaattatgagtaattgtagcaggaactaaagggagaggtaaagaaactcatgattaaaaggaggattaagataaatatgattgattacccgatttaaagtggcttttttgtagaattatctatagagcatgacttaagaaaatcagactttgcagtgaaaggatctctgtcaagaatttctaataggttgtcataattgagaagaagacatactaagcattgcagtgggtattaaattgcatatattgatgatcttctgtgttgcaattgttgacaaattatcacttttgcattgtattatctcaagtgtatgctttctctccagcctggaatatgaagttcaatttagcacatgattgtggatactccatttcagaattaaatgaagatgacaggaggaaagtagaagagatcaaggcagagttatttggtcatggaagaacaactgacttgtccaaggtataaaagaaatctggaaatgaagaaagtaaatatgaaagaatgggtgatggaattaggatctcttacttgggcatcagttgagttgctgataatatttggctaaagccttttttggttttgtttttgagacagtcttgctctgttgcccaggctgaagtgcagcagtgcaatcacaggtcactgcagccctgaactcttagactcaaggaatcctcccacctcagcctctcaggtagctgggaccacatgtgtgtaccgccctgctcggctaatttttaaatttttggcagagacagggtctctacgttgcccaggctggtcttgaacgcttggattcaagcgatcctcttgccttggcctcccaaaatgctgggattacaggcatgagccactgtgcctaggcagg

SEQ ID NO: 94969 - DNA, 2717 bp, Homo sapiens
ggtggtgatattgggggaacatgcaggtcaagaacttgattttaaggacaggaagcagaagttgtacttgatgccttcattcatatcccattggtgtcagtctagtaatgtggttacaactagctgcagaagaaacaggaaatgtctcccacttggtggctatgtggccagcaaaaatttgagtaaggcatttctattattaaaagaaaggtgagaatacttactggtggacaatagtaatctttgctgtttactttagtggaaattttttagaagaactctctgagtggtcttaatcattgtgagccattttattctgtagttaactgtcttttttgcttgctgtgctctttgtcctgttatattataaaagaatgacatgaccttcatggtctaatcttagcgtgggtataaaactgatttgtataaaactgatttgtttataactacttggactacttcaaataagaacctgtttgtttgtatcttctagggtttacagagtccacggggaatgggatgcaagccagaagctgtatgtagtcacattattattgagagccatgaaaagggatgtttccggactctaacttctgaacatccacaactagatagacacccttgtgctttcagatctgctggaccctcagaaatgaccagaggacggcagaacccatcatcatgcagagccaagcatgtcaacctttctgcatccttagaccagaacaactcccatttcaaagtttggaattccttgcagttaaaaagtcattccccatttcagaactttatacctgatgaattcaaaatcagcaaaggtcttcgaatgccattcgatgaaaagatggacccttggctgtcagaattagtagaacctgcttttgtgccacctaaagaagtggattttcattcttcatcacaaatgccgtccccagaacccatgaaaaagtttactacctccatcactttttcatctcaccgacattctaaatgcatttccaattcctctgttgttaaggttggtgttactgaaggtagccagtgtactggagcatctgtgggggtatttaattctcatttcactgaagaacaaaatcctcccagagatcttaaacagaaaacctcttccccttcatcatttaaaatgcatagtaattcacaagataaagaagtgactattttagcagaaggtagaaggcaaagccaaaaattacctgttgattttgagcgttcttttcaagaagaaaaacccttagaaagatcagattttacaggcagtcattctgagcccagtaccagggcaaattgtagcaatttcaaggaaattcagatttctgataaccatacccttattagcatgggcagaccaagttccaccctaggagtaaacagatcgagttccagactaggagtaaaagagaagaatgtaactataactccagatcttccttcttgcatttttcttgaacaacgagagctctttgaacaaagcaaagccccacgtgcagatgaccatgtgaggaaacaccattctccctctcctcaacatcaggattatgtagctccagaccttccttcttgcatttttcttgaacaacgagaactctttgaacagtgcaaagccccatatgtagatcatcaaatgagagaaaaccattctccccttcctcaaggtcaggattctatagcttcagaccttccgtctcccatttctcttgaacaatgccaaagcaaagcgccaggtgtagatgaccaaatgaataaacaccattttccccttcctcaaggtcaggattgtgtagtggaaaagaataatcaacataagcctaaatcacacatttctaatataaatgttgaagccaagttcaatactgtggtctcccagtcagccccaaatcactgtacattagcagcatctgcatctactcctccttcaaatagaaaagcactttcttgtgttcatataactctttgtcccaagacttcttccaagttggatagtggaactttagatgaaagattccattcattggatgctgcttctaaagcgaggatgaatagtgagtttaactttgacttacatactgtatcttcgagatcactggaaccaacctccaaattattgaccagtaaacctgtagcacaggatcaagaatctttaggttttctaggacctaaatcttcactggatttccaagtcgtacagccttctcttccagacagtaacactattactcaggacttgaaaaccataccttctcagaatagccagatagtaacctccaggcaaatacaagtgaacatttcagatttcgaaggacattccaatccagaggggaccccagtatttgcagatcggtgagtctcattgtgataacaagcaagctggatggactttgtaataaagggtttcaaatacttaagtagatatcggttcttgggggaaaggccgtgtgatttctctgagtggaggttgtgtctggctaattactagaagtctttcaaggaataaatgtgttaagtaagagagaacatgtgacagtaatgcatttatatttcagagggcttttggcaagacttgacatcaagtgtttttaaaaattgaatgaccttgaaaagaatctttgatcatccaatgatacaattacgaatttatttactgtgttggacatatgctgaagatctcctttggaggttgcacacacatacatgggtgc

SEQ ID NO: 94970 - DNA, 1137 bp, Homo sapiens
gtgtatttagcacagtcccctaatttatggtggacatctagtaatttaaaaaaatgtattttcaattcagctgaaaaatagcatttcctcaactaaattatataatttaacattctaaattaaaagtaggttttaagataaaagtaaacatgtgtgataacattgtatcaaacaaaataaagggtactgctgaaattttaccttaataacgtttgacattgatgtgtccacaatatattcctatagctacttaaatattccttgaaaccacttttggaaagagatttcagtctctaatggccaaggatataatctgctgtattctttctcttttttggtcagattaccagagaagatgaagaccccactttctgctttctctgaaaaattgtcatctgatgcagtcactcagataacaacagaaagtccagaaaagaccctattttcatctgagatttttattaatgctgaagatcgtggacatgaaattatagagcctggtaaccagaagctacgcaaagctcctgtcaagtttgcctcatcatcttcagtccaacaggttactttttctcgcggcacagatggtaagagaatgtgattgcattttagattgttagaccagctcttttgtgtagttatcttagaaatttgtggttgtgtctttctagtcagaaaacctaattttaatttaagaattagggtccatatgattatatctgtcttttatttgcatagctgtcaacagaatatgatttattatattttatcttaatttcaagcacagttaacatgtagaactcatgctgtttgtgttaaaacttagttttgtctcatcatatttgcaataaaaatgcaagtagttcataacaacttgaaagtaattgaggtctgcttttaaaatggcggataaattatcttgtattacagtaacagtaatgttattactatatagtgcgtatatagggagagtatgtatatactaaatactataacaaatagatgcataaacatgtgatagtgcaaacacaatagcagtttatctcttacttataaagcaatcaccagagacccaggttgtcttcttgctctgttttctttaaaatatataacccaaggttatgttggatttaccttcat

SEQ ID NO: 94971 - DNA, 1887 bp, Homo sapiens
agcagtttggggggccaaggcgggtggatcacgaggtcaggagatcgagaccatcctggctaacacggtgaaaccccgtctctactaaaaatacaaaaaaaaaaaaaattagccgggcgtggtggcgggcgcctgtagtcccagctactcaggaggctgatgtaggagaatggcatgaacctgggaggcggagcttgcagtgagccaagatcacgccactgcactccagcctgtcgtatttaaaatcaggtgttaccctcagcatgggggagatggaaggaagaatgaggggagcgtgtaagtttctagccagattttatttcctaacctgggtaaggttatatacacttgctttttgtaattcactgaactctttatgtgcacgttttcccccatattttccactgtacaattaaaaagatattttaaaaagcaatatggtacttagaaatgaatctaaaagggtctgtaagataaacaatacggtacttaggaatgaatcttaaagggcatgtaaaactattttaagagaaaattataaaactacattgaaatatattaagacctaaatagttggaaaattacacaattgtaataataaagatgtcactaaattaatttctaaattaaatgcattgctactcagaattccagtaggatttttcgtggaacttgacaggctgattctaaaatatttatggaaaatcaaaaaacgtatatttaaagaataagataagggatcttgccataccagacatcaagacttattacatgtgtagcttatttaagacatcatttacaaaggaataaacagaaagaaaaatgaaacagaatggtgacccagaaacatatccatgaatgtggaaacctaacatacacagagatggcataacaatctgtggagaaaggatgaagaggaactattcaatagagtttgaaccaatgaatatatatctggaaaaaataaaatcagataaatcactgccacacactaaacagaaatgtatagtataccaggcatattaaaagtaaatgggataactaagtttttagaatttagatggtctgtccttatgaccatgtgataataaaagatttcttaatcaggacacgcaaagcacctaccctaaagggaaaatataataaatatgccattattaaactgaaaaactttttgcctaaacgatatcaaacaattaaaagacatgaaacagcctgggagaagatatttataatgcacaccacctgcaaagacatttcacaggaatgttcattgcagtgcttttcaaaataggaaatagccttaagttgatcaacagaggtgtattcgtatatattaatacagtagaataatacataacgttcagaatcaaagacatatattaattgactaactctcaaaatcataatattgagtgaaaaagtcatggtgcgtaaaggtacagacagtattgtacccttcgtataaggtttaaagaaacttgcaaaacaatgctgtacactgttggttaatatatgcaatgtggtaaagaattacaaaacatccttgatattgataaactgtaaatttggtgtaaaggctgctactgagaagtgagaatggcatcattgggaacactttacacaagaaacattatatttgtaatattttatttcttaagctctatggtaaatacttgggtgttcattttgttgcctatatttttggtatgcctgaaatattttattaacattaaaacattttttaatgatctaaaaatttcagaagacatttagagaaaagagattaggaggattgaagtaataagaagtaagaaaaatgtgtgaatttaaaagaggtagcaagagttaactggttctttgcatttttagcaatctctattgcct

SEQ ID NO: 94972 - DNA, 1700 bp, Homo sapiens
gagtgttttcatgagacattcttggaaagatttctttcagcatcatccagacaaacatagagaacacatgtgtcttcctcttccttatcaaaacatggacaagactaagacagattataccagaataaagagcctcagcatcaatgtgaatttgggaaacaaagaagtgatggatactactaaaagtcaagttagagattatccaaaacataatggacaaattagtgatccacaaagggatcagaaggtcaccccagagcaaacaactcagcacactgtgagtttgaatgaactgtggaacaagtatcgggagcgacagaggcaacagagacagcctgagttgggtgacaggaaagaactgtccttggtggaccgacttgatcgtttggctaaaattcttcagaatccaatcacacattctctccaggtctcagaaagtacacatgatgatagcagaggggaacgaagtgtgaaggaatggagtggtagacaacagcagagaaataagcttcagaaaaagaagcggtttaaaagcctagagaaaagccataaaaatacaggcgagcttaaaaaaagcaaggtgctttctcatcatcgagctgggaggtctaatcaaattaaaattgaacagattaaatttgataaatatattctgagtaaacagccaggttttaattatataagcaacacttcttcggattgtcggccctcagaggagagtgagctgctcacagatactaccaccaacatcctttccggcaccacttctactgtcgaatcagatatattgacccaaacagatagagaggtggctctgcacgaaaggagtagctctgtttccactattgacactgcccggctgattcaagcttttggccatgaaagagtatgcttgtcacccagacgaattaaattatatagcagcatcaccaaccaacagaggagataccttgagaagcggagcaaacacagcaagaaagtgctgaatacaggtcatcccctagtgacttctgagcacaccagaaggagacacatccaggtacatggctacagattccatctggcaatgtgactgccctcttcatggactttttagttaagctttgcacacaggtgaaaaaaacaagccatttgccctttcctctctataccatttcttaccaactggaaaagagtgagaaagtgtagtacagtgctattgtgagttgtcattattttcatcaacattcatttacgaattaccttttgaatgaagggctttgctgctagatccttcacagtctgcaaagtttacccctgaaatgggggagctttgaggttagaatgatctctatcctgaacaatattgctgggtttatgtttatttgggttttttttttttaattcattcctctctgtctttcaggaaatatatttgaggttcttttaaacacacacacacagacaaacacataaataatacagggtttttttttttgtaattgaagaatggagttgatttgaaaaattgaagctggggtgagctacaatatgattttttaaaaatgagtaaataaggaattgtgaataatggaaagacaagtcaaagccaggaggaagataaataagccttgtggatgtggtcgctagaaaagagctacaaatttggctttatgttttctagcacttagtgttgctagaattttgtgatcaataacatt

SEQ ID NO: 94973 - DNA, 1575 bp, Homo sapiens
ttagacacagtgttttgaatattcatccatgacataacatgtatcaatacttcgttgctttttatagctgagtattattccgttgcatgtatataccacattttgtttatccattcatttattgatttgggttgtttccactttttggttattgtgaatagaattgatatagaacgtttgtgtacacctgtctgcaattcttttgggtatatatctaggaatggaaatgctgggccatatggtaattctgtggattagcttattgaggaactgccagactattccatagtacctgcactattttgcattcccatcagcagtgtataagggttcctccaaccctcctccttttttccacagcgactgctttagtttatattcgcaccagcagttcacaagggtttcaattttattgcatccttgccaacacttattttccattttttaatatataaactaaccatcctgttgggtgtgagttagtatcattgtggttttgatttgcatttccctagtgattattcatgttgcacatctttttatgtgcttatttaaccatttgtatatcttcttttgaaaaatgtcttttcaagtcatttggccattttaaatctggctgtttgattttttggtttttgagttgttgggattttctatatattctggatattgatctcttgttagatacatgatctgcaaatattttctcccattttgtaggttgcctctttcacagtcactctgctgaccgtgtcttctgacatatagaagttttaaattttgatgtagtccaatttagctattttttttttgttttttgtgcttttggtgtcatatcttagaaatatttgccaaatccagtgtcgtgaaagttttcttcttaagagtttaataattttagcttttacttttaggtctttgatccattttgagttaatttttgtgtatggtgtaagataagggtccaccttcattcttctgcatgtgaatatcccgttttctcaacatcgtttgttgaaaagactttttttccccattgaatgttcttggcactcttgccaaaaatcgtttagccatatacgtgagggtttttatctgggctctctattctgttagtctatatatctctctttatgccactactgcactgttttgatttactgtgtatttaaaatgagttttgaaagcaggtagtgtgaaacctgtaacttagttcttttttcaaaattattttggctgtttggtttcccttgagatttcatgaattttagtaaatattttattgtttttaatactaccatatgtgcaatttctttcttaatttcatttttggattattcattgctaatgtataggtacataaataatttttacatactgatcttgtatcttgcagctttgctgaatttattaactctttttttgtgtggatttttaaggatctctaggatttcatgttgaggaagttcccttctttttctattttgatgagtgtttttgtcatcaaagcattttggtgtttgccaaattcttcagcatctattgagattactagttttttctttttctttttct

SEQ ID NO: 94974 - DNA, 1047 bp, Homo sapiens
tccatgtccccttatgcgtctgtctgaaactgtctttagcatatatacccagaagtggaattcttggcttacaggctcgtatacttaatttcctacattagtaccaaattgctttccagttcatattcctacctgcagtgcatgaaaatttccatttctacttctctgccaattatttctaatttttatcagaacactagtaaaacaagtttctataccatgggaagataggtgttttttttttttctttttaatgagatgatacttgtcttgaacatctagagtatctctttaatttccgtgggaagagagtttttcatataatttacagtgctttcaaccagaatacattcgtttgttcattcatccaaacataattatagaattgacaaaagcacagagtgacatactttaataagcttttctcagatttatatatatgagtgagaaaatatatggaaaatttttataacaatatttaaaaacttgatttaaatatctggtaaaacttcattgtcaaaacacagcatccacatttgttccaaatacccatggaatatttacaaaattaattgtacgttagacaaaatattgatgaattctcaaagcagaagttttataagtaagcccatattctgtaactgtaatgcagtaaaattgaacttaacaactataatttttaattttgctaatgctttaaattgcatttctattaggtttcagatttgccatttacatttcttactttgagaattacctttgtgtatcctttgcctgtttttctctgaaggtttttttcctattcatttttgtaaacatatttggagaccactgtagttgctgtttttttaaattctgttttattacttttttttttttttttttttttgagatgtctcgctctgtcacccaggctggagtgcagtggaaagatctcggctcactgcaacctccaccttgcgggttcaagcgattttcctgcctcagcctcctgagtagttgggattacaggtgcgcaccaccacgcctgactaatttttttgtatt

SEQ ID NO: 94975 - DNA, 1115 bp, Homo sapiens
taccattatctgggaaattttattatcccattagagttttttttaccttagttgtaatgatcattgactgtaataatttccactgcattttagccatacattctcttaactattgtttgaattttggattcactcaaaattatttgttctctgcaatctttacttcttcacataccaaaataaatttttcaagaacctgttatgcaggcacagtacattgttaattttctgaggaagattttccatagttttctgatcaaccacactggcagaaatagataactagttctaatttccaaaaggtaagtaatagatagttaccacctgagtttctgcttctgcaaccttttttcactaggaattaaatgtatgtcacagcattattttttggacagacacttggtcattgtgtcaccccttggtgatgagtaaattttattgaaaatatacttgctgtttgattgacacagttctataaacttttcacaagaaaagacagtcttttggtgccatagactatatttctcattttgactctgactgttttatcaatgtgtgtctctggtcctaagcctgagtgattataaatgaattagcgtaaacccatgcctctaaaggaaaagcatctcccagcaggcacctggctagctgaaggccagcagtaccaatcctcctgcctgaagaatagcagtgtagggtcatatcagaaaacatggcccttttcctatgttggatatgtttttctaagatcagtttccacctaacaagtaattttttaattgaaaagcttttatttctaggtctgtctcatgtctttaataaatacgggaatgagtctcatttagttcttaagctaaagagtactacaaaaaccctgaaacatctctgagatggtacatttactttccattgttactcttgtataagacagcaacaggtgagtttgctctcatagtggaaattaaaacagaagcagccagccagcatatatttccttccaagattgtgtacaagagaaagcctaacccatggtggctgataatgccatttaatatatagtcacctaaatctttatgtgtcagctccattgcagaggactcagtgggctactccac

SEQ ID NO: 94976 - DNA, 1073 bp, Homo sapiens
ctgcctctcggacccccacctcctttcctgatgtgttttttctcaggtcttcactccatgaaccgttccacatgggctgtggtatctactctcctttctgagtttggcagctttcctgggtataagtttgttggtatcttgtttttaaatatgtccctctcagctaagcttgttgtgcttcaggtagtgagagcgtattgaccaacacaacttaccaccttccattcagtgactggaccatgtctgtggcctaacgtatgttattccttttgaactccttaaatcttttctgccacacccttccccacaagtttttgtttattctcatttcttgaactggtaatacagtacaaccacatgatacaaaatatttgatcaagagtgtccttcctactcctgttccccagcacccagccctccttcgcagaggtatacaataaaatttcatccattttaagtgtacagttaacttttagtaaatttacagagttttgcaatcatcaccaaaatccagttttagaacatttctgtcgttaccaaaaggtgcccttgtacctctttgcagtcaatccttgttcccagccccaggcaacctctcatctgccttctgtctcttctggagattttatgtatatagcatcagatgtggtcttttgcatctgcctttttttgttaacatcatgatttcaaggttcatccgtgctgtagtatgcatcagtggttcctttttgttgctgaatagtgttccattttatggatataccacattttgcttatctttcagttgatggacatttggattgtttgatttttttggatgtgaatgctgctattaatacttctgtaaaagttttgtgtgggcatacattttcatttcttctgggtttttactcaggagtgaaattggtaggtcatatgataggtttatgtttaactttatcagaaattgcctaagtgttttccagagtggctgtatcattttacattctcgcctgcaatgtgtgagggtttcggtttctccacttccttgtcaacacttgctattgtccacctttttatttatagccattcta

SEQ ID NO: 94977 - DNA, 1010 bp, Homo sapiens
ttcttttttctttgccctctttttccctcctactctcccctgtccttctttctcttcctctctcttcgcatccctccatcccacacaaagggattgtatttttgaaacattaaaaagggttcacgtactcacttgaataaatctgtcaactcagcctcaaggttactcccagagacacctatgatccttcccctcaggtaacttggagattgtgaacggtgccaaaaaacacactcgagatgttgggataactttcccaactccaagttccagcgaggctaaattggaagagaacagtgatgtgacttcttggtcagaagaaaaacgtgaagagaaaatgctctttaccggttatcctgaggacagaaagttaaaaaagaacaagaagaattcccatgaaggtcagtttctcattccagatcttgtagtagagaaactagtgaatttcaagtcccctgcgatgctgactctgtgtttccaagtgactctatgtggtccccacctacccccagccacaaccttgtcaggttttcagagtccagcatggcagttacacagtcatccctgcagcaaaaccagactcaagggcaccctgtggcctctgacagctgagacccctgagaacctgtattatatgcatatcctggataagagctgggtggggctgtaaaaaagtgaaaaatctgtgttccttctaaaaactgtttcctgtaggagtttcctggtttgttcctgtggaaaatgtggagtctagatcaaagaaggaaaacgtgcctaacacttgtggccctggcatctcctggtttgaaccaataaccaagaccagaccctggagggagccactgcgggagcagaactgtcaggggcagcacctggacggtcggggctacctggcaggcccaggcagagaggctggcagagacctactgaggccatttgtgagagcaacccttcaggtgcagtgacgttgacttaactttaatgctacgtgtagggagaagaagggcaag

SEQ ID NO: 94978 - DNA, 1018 bp, Homo sapiens
gggaggctgaggcaggagaatggcttgaaccgggacgcggaggttgcagtgagccgagattgcaccacagcactccagcctgagtaacagagcaagactctgtctcaaaaaccaaagaaatctccagcagcggaaatgtatgtagaactcattttggtcagtacttttccttgtacaggaagaaactgaggtcgcccggtgcaacgcccaacacaggttaagacaaagccgagactcaaaaccagaccccagcttccggtcccagcccatagattcttccatttccttcgccggaagtgatatacagcccctgttctccttcgcgtccgttgacgggacccaggttggggaggcggaagaatgggcgggaccatgggcggaagcacccctcctaccaggacccggaaacagatggccaccccgagccggcctatccggaaactggctcgaagaagacggggattggccatcgcttccggaagttgtgagctttgtttcggagcgggagctcttccgagacgcactgggggccggatggtgagttttccttgcgctctaacgggcaggctcgggagcgggagggtccgggcagttttagtagtgtctttgggacaacggctgcggttggtatttctcaagcggcaacgaggccagcccctgggaatgcagcacgagaatgatagagtcaggctgtcccctcaagaaatagtttagtgaggagacatgcagcggataggcgcaggattcttcagagttgtgattgggcccaaaaaggagctagtcctcagactaaaaagagccgtagtgccggggttctgggcgctgtagtaaatggactccaaatggagttgaagggagggaggagtgcgtcaggcggagatgaaaggagagagggaactacctgtccgatagggcagaatcggggagaaaggttggtgacttgagcttagagaaggccattgcggcggtagcagaagaggagaggcagggaccagatcgtagagtgtggaacaccgtg

SEQ ID NO: 94979 - DNA, 1267 bp, Homo sapiens
ttgggaatggacccagtgatacaaacctgtcctggaattctacctggagaccagagctggcctgaaaattactggtgtgacttttaattagttcaggtctaatcaggtttctttattgttcccttatgtattcaagcttaaggaaaaattgcattgctgtttacctctttgctgataaatttgcagtaattacagcattgcaggaaaaacaatctgttattccagtcttaaatttttctaaaagaagacaatattttagaactgaagcattgagaacttcccttgcaaattatttttaaaattctatcttgtttttctatgtatttctttctgactagacttgtgatatgcgtgtgtttatgtacagaaatttttagtgtttttgttatgttctgttattgacccaaaggccatctttattttctataactgttcaaaatttatattaaaatctacttaggagataatttctttagaacctagttactacctgtaattaattgtggtatttttgtgattagatattactttctttggcagtcagttgtgggatttgaccaacttcctttgactgaattgtcagatatacggtctcacacaggaatggatgaacttttagggattgtcaattgagcaagagagactgactgataaaccagattgctggtttattcaattatagtgagtaagttacctggcagggtaattgccatcaactgagtagaactatccagaaaacttgaaaacttttataaaggtgataaacagagtagaatatgtccatttaaaggctgtggatgtctagcaagactactgtgttattgctccgttgttgaatataacctcctgggatctttctccagttgcctctcctcttaagtggagttgtggcttacctttttttttttttttttttttgagacagggtcttgctctgtcacccaggctggagtgcagtggtgccatctaggctcactgcagcctctgcctcctggctgaagtgatcctcccacctcagcctccctagtagctgagactacaggtgtggactacaatgcctggccaattttttgtattttttttaatagagaccaggttttgccatgttgcccaggctggtctcaaactccttagctcaagcgaatccactcacctcagcctcccaaagtgttaggattatagccatgagccactgtgcctggcctaccttcactttttccaagttgtctcttctgctgctatacctgtggaacacacagacccttca

SEQ ID NO: 94980 - DNA, 1040 bp, Homo sapiens
agatataacagcttgaatagtgaatttcagcttaatttgctttttctggaaagatctgctttttgtacagttatttctaacagtttatcctctcctcagtattcaataggtgccggggacattgcttagaaagacaaaactacattgaagaccttcagaatggtcctatcagaaagtaagtcttatgttatatatgtgagatttgtgggtcagggagatctctgtttatgtaatttaagttgcatatgttcattcttctggtagcttgtttgtttgttggggggagatgtaaacaaataggaatgggagaaggaagaaattgttattttcatatgccaaaatatagtcactaaattgactactaaatttggaaaccagtaatattgtgtggaaaatattctctttaaggaattggaattccagtgtacccaggtcaagtgattttgaagactcagcacatctcatgcaaccagtccacaataagcctgttaaacaaggacctaggtataatctacatcagatccagggtcactcagctcctcgacatttccacacccagacccaaagtttgcaacaatcagtcaggtacctctctctgttttcccttttctagaattgagatagaaattaatactatagttaatgaaaacacattatgatactgatgaggaattcttcgttttttttttttttggagacagagtctcgctctgtcatccaggctggagtacaatggcgcgatctcggctcactgcaacctccacctcccaggttcaagcaattctcctgcctcagcctcctgagtagctgggactacaggcacccgccaccatgcccagctaattttttgtatttttagtagagatggggtttcaccatgttagacaggatggtcttgatctcctgaccctgtgatctacccgcctcagcctcccaaagtgctgggattataggcgtgagccaccgcgcctggccgataaggaattcttgctgttcagtttgaaccaggagatattattctgctctgtattttgcattta

SEQ ID NO: 94981 - DNA, 1095 bp, Homo sapiens
aacgtaaggatcagcagagaccatattaacaggaaaatatatactgtgttggaggaactggctagggagactgggccatgggggtagtatggcgttaaaatggagctggaaatatgaataggagctgaaaccatgcagagctatgtttaaggttttagtcactaccttaagagcaatagaaaaccattgaattttttttgttggggatgagtgtggggaacacattcaaatttgtattttcaacctatcattttgctgctgagtggagaatacactgcagagggaaagaggtagaagcaaggagacaagttgggaggtgtttgtaggaactgaggcataatggtggattggaccagggcatggtggtcattttggtagaaagatacagatatactctatagagatatttaggtaatattgttgtcaggagttggtggtgaattgaatatgagagtttggaagaaatggctgacagtgatggtgactcccaagtttctggcccattctgttggttatacagtattttttagatataatgttaatatttttcccaatttgtcttttgttcattgttggtttctgataaatactctgtcatattaaggaagtctctatttttagtgtataaagcattttgataaaaaatgattctgcattttctttccttttgtttattaaattacattaatgtaaataaatatataaatagattttctggagttgggtcatccttgcattcttgaaaaacgtctttttgtggtcatggtatgtcattctttaataactgctggatttgatgtgctgatattttcttaggatttttatatctatgtctataagttgaaattggaccttttttgaaaaaacttgatttttttcttttcgtatataaatgacccaaattatgttgttttgttagatatttgattgatgtagaaggcgtgaggccagatgatgcaattgaatgtaagtatgagggttgacactatttttcccttttattaaagttaaaggtggaaatgtagaagaatttatcaaattttggaaaaaaagaagtttgtaattcgtttgttccaatataagatagtcttgcca

SEQ ID NO: 94982 - DNA, 2107 bp, Homo sapiens
ccaggaggtggaggctgcagtgagccatgtttgtgtcactgcactccagcctggatgacggatgacagagcaacaccctgtttcaaaaaaaaaaaaaaaaaaagaaaagaaatatttataagcactaaatatgataagcactccacctggagctggagatacagtggtgaataaaatctgggagattacagtctgattaggagaccaacatgaaacaaatacagaaatacatatatagaagtgggcttatttttttctttctgaccactctggaagaaaggattgttgtaatataccttctatgttccaggagaatggaaactttcctttgaatctcgttgtatgttagcatcacaggacttgaataaatgcctaatgtagtacaggattttaagcacatatttgctcttatttcattctctgtgacagagttttgaaaagaaacttgctccagaagaatgcttttcccctttggatctttttaacaaaatccgagaacaaaatgaagaacttggactgattattgatttaacatatactcaacgctattataaaccagaggtaagtggaacccttcaatgaaaagaactttcttccttctgatcctaaaataatttatagtaattcagtaatcatcttgtgctaatgtgaagcttggccttctttgatgggtagtaagtttaaaagagaaccaagtgatttctctaattacatgtttttaattgctgtcttaaatggaatattattcagccataaaaaagaatagatttaatacgtgctacaatatggatgaaccttaaaaacatgcttagtgaaataaaccagacacagaaggacaaatatatgattccacttgtatgaagtacctagaatagacaaattcacagagacagaaagcagactaaaggatctatgaggtggggagaaaagggaattatggtttagtggtcagagtctttttgtcggggatgatgaaaaagttttgggtatagacagtggtgatggttacacaatactgtgaatgtaatgccactgaactatacacttgtggatggttaaaatgattttgacttagcctcttctgtcttttatctgtatctacttttctcccaccccaagaatatcggttctcaatagtgcctggaattccctctatctcacaattcaaatccaagttcttctgactctattctctactcttctacttaaatcatagctgctttatgaaggcactggcccttgaattataaaatattaaatggaactgtttatataatttatagttaaatatgcattcattcacatggaatttgctttcagttttgtatacctagtgactatctattatgtagttttattgaaaatcaagtgatacttcctggttgaagcagtgttggaaaaaatggctcttttatcagaattgtgtatactgatattggcatattaagtttgttataatctcttggcttatattctgggtcccctaattactctttaattatttctctacaagtgaaataatacacatcttttatggttttgctttataggatttgccagaaactgttccttacttaaaaatttttacagttggacatcaagtgcctgatgatgagactatttttaaattcaaacacgctgttaatgggtttttgaaagaaaataaagataatggtgagtttttgttcttacctgaactgtggtgtgcattatgaatggggttggggatttttggtatttttttatagttccaacctcagacctgttgtatttaatgatgctaaggtgatgaaaatgtcagatggtgctaatagggtaagatgtttttccttttgttgatcacaaataatttaactttggaatgttaaattagttttagtgcaaaatatgaactgaactggctcatctttcttttttaatttgaatgagaaatatataaaattaaaatgttatttttgtcttctatattggttaagaagtgagaagtagaagaaaagattaaaaaactctgagtcttagagttatgtgaaagagacaagaaagggcaaagattaagaatgggacggacccctagaagcaaaacaagaaagagtgcaccagtggaatt

SEQ ID NO: 94983 - DNA, 1257 bp, Homo sapiens
atggtggttctggttagcatgaattgatctgttatcagtctgacaatggtacggctgctgagtttgaaattcagaaaactaatacttgttcccttgagtttgggcgtttgtggcagagtttagtagcagccttctccttcagccctgatttgggaagcatcccaatacatgctatttgcattgcagctgtgggaaagtccacgtttgtgaagttactcacgaaaacttacccagaatggcacgtagctacagaacctgtagcaacatggcagaatatccaggctgctggcacccaaaaagtaagtttttagttgtggtgggtagttggcaggcatgggtgaataatctaattgtcataatttaatttactctcagtgagtaaagtagcccagtttgagtatcctttttaaaatagcttcattccagaaagcagaccacatacaccagagaggatatgacttgtttgaatatgtgcagttttgatttttgtggtttttatatgtctatctaagtgactgcctctgttgtttgtggtttcccaaagcatgtccaaccatcatggatggctttgaagatgaattttgtcattcctacacttaagtatttatattattacttaagctaaccactaggattaatagctaattatagtgattttaactttttaaataaagtcttagaaattagaagggatattagagaggttccagtcacactttgagtcaatgggagaggttacagctaacatttatgagcatgtactatgtgccaggcactgtactatgccaagcacagtacatttcacttacacctcatggcttaggccctggtgtcaagactatggctttggcagaggccatagagttggtttccagccacatcagtctgagtaaggaaagacttgtttcgacatgacccttagagggagcagaagcaccatgcctcctcaggcaccatgaactgctcctgccgccacctgggatattcactgagtggcacattctggttcttaactctaattactaaacagttctgccttttaatgagccatgttgcacccctgtgactctgactcattggttcaagttctacctcttaagtcttttaacttttcgccgtaacaaccctatatatagttgaaggtaatgattttcctgttctttctccccctcaagtctctctccttttttttttttttttgacagtctcattctgtcacccaggctggggtgcaatggtgtgatctcggcccactgt

SEQ ID NO: 94984 - DNA, 1027 bp, Homo sapiens
aatcacttgaactcggctggggtggggaggagggcggaggttgcagtgagccgggaggttgcagtgagctgagatcgtgccactgcactccagcctgggtggcagagtgagactctgtctcaaaaaaaaaaaaaaaaaatccggggctgctgaacatcccacacttgtgcccacttgcacatgccgagtaagtggaacgttttaattatgtttcataaagtctctagaattaagtagggttttgttttaacaaacaaattgtactccttatatgaaagataaaattctatttggtggttgattggttggattttcaaataagcagttgctttctggtttgccttgacattttataaacataactacagatggaagctcaaaagagaggcaacatagtgttatagtggaaagatttgattcagagttaaattttagatggttgttgactgttaactcctccccagacagacttcacaaatccctcaatcagtgatcgtgttaattctatatatggttcttcctctgcttttgttatattgaagtggcatgtcatctccctttagagagtcttatttaataggtaggaaaatctcatacctgattatgaaattttgactaagctggggatctgattctacctttttggtggaaggaaacttttgtaatttcttctttcattgattattaaacctgtttggggaggtaggggtgtgtgtggaggggtgtaccccatggagtaaatatgctttctaggaaattttcttctttttttcatctccctctaggcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggtaaaatgccaagccctccaccagtcacaagccccatgctcagtgctgcctgtt

SEQ ID NO: 94985 - DNA, 1070 bp, Homo sapiens
taggttttacttctttttcagctgttggatatcccacctgcctgttttcctctcttctctcccaagccatgcctctcggactccgaagttgaattacatataaccacatgggttgtttggaaacatagtcagtctttatttctagccgcttcatgaagtaggtgtgtgagaccctcagaggaaaatagagaagtagaaacactttgttaattagaaatgcattaagaagctgcatggatcttaacctttgcttgtaaaggaagaggtaataattgattacactgtgggcatacaacattccaggtgctatcttcagtgagggcattttcgagacagaaaggaaaactaatcacaagttctaatcccgagggtaatttagactttgttcacttgcacagatttattggatgcctcctgtgttgaagcaccaaggctggccctggggctgcagcagtgaataaggcagacccagtccctgcctaacagggactgaacacatgctcacgtgtgtgatatttgttccaaaggaggaacacaggttatctgggagagttgattatagcgaggaagaaatcttagtcttttctgtttgagttaaaggaaacattagcatatggttttagagcagaggccctgactcctagatccttatgccctgttctgtcctgcagcccctgcattcagtctgcagtacttccctcccactcagcaccacacccttctgcccctcaccccatcaccaccacaagctttgaagaaataaaggaagtgctctttctcaagaaagccaagaacccctttcatagggcttattagcaaatctttaatttctctttataagatccttttttgttttaagacagagtctcgctctgtcgcccaggctggagtgcagtggtgtaatcttggctcactgcaacctccgcctcctgggttcaagcaattcttgtgcctcagtctcctgagtagctgggattacagggacacgccatcatgcctggctaatttttgtgtttttagtagaaacggggtttcaccatgttggccaggctggtctcaaactcctggcc

SEQ ID NO: 94986 - DNA, 2044 bp, Homo sapiens
actttgggaggctggcgtgggaggatcacttgaggccaggagttcaagaccagcataggcgatatagtgcgactccatttctacaaaaaagtttaaaaattagctgagtgtggttatgtgtgcctgtggttttagctattggggaggtgagacaggaggatcacctaagtccaggagctcgaggctacagtgagctgtgatcgtgccactatactccagcccaggtgacagcgtgagaacttgtttctaaaataaaataaaactgaactaaagattcagtgaggccagagggctaataatcttccatggaaagaaccacactaaagttagatgcattgattgcaagttgacaaggtgggtcatgtttatgtgacttctttcaatagtcttcattgcctgagagccagaatagaagaaggggattatactttaggggtagagattagtgtcagcgattgtggggagaggagtcccctctcaaagaggacagtttgaagtgtcaaagtgtagggttcaagttgggagagaagtcctgagccccaggaaggcttgtggcctgggccaaagaggagtgagagtgctgtgaggttggattgagtaaagatcctggttggaatttgaagaagtgacaggtttcctatgggagtcttgggatggctggactgaaagaagcaggaggttctcaggacgagctgagcattaggagaagtgagaatgctgacttaaccttttccaagagaacagcacattcagctcagtgccatgaagccagcattggggaggagtgagagaggaagtgggctgactcattcctgggagtaaaatggggctacttgggccagctgaagaggctcttgtttctggggagtggaagttggacccagcaaggagaacaagaaagtcttaattgcttttcttctttgtgcactctgaatgaccttataacagaatgcctgaaactggttaatttataaagaggcttattttggctcacagttatggagactgggaagtccaaattgggcagccttaacttccattgaggacctcctgctgcctcatcatatgatgaggtggaagggagcaggcatgtgcaaaaggggcaagataggaggagcagccttgctttataacatcccactctcatggcaactggtccaatcccacgagagtgagaactcattccggcgagaattaacccagtcccaagagagtggcattaatctgtcttaacaacctaatcacctcttaaaggccccacctctcagcactaccacactaaggaccaaatttccaacacatgaattctggggggatacactcaaaccatagcaaatggtgatgatgatgatgatgatcatcatcatcatcgtcgtcgtcgtcgtcgtcgtcgtcacttgggggcagatctgcccttttggagaggctaattgaaatatttcagctggagtagaatgagaagagttgaaggattattacaacttaatggcagaaaagaaaaatagcttattcattttgagattagatggggattttaatgctgttttgatggcattagttccagagatgcaggaatgcccatgtttcttccctgaagtcacacttgacctcttctgtgaaattcagaggtaactgtgcccaagggaagagcagaatagaagttgtcctgtcactatgtaaaaagctgtgcaagtgcccaatcttccagttcagagccctcgtaaatactgagtttcgagcatgtcagatggacttcgtaggtccttctgctcctttctacctattcttccctaacttcttttttttttttttttttttttgagacagagttttgctctgttgcccaggctggagtggcacgatctctgctcactgcaagctccgcctcccgggttcacagcattctcctgcctcagcctcccgagtagctgggactacaggcacccgccaccacacccggctaatttttttttgtatttttagtagagacggggtttcaccatgttagccaggatggtctcgatctcctgacgtgatccgcccg

SEQ ID NO: 94987 - DNA, 1096 bp, Homo sapiens
aagtggaagagttgtacttgatggctttcaaagcctcttccagctgggctgggagctgcttgcttctgaggactcgggtccctgtggctggcgttgggctggcagcccgtgctctgggtttccctgaccgctgagtgcagagcctcacagcgagctggtggggctggtcccgtggctaggaagaaagattcaagtgttgaggacagggacatggggttgctggatatttctgccccttctcaccttgtcttgtccgtgccttgtggaagctgtatgtcctgacccagggactgcagactcggggccctgtttcccttgtttctggttaaagcagacatctggatcacatatgcagcccccagccccagcctgggagacttctctgttgctggtgttgggggtagttatcgtcctgctggcccagtgccccatgggtcgctactgaaagcagggtgttatgaagcgggggaggctttacttctggatgtaagagctggtgctttggtgtagggaggagctgctgagtctactttgcaaagcttgattcctttgcgcctttccttctagcattccttttcttccccagcccccattatcttactcggttcctcccataattaaacgggaggaatgaggatgctgagcttcctgggctagatgttcttggaagcagtggcccttgtgaactaagttgaagtgctgcttttggcaacaacagaacatacctgagtgaaaggggctgggagtgaggccaggaccttgtcatcctgtgtgtaagctgtcggcccaggctgccgggtggtcttggttaagatatcatggatctggggtggctgaggcttagagacacccctgctgagagatgtctgcatccctgttgaccttgccatggccaactgcctctctaagccccagggtcaggtaaggtgaggctggacagccttgggtgtccgaggacagagggtctacatgctgatctgtggagttctctgtttctagagaaacaaaaggggacagtggaatgagttttttcgtaaagctaactttctgtgactcaaagagcagtactttttttctaaggataggtcctttctac

SEQ ID NO: 94988 - DNA, 1347 bp, Homo sapiens
aatgggacacggagccagtggggtggagggcgggggcagtgacaaataagctgtgatgaacaggcaaagaattccaagtgccagcagggtaaagaggatgacccaacccatttcctgaccctctaagccggggagacaaggacctcttgagatttactgcatgtttctgcttgttcttctggcatttgtttccttgtagtttagtgagttatcagtaaaacctatcaataaaactgatctacaaagttatcagagaacttgtgaatttgttctgacaacagtcaggaaagggctctcagaagatgtttgctgctcagcagcctgattcaggaggttggagctccatgacccagtagtagatggtggtggttgtgcagaggaaggggtgtgtccatagaatcttaggtctcatggaacaatctggaagcttatggagcagaatcgatgtgtgcccttttcacaagatgaagtagtaggcgagtcagatctgtgggtgtggtgggtaggtgggtggcagtgatgatgcagttattacgttgcatgatagaacaaggggctaaggaggttggggcagtcaggtacagtgagtcccagtaagactcaatgggatttaatcagggcaagtacaaaggcctgtacttgttttaaaaaagaaatgtacgaactctggcttcctagcaggtaggaataactgaaactctaaaaaagaatgttgacagtctgtcttgaaatctgtcagagtggtcacatgcaggacagttgaaggaagcagggctgttcagctgctgatgagtagaggaacacaggctcaggcaaagcttgtatgaagaagaggtcagttccctcactggagggagtatgcaggagttttattagtgggtgaaagttattagacagactgaacccacattagaaaaaagaattgtctagcatttatgactattccagtactgaggaactagccctgagaggtcctgtgtgaccagtgcctgcacgagtctgggtgctgcctaacagggaagttatgaggatgtcctctgggttgcgggaaggttgggagggagattcacatttggtggtctcttgctaagattatgtgaagtatattatcaggtctattttttttctttctttctttctttctttcttttttttttttttttttgatacggagtctcgctgtgtcccccaggctggagtgcagtggtatgatctcggctcactcaccctctgcctcccaggttcgagcaattttcctgcctcattctcctaggtagctgagattacaggcacgtgtcaccgtgcctggcttattttgtatttttagtagagacagggtttcaccat

SEQ ID NO: 94989 - DNA, 1085 bp, Homo sapiens
gaatgaggccagggtgagatggggatgggagcagatggactgcctgggggactatgggctcctcctctgggctacttctctggtgtagccgagggctgctggaaggcagggtggggacctgtgtttggggtagggctgaattaccaccgggagatgagtggagccaggagttgggatgggaactttgctctgtggctccttcaggctgctgaggaagataggtgctggttgagcaagtctgggagtagatcacagttcagttctggcaggtcctgccctcccaggacagcgggtgtctctcagatccttgaggacctcagggagaaggctgaccagaagaggggcctccacttctcagtgcccagccccctgcctctccaccctccttgtgtagaaacttggctcagcacattccagctctgtgcagagcctaggaaagtagggaagacagggcccccgcccacgtgggaggactgccgtgtaaataaataactgcactttattgtgactggtgctgtggaagaggcagtacactgctctgtcaggacccgggaggagcagatgatgctcatgggagcttggtgatctgagaaactggcagggggaggcaatgtttaaactaagtcttgtaccacattagcttgccaggtcgggggaggtgcggagggatccaggcagaaggagcagcaccgggaagtctctgaggcatgaaaacattactagatccatagcttaaagggaagtgattgggttcaagtgacctcggtcttctttgtatctccctggggttggcagagacagacagaacttagagaattggaaagagaaggacctagatttgaattctagcccaccactcaccagctgtgttgacaggcaagtaagttaacatcgcgaagtccttccgttgccctgttagagatgagcttgtatggggagtaagtcaaatgagatgatcctacaacatggttggcacagggcctggcatgtagcaggggtttgataaactgtggcagccgctgcagcaaccgtactagttgttcctttccaagcattgtttgtctctcctatccagcagcagactg

SEQ ID NO: 94990 - DNA, 1930 bp, Homo sapiens
ttcctctcacacccgggcatctggcagttagctgaggactcccccttgttctcagcgtctctacagcttcagagaaggagatacattaggaagcctttaggcaaatagaaggcagggaaaacttggaggattaaaatctgtagattagtgtattctctaggactattacccccatctctatctattttctccccctttcttcttccctttgtctttcaacatccaccaagtatttatcatgttctaggtacagcattaggtcctgaaaaataagagaaatcattattatttgattctcacaaaaccattggaagtaagagacattgactaaactattacctgaaattataactcttgagtgggaaagccagcactggaagcttttgtgttttgtatattgaatgcttttgacttcagcgttgtgtttggggctgtgaacttgcacatggcagacagaatcctcaccccagatgcacccagcactttacatttgctttctctctggctcagagaacctcaagggacttcgaaggttgactcaacatgccaagtttgttttcaattaagtcattgtttcccggatctagcaatgacagaggagggcagtggggtcagaaatgggctagctgggaagggagcttagttttgaaaggcacatgttggcattagatgtttcggatttgagattctgaaagctggatggaaatactgtgcctgagcaatctaccatgaacctgaaattgccttagactcatttagagtgtgggccccgcagcccttactgcttcagggggcttcagtgagacccactgactgagaggaggagggtgagaagtgcagttgttagtttccttccactctgttttctactctactcctactcctgggttctgtcattagccatggggaggtcacttactgtctttggacttcagctttctgggtaaagtgaggggattgccttccaaagttaagtttttctcagactaaatctggggaaggaccagtttttttgtttgtttgttttttgtttttcagtgttcccaaaagattgcaaaactaaaacgtggtcccacttactttgtacagcgagtttgcagctgctgcacgtgtggctcagcaccatccaaagtggtctgtgagccattcagtgaggcgagccaagtgatcatgcccttggatgtcatggtagctttaaattgctataaaggttcctaaaggcttcctcttggttcctgtatttatgttgtggtggattggtgttaagcagtttacgggccatatcctgaatagcactgcttttgaacttttatctgggacagcatagggtctctgttttgatgcctccccaccccttctggacatgacttttccactcttctataccctccatcttggggacaaagcctccgcttgaaagagtagagatctttttgtcccataagttctctgagtgccccaaaagatttacttgcatctcagcttctgtagataaggatgcctcctgccttctctttcacttctgcaagtctgggagtctgatggaggcccgtcagagcccttggagcccctgtactgtgtgtgtgtgaattgcatgccttggaggaagagaacagttggggaggaagccaagtctcctgtagatgctggtgtggacttggaccctgcaagagactaaagctccattgccacaggcagggcaccttgaattttgagcttattccatgcagtgtttgttaataacctagaggtataccctttttcccctgggggttgattgcagattctaccctgatttctataaacaaagacatcttaatatttctgacagtatgagcttgaccatcttccccctactttctgttgctgaggatctacggccttttttgagatgctaaagattagacaaaaagtaaaaatgactaacttt

SEQ ID NO: 94991 - DNA, 1055 bp, Homo sapiens
atttaaatagtactgcttaaataataattcgattctttttattggggctgggcgcagtggctctcacgcctgtaatcccagctctttgggaggccgaggtgggtggatcacgaggtcaggagatcgagaccatcctggctaacacagtgaaaccccgtctctactgaaaatacaaaaaaaaattagccgggcgtggtggcgggtgcttgtattcccagttacttgggaggctgaggcaggagaatggtgtgaactgaggaggcggagcttgcagtgagccgagatcgcaccactgccctccagcctgggcgacagagcgagactccatctcaaaaaaaaatagtaataataattccattcttttatgaggggtgggtctttgcagctttctgatctcccctctactccccataactaatgttatcaaatatttactttgtattttccatagaaatgatccttttcaaatttattaacataatatgtctacagctactgcttttcagttccctcagtagctgtggtttttttttaactttcttcatttctaacattgtatattttttctttttcttccatagctttgctggagttttatgtaatttaaaagcacacagatctgtcagttgtgctgttttctaaagtattaatttctactgtagtcttatataaattgtcatcttttccttaggtttatttggtatgtccttttttctggattctcagttggatccttagcacattttttctatttttttcttctttgataacaaatacatttaaaaatatgactttcaccaagttccactgtggcctaattctcttggttttgatattttatgtctggagttcttggagaggtttcgatgatatacccagcatgagaattccgagccccgatttagcctgaccacccttcctcccagtaagggccctgaggagagtccctgtgcatggcttggtggcacagctaggcagtgcagcacttggtgactcccttgggctctgtctctaaacccccaaatagggaccctagtaatagcttaccagcttag

SEQ ID NO: 94992 - DNA, 2515 bp, Homo sapiens
gatcacatgctgtgtccagtggtcagtttgttgtttgtttaagtctcctttaatctggagcagattctcagtttttcctgatatttttaaagaattgtttttggccaggcgctgtggctcatgcctgtaatcccagtgctttgggaggccaaggtaggaggatcacctgaggccaggagtttgagagcagcttgggcgacagagtgagacctcatctccaaaaaaaaataataataataattgtttttaagcacatgaggaagctgactccttgtcctcatagctcccagggaacactcagctcctagttgtgtgtcatcagcaaagcctaaggcagagaggtggggcagggcccagctccccaggaagctgccttctgctctcccctttgcccctctgtaataccaggccacagcatcccaccccaccctaccccacccattccctggctggtttggtgttagcctgggatggaggccatcgctggggggagagagggactttgacactggtctgccactgcctctccctgagatcagggctgaggaacagagatcactgccttgggtagggcccagccgctgctttctgaagagtaacaccctcggtttggggatgtgggttttaacacccctgtcacccccctctcccccaccccaaaactttgaggccagtggccggggattgttaatccccagtcagaggtgtgtgtcccaactgaggtatgtcccgagggtgagccagagggagcaggttgcctgttctcggacctaaggaggttccagagtggttatttgcattacaagggcagtgcttaacagataattgactgttaggttatcttttagtagcagaactcccttgtataatagatattaaaaacatgatttgttttttaacaaatgatttgcatttagctttttaaggtcatgcttattgcatattatgcattctttgtctcacttatttttattttattgaatcgctcgcaaacttcccctccaactttttttttttttttaattctaagggcctttgaaccaagttccatttcctgttttctagttatctgtgactctacccagggaatcagctggttttaagtcagtggttctcatttccaggccccctgcccatgcatttccagagctcatctctctcttccccaacccagagctcagggctgtcccagcttgcttttctccccactcaagagttgccaccactcctactgtcccctgcagtgacgtgggaggtattcttcccatctttctttgacggaaaagggaccaccactactttccctgagataagaccctcctgttttcactttcacttgtaacccagtagggaaataaaaggagagagaaatgctgatgaacgagttgcagagaatgaattgcacgacactcttgcctttccctttcctctgtccctgtctcccaaccattgtttgagggtgagctcactggctcacccaccctccttgagcttgtgttcagtttctgcttttgcctcaaagctgcttatggagatgcagatgaaggatcaatgtgtgctttctcgttttcttagccttttagactttcggggtagaaggtgggtgatgagaagtgacttttttttttttttttgaaattacagttttattgagatataaatcatatacagttcacccattggcagtgtataattcagtggttttagtgtagtcaggattgtgcaaccaacaccactctcttagttcacaaaatttttatccatccctaaaagaaaccctgtggcaaatagcattcactcctctttgttcccctaaccccctcagcccctggcaaccacttatctttctgtctctgtggatttacccaatccatgcatttcatataaatggaatgttatagtatatatctttagtgtctggctgacttagcataacattttcaaggttcatccatgttgtagcctgtgtcaatactttattccttttcatgactgcataatattccattgtatgcacagaccacattttgtttatccattctttagtcactggacatgtaggttattttcactttgggctgttatgaataatgctgctatgaacatttatatacacgtttttgtgtgaacatgcccattttaaaattggggttttttggttaaggggttgtaagagtttgttatctcttctatatgagttccttgaatatgattatatgtatatatgtatatgatttataaatttttttcccattgtgtgggtttttttcactttttttttaagaggcagggtcttactctgtcatctgggctagagtgcagtggagtgatcatggctcactgcacctggaacccctgggctcaggggatcctcctgcctcagcctcccaagtagctaggactacagatgtgtgccaccaccatgcctgcctaattttaaaaaaaaaattatgtagagcaggggtcttgctttgttgcctgggctggtctcagactcctggcatcaagcaattct

SEQ ID NO: 94993 - DNA, 1044 bp, Homo sapiens
tacagtttatcttttttcttttggtctcatatctgagaaagttctgcctaatccaagataataaatatttatgtctgttttagagttttatagttttagttcttacacttgggtctttgatccattttgagtgagtttttgtatatggtgtgaggcaggggttcacatgctgttgcaactggataaccagttgtcccaattaaaagactgttcttttcccatttaattatcttagtgtcttctcactgttttgtagatgtttatagtagatgagagagctagattggtctttatagcttttttattggttacttgcatgtattgtttggtattaacatttacatgatgtacatcagttatcttcaaaatttctggtgaaggactaagttttaaaaatttctaattcatggactgataattttgtaaaaataagaatgaattactagaaaaatgatcatgtgcttagatgccatgacaatgtcaaattgtgatacaagtgtctaaagttaacactcttagcttttgtatttaccttgtcacagactaatggagatagcagaatagtgctagtccatagatcacacttacaggagtcctggccaagactcagctggccatgctcaatctgcttatctcttgctgggcatgtcttcaaccagtgtttgtagaaccatgggccttagggggtctcatgattgttaccttggggtactggaacagcaaatactagtgttactactgcttctcctccaatcttgaaaggggcagttgtccccaaaggcttactagacacgtaccttttatatttgtagtcacccaaataagatgaagcccttgtactaatgtgagtaaaatcctacccctacctgttgttatcaaggttgcttcctacagccttcaaggttgagtagaatccatccattcagcctttagtgccaagttgccatccctgttctcaagggaataataagcccaaatagacatggaaggaggaggaaagacactattccaacagtcaatacgtcccttgggaatatagcaaac

SEQ ID NO: 94994 - DNA, 1062 bp, Homo sapiens
ccgagatcgtgccattgcactccagcctgggcgacagagtgagactctgtttcaaaaaaagtatgtggtggctcctgcctgtaatcccaacactttgggaggccgaggtgggtggatcccttgaggccaggagtttgagactagcctgaccaacataatgaaaccccttctctactaaataaataaataagcaagcaagctgggtgtgatgttgtgcgcctgtagtcccagctacttgggagactgaggtacaagaatcattgagcccgggaggcagaggtttcaatgagccaagatcccaccactgcactccagcctgggcgacagagtgagactctgtctcaaaaaaaagttcttgctaaaccccgtcggcacttggtattaaactaaaataccctctcgcggtgcttactatgtacctggtactgttataaatgctcttcatatattgtttaattttcataataatcttgtgagataggtactgttactcatccccaatttacaggtgacaaaacagaggcgcagagagattagctaacttgcttatggtcacacagctagtaagtggtggggccacgattcaaactaaatgttcttcctcttcagtcctacgtaataggtgtaaaatggaatcttcttgtgatcttcttttgtatttttctgattactgatgatactgagtattttttcatatgtttattcccttttcatgaagaagaaatataaaatttaaaaccatctccctattgttggggcactcaggttgtttgtaattctctgctgttcatgcttgagggaaaatcattggcacatgtagcttttttatgtcttctgttggcttgtttacttttacatttccagtgaaattaagagtacttagtggttaaaaatggctgtgctcttccacattgccttgtgatcttgaggcaattacttgccctctctgtgtttagtgtccttatctctgatctccaccttggaggagcctgtggtgattaaatgagataagtgaatgtgcgacaatttgcatgatactctgcctgtcataagagggttcca

SEQ ID NO: 94995 - DNA, 2035 bp, Homo sapiens
tcgcgcggcatggtatgaaaccacccaactgcaactgcgatggcccagaatgccctgactacctcgagtggctggaggggaagatcaagtctgtggtcatggaaggaggggaggagcggcccaggctcccagggcctctgcctcctggtgaggccggcctcccagcaccaagcaccaggccactcctcagctcagaggtgccccagatctctccccaagagggcctgcccctgtcccagagtgccctgagcattgccaaggaaaaaaacatcagcttgcagaccgccattgccattgaggccctcacacagctctcctctgccctcccgcagccttctcattccaccccccaggcttcttgcccccttcctgaggccttgtcacctcctgcccctttcagatctccccagtcttacctccgggctccctcatggcctgtggttcctcctgaagagcactcatcttttgctcctgatagctctgccttccctccagcaactcctagaactgagttccctgaagcctggggcactgacacccctccagcaacgccccggagctcctggcccatgcctcgcccaagccccgatcccatggctgaactggagcagttgttgggcagcgccagtgattacatccagtcagtattcaagcggcctgaggccctgcctaccaagcccaaggtcaaggtggaggcaccctcttcctccccggccccggccccatcccctgtacttcagagggaggctcccacgccatcctcggagcccgacacccaccagaaggcccagaccgccctgcagcagcacctccaccacaagcgcagcctcttcctagaacaggtgcacgacacctccttccctgctccttcagagccttctgctcctggctggtggcccccaccaagttcacctgtcccacggcttccagacagaccacccaaggagaagaagaagaagctcccaacaccagctggaggtcccgtgggaacggagaaagctgcccctgggatcaagcccagtgtccgaaagcccattcagatcaagaagtccaggccccgggaagcacagcccctcttcccacctgtccgacagattgtcctggaagggcttaggtccccagcctcccaggaagtgcaggctcatccaccggcccctctgcctgcctcacagggctctgctgtgcccctgcccccagaaccttctcttgcgctatttgcacctagtccctccagggacagcctgctgccccctactcaggaaatgaggtcccccagccccatgacagccttgcagccaggctccactggccctcttccccctgccgatgacaagctggaagagctcatccggcagtttgaggctgaatttggagatagctttgggcttcccggccccccttctgtgcccattcaggaccccgagaaccagcaaacatgtctcccagcccctgagagcccctttgctacccgttcccccaagcaaatcaagattgagtcttcgggggctgtgactgtgctctcaaccacctgcttccattcagaggagggaggacaggaggccacacccaccaaggctgagaacccactcacacccaccctcagtggcttcttggagtcacctcttaagtacctggacacacccaccaagagtctgctggacacacctgccaagagagcccaggccgagttccccacctgcgattgcgtcggtaagtccgcctgggtatcagggaagggcagagaaagggctgtggcctggtgagctaggatttctaggccctgcctttcatttggcaaacatttatttgtgccaactgccacactgggttctgggaacacagaaatgagctcatagcctagtggaaaagacattgaaagaaattgacgtgatactgtgcgtgtatgccacgtcggctgagatgggcataggtgctttaatacacaaatggagttgaaggcataatagaggccttcttgtaggaggtagtacttgcgccgagccctacagagccatcagatagaaaggacacattc

SEQ ID NO: 94996 - DNA, 1119 bp, Homo sapiens
tgtgttttagtggccttcccagggaaacctgaccagccagttctaggttgtcttggttttagatcttcgtatcttgttttccagctattgggatggagttgctaagatttagtttgtgccttctccttgaaaatttcctttctctgtccttaaccgtgtaagttttgagtttttgtgacttagggcagaaggtggtcaccaaaagctacatgatgtttctcttcccagcataagaccctgcagtcaatttgttactttgaattttctccagacaatagcaactggaacagagcccagaagttctggcatattcttatgttctattttctgtataccgtgtggtctcctagcacctataaagagctttcagaccactgcctccatcacccacattctcatattctctttctctccctccccactcccccctgctctcccttggccttctcctctccccacctcttcacatgcatccttctgtaattctattttatggttcaaaatagtgcccatttggaatgaatcatttctaactttttagttgaaaatactcattcatgaaatgtttaagcactggtaccttgcatctcacctgatcttcaacaattctattatgtaaaaacattattttaactactttgaggctcataaaggttgtgtaatttgcccacagtcacatagtttgtttggcggagcctggacaacagctacctgttgagcttatgttatgtgccaaatactgtgctaagccctttgtgtattttacacatagaggcatgaggattagagaggttgggaagtaactcattgtagttgcccaggtttccgtctgcaagatcagtatttgttattctgtgctacattaacaattacgtaacaattatgttttatacatgcctcaataattgacattgtatacaagatgctctagaagtccagagggaaaacaccctgagaaagttcaatagggcttcgcagaaaaagtggcatttaaactaggccctttcttggagctggagctgcaaggaaagaaagggaaaaaaaatgagtttttccaaaaggagagatccagaaaggcactgttgtcagtgagaaaacatatttaaggttacatgggat

SEQ ID NO: 94997 - DNA, 1052 bp, Homo sapiens
agctttgacaacacttggttttatcagatttttaaatttttgccaatttggtccatatgtgatggtgttttattgtgattttaatttgtatttcctgatttctaatggagttgaacaccttttcacatgttcataagccatgtgggtttcctgttttctagcatgcctattaactttcctgttggtggtttgcttttctaaattaatattgactaattgatattccaaaaatgtttactctctgtgtttctgcagaacaaatagtggagaaagatgaaggtccatattatactcacttgggatctggccccacggtcgcctctatccgggaactcatggaggagcggtgagtgatacacagatgtccaaggagaaatggatgtgctgttaatggaatacggatattaagcgcctctcatttttctttgccttgtaacagacaatatacagaaaggaaaccctgataacgggcttagggaaggtttactgtgggatcctcacttccattgtttctgggtttctttcattctgtaggtctgcccaattcatgtccccctgcttctctctgtcttgaaatgtttttatggttatatggctctatgtcctgtagagttagtttcctacatctgaattttgctgatagctttcccgtggtattgtggtatcattaaaagtgtttaacatgcctctatgtcctataaattggtagttagaccaaaagccctgattgagatcaggttatttttcctttttttccaaaactacctcataggtggaattttttacctcccctaagaggaatataatgtctcactcctggccagtggaaacctactcaggttgtcccctaaatcctttggacaggatcgtaggagtgtttcatagctttcttgatttctcatatgacaagatatcctgggttcacattgtacgtttatccaagaagtcctggttccttttattggaggaaaaggtatttagaaaacagactctgtctactaggggcactcatgactacacaggggttgttcattgtttttaggctgcttatg

SEQ ID NO: 94998 - DNA, 1032 bp, Homo sapiens
gtttagcttttggaggcattgccagactgttttccacagtgccaagccccttgcatgttaactaaaaacacacaggtaggcagcattttctctgcaaatgttttaggataacataaaaatctgactgtattttggcttacaatttttatctgtgtatttttactcctaagcctatgtaagtcatcagcaacttagattttgtggtaattattttttatttcactctcaaaataacttttatgtttttgttccctaacaaaacatttgttcctaataatgttccctatttgttccctaataatggtctcttagcttgtaaggttgctgtcttcagggcatgacatccctagaaccctgccgttaagacctgcaccctgggtctgtgtgacaaagggaggggtggcaccatgcagaggagcacgggtacctggctcctgcccctcacaccctgcgtccctgcaggtgatccgcaggcacacgctggaggagaagctactctgcctggtgcggcaccgggcaggccaccactgccagaacgctgtgatcgtcatcctcatcctggcctgggagggcattccccgtagcctcggagacaccctctaccaggagctcaccgacaccctccggaagtatgggaaccccaccagccggagatgcggcctcaacgatgagtatgtagcagagggcttcagggccagggcccacctatagggtcctgggcagcaaatacaggagactgcaggcaaccctggggaaggctcctaggggccctctctgcggcactgtttgtcctgcacagttaggactgtggttgaggaaggcatatccacagatcttgcttgagctgggttctagctctggctccagagggtctactagtttgacttcaccgttaaaccccaggtcgataacactggcactaatgatattagcgagtgtgaagtacatgtgccccataaatagaaggtatcgaagatatttacaaaacctgcccttggccaggcgtggtccatgcctataatcccagcactt

SEQ ID NO: 94999 - DNA, 1034 bp, Homo sapiens
acttagcagttacgggtgccccaggctcttcccatgtaaaccatctcttttaggtaaatactccaaatatcgaagatacatattcaaatcgcttgtcagaatttggccctctcagaggtcatttctcccccccatcttcccaggacacctttctaggtgtgaggtttagcaggaaaggcggtctcccgcatgtgggccatcctctgggcctttgctgtacttcccaaggtatctcccaccctgcctggctgccggacagatgtctctgggcagtcatccgggcccttgcagtctccatgctgggggcctggcctggtccctgggctctggactggtgtccatacagtatgaccgctaggcacggcaccttctctctgtaggctccttacccagacccctgccctgcagggcctcccccagccccaagacagcaggggaaggcgccctcaggctgtgggggccggagcatctgctcaggccgcctcccctctgttgtttgtcctctgatgcctgcatggcaaaggccctcctgagaggcggtctccactcagctccaaatgcaaggaaggcacaagcctatccaggttgtctgccattttaccttccttctgcctgggctcctgagcgggtggagtgctggcttcctttgctaggatacagacaaatatccaaatacgtgaactcaagttgcaaccttccaaatctctccaagctcctagtaccagaagggcttcccacttcccgtggtgcagggacaccctctctacaccaaagcctatgtcaccttctgtgctctgactgccaagcttgggtcctcataagaaaaaggaagcattttcaaattcagaactctttgtttaccccagacctggcttttagacttaaatagtctaatagacctgtatgcaaatagtctaatttgttattagatttttatttacggtaagattcaccctcccttacaagcagcagatgtggttgcttcaatgaatggagccctggggctaccaggacctaagaactactaggaatgg

SEQ ID NO: 95000 - DNA, 1059 bp, Homo sapiens
cgctctcccgtcttttagctactatggctttccatccagcaaccccgtcttcccctctcagttcctgggtcctggtgcctgggggcacagtggcagcagtggcagttttgagaagaagccagacctccacgctctgcacaacagcctgagcccggcctacggtggtgctgagtttgccgagctgcccagccaggctgttcccacagacgcccaccaccccactcctcaccaccagcagcctgcgtacccaggccccaaggagtatctgcttcccaaggcccccctactccactcagtgtccagggacccctccccctttgcccagagctccaactgctacaacagatccatcaagcaagagccagtagacccgctgacccaggctgagcctgtgcccagagacgctggcaagatgggcaagacacctctgtccgaggtgtctcagaatggaggacccagtcacctttggggacagtactcaggaggcccaagcatgtcccccaagaggactaacggtgtgggtggcagctggggtgtgttctcgtctggggagagtcctgccatcgtccctgacaagctcagttcctttggggccagctgcctggccccttcccacttcacagatggccagtgggggctgttccccggtgaggggcagcaggcagcttcccactctggaggacggctgcgaggcaaaccgtggagcccctgcaagtttgggaacagcacctcggccttggctgggcccagcctgactgagaagccgtgggcgctgggggcaggggatttcaactcggccctgaaaggtagtcctgggttccaagacaagctgtggaaccccatgaaaggagaggagggcaggattccagccgcaggggccagccagctggacagggcctggcagtcctttggtctgcccctgggatccagcgagaagctgtttggggctctgaagtcagaggagaagctgtgggaccccttcagcctggaggaggggccggctgaggagccccccagcaagggagcggtgaaggaggagaagggcggtggtggtgcgga

SEQ ID NO: 95001 - DNA, 4450 bp, Homo sapiens
acgttgtcgagagaggttgggcctgatgggagcaacactcatcatcaccaagtcaaactttgttggagtgttggtttttcttgtgatattagcagaaatgatctcatgctagccatgtggatgtgtgtgtggtgaatggggggcttcatcaggacacacagaggggaatgtggccacacggtggatgaccaccaagccctgagatgaacaggtatttactgagcagttgtattcagatatgggtcttcatgaatcatgtttaacaatcagatgaccgctataggcaagttcctgagcttccgggtgccttgagtaagagctgagaaccggcctgctgggtgtttactgtatctgtttggaagcactggcggagggtcgttgtaagatgtcctgagcatttatgtggtctggttttaactgtaaatagtgaaagatttttttaagcacttttgcctagatttaaacagcaacttgaaaaaaaaagtatgttttaacatgtaattgtgggagaaattgtaaatagtagccgaatatttaatgtgctttgtctatcctccacttttaccatattctgtaaagttgcatttattttacaggacaaaaaaatgaaatattattgcttttgaaataaatacccaagagcttatcaggacttagaattattcagaactcagatttataggaaaacctctgaccttcagtttgacaagctaaaggaagcagagtctttaatgagcatgctaattttctagttttgaggaaaaattgggtcctttaaatgctattttgcttatcgcatcagtacttttatgcaggtctcatttgactccgtgcttaggtagatgcgggggtgccttgaaaacttcattttaaatgatcttaagcaagaaatacaatattttacgaaacatttggagaatgtgaccgtctgtatgacccgtggaagccccaggttggctgttggtttggaaggtcccgagtgtaacccaggtgattctgatacttggcatgtgtgaatcttcctgatgtatgttaaataaactcttcccctcatcaccctttggtaggaaagccattagatgaaaggagaaaccaatacaagctaaaagcatgcgacgtctgtcccccagcccaaacagccttggttcatcagtttctgcagtaggagataggctgctgagaggtgagtcaagaggcagtctccattggatgtccccactccccgcagaatggcgtttccagagttaggcggtgtggttgccgtgctcaagcccatgctgatttgtacactacatgtctaacctacctcaaatctcagtcattaaaattagcatgctttagacatatatttaaaaagtaactatgcacagctctttatcccccccttgctgctgaagctttcttaaagagaaaaatcaaatttttattttttactggcactatcattttttaagtcctaaagatgattaacagacatttttatcatgagaagaaaaataaagccattgcaactaaagaacctaacagcatgaccaagttcgaagagtcatattatagcaacggaaatcgatggcgtcttagtcatctccccagtgtgccctgtccacggacaccatccacgtgcagtgcaaacatttggttccttttctgctctgttttgttttccctgcctgttgcgtgcaagggaagtgcttgtaaagttctgtgctacgagatttttaaaataaaaatcgcttcgcagcaggttctcacaaaataactggtgctagctcaagaaatcatcatctgaccatcagaaatcttgactaaaggtgttgcatggatttgggggtctttcggtttttggttttgggtctggcttttagcagggccaatgtttcccacaccccggcttcatgggtactgctttgccttctcaccaaggtgacgatggtgtgcgtggaaagagatgataccccaccgccccctcttggtccttccaccagcctcttttgggaacagtagtttgcagagcaagggatttttaaagcgctaaagcaaggaaagaagtagcagagcttaactgctttgtaccacacagcagtagatgtgcaaggacggttgacaatgagtcgatgataacctaatttcattgagagaaacccagccagacttgcttctagaggtttaatcaccatgagatctcaaaccaaggcaaagctggtggaaaactatatgatatccctgacgtgcctcaaccagtatctctttccttttgttactgaagtgtgttttatggactaggaagcatttttatgaattgaaatagtctaaataaaatggtgctatggtgttttaatgtgactgtccctgatcctgtcttgctgaggtgctatcaacgttctgaaaccacaaccaaccaaaaacaaggtgggctccagtctcttggcttttttttttccctcccctcttttggtgctgtcttagacccgtttaccgtgctataatctgctctgagcagtgttgtgttgtgttgtattgttcttcccttggtggccaaacaaagcaagtcgagaaggcagctatctccctttctgtgatcgggagtgggcctgcctggcttggcaggtgctttttggttccacacctgtcttctcaggcttgatgtgaaagaaagggcgaagggttttttgagtttttgtttttgaggaaggggagttgggtacttctgcctctcctagcatgataggcattctcatagccagggacagattttctcctgcagcccagggtgctaagcagacatctctgggagtcccaagggcacaccaagggagaccagatggatctccttcctcccctggcactggctgggaccatggtgggcaggggcttcattctctgacccagcgttgcttctgcctctcattggtaaccccttatgttcggactaaaggaaggagctttctttgctcactcgatgccactgaggctgctttttagttggtgctaacctaaatttcttcttgggtccacagaagttgatgttttaaaaactcaccaggaagctccattttgtgtcatccactgtcacaataatttttttaaatacctcaaaaacaggacatcatgacaacttcagtaaagtagattccatgagggtctgatacctgcaggttgtccgtctgatgacatacttgaccttgaaaaatctggggtcattttgtttttcattcttcagcagttaagatagcggaacgccgaaaggaaggagcgtagttggctgtatttcatgtttaagttttgcttttgaataaaatgtgaatttcctatgcccatctcattgagctttctcagtcattgttgctgtcatttgaaatgactccctcaaaacctagttttattagccagctgcctctgctgtagtacatggccaacttcaacataccctggaccaaaacatttttgaggtgcatacccccaacataagttacacagtcccacatccaggtgcacagagtgcgagtgcactccgcgagtgcggggggaggggcggccccctctggtgctcccagcccttcctcctgcagagctgcaggcaagagcagagcaataggcttctcccctgagcagagaccgcagcacagaaatgcaaggtctaaagttgctttttgcctaagaatcagcgagcgatttggcctacttcctcattggcttctattctgatatcagggatgctttttgtagtggtattgtttgctccctcttcgcgttttgactacccgtcattcaggggtaactcatcactcttcacacggggatttaaattaagaaactaattggctcatgtgaacattccaaattttcttggtttcaatacccttttttttcttttgaggggaaaagaggggagaaaaacaggagtgatgtcatttctttttcatgtattccaattaaagaaacaagggcaggtcgtataatggcatattaatacattagacttaatctagaacccctgtagctttttgatgtgttttatttcttatctctttgaattcctgtttggttacttggcttccaatggaggtgaacttaacaaccatacttgaatattccgtcttgactttgtaaactgtggctacttgaaatgaagtttatctggggttgatggatgaatggtagatttttgcaatgtctcaaggcaataggatgtgtattaaactgtagatattcttagtacagtaaatttatgctgataattttattttgtataatttttacctttttgttaatattttttccttccactttattggtttgcctcctgagctacccctccttaccctcccttctccctcagtgtttcagtaaatttaatttagggtgcctagaaattgcaagtatgtatcctttttgatttgtattttattataatttacacaaacaactgggtttgtgaactgtattactc

SEQ ID NO: 95002 - DNA, 1079 bp, Homo sapiens
taaaggcgagggagtgtggaatttggccccaccatccagggcagtggatggcctagtggtatggatctgaggcaggctatccagcttttctggctctgtatcttaccgaattcaaccttgggcacattactgtgtgcctcagtttccttacctataaaactatcggcataatagtgtcacaacattatatggaagcaaacatctcttgaattaggtttggggcctcttgtctctggagtcaaattgagttattaacaatcatcctgtccccgccaataaaagtttattctgtgttttggggcacttacatggactcctgataccacagagcccctctgacataacccatggctgtgctggcgagggctcaggggcctgccttgcagggggaatggcaggcgggcctgcacagtggcccagctcaggggcaacagcatcttcctctgccctgaccttcctctctgttctgtggcagcttccacttcaccatcggatgtttgccactcagactgagggggagctcagagtgacccaaattctcaaagaaaagtttccacgagctacagctataaaagtcactgacatttcaggtaaggtttctctcactcttcctacggcgcttggataagattttgccctttggaaggacagagggtcaggggcttggaggagggggcttgctgctggtgagtggcttctcaagatgtgttgctgctggacaggtggagctcggctgcccccacctcatgggatggcagtcaggattcagaaatatcagagggaaactgaggacaaggcgcagctgggaggactcaaggttgccagcctggctcagctcagacaaggtccctctcagtcaccctagagctgaggtccacagtctgtcatttgactttgaataggttttgctctaattttcccccattcttctgacaccctaggatatcagagctggagtggaccccagaaagattttcttcagctgctttactttccctaagaggaaatgagcccagagaggccaaaggaattgcctagctcctcatagggaagagacagtggaactggaaccagaaccg

SEQ ID NO: 95003 - DNA, 1123 bp, Homo sapiens
caatggggggctcctcttcctttctctcattcattctttcattcattcattcactcagcgacaacggcattcgaaatttcaagctctggcgcgctctaggggagctcccgagctgggtggaggttggaggtcaggcggacagacacatgaacagtcataatactgcgggcacaggaaaaaaaaaggattggtttaccgagcagaagacaggagtcatagcccagagtcaaggcgtgggtgcgagggactgcagcggggccggggccttgggaaggtcgactgggcctctgaccttgatcctcctccaaatcccacactaccggagcagaacccaagcagggggcacttcccacgcgctctcctaatctctccccctttctgaaccatcctttgcttcagctcataccattctttctcttaactttcattttccttctcccctggttctgaacctgcctgccctgtgcatgaagagaagttcttccactgcggtgactttcagcgtggacagtgatcatctggggatgtcagttgattgttccactaaaggccgctgcccacagatccgctaagatgaaaggcttctcccaaggattctgcaacgctcacctctctcaccccttagtagctgccgattctgtctgccatctggttactctctgcctttaccctcaagattctgcccccagaagcagctccaccccaccctcactcctggcaatcctgtccagcctctcaacatcgagtttctgtccctccacacagcaggcagacaatcacactctggacctttctcctgtcttgcatttctgtccctaattgactagttcttcccctgctcattcattcatccagcaccaagtgcctctgagggcctgccctggggtcagctctgggatgctgccggactcattcctggcctataagaccagtggtgagagagccagtgcacagctcattttaaaggaggtgctctgagattctgtgacacaggaccctgctctgagctatcaggaaggactgaggggtagaggggtgggaccttcagcaccagcacccatgaacggccctagtgtcctccaacctgtcatccacgtctagtcagggaccagtgcccggtgct

SEQ ID NO: 95004 - DNA, 3852 bp, Homo sapiens
ctagaacacagttacccccttgcttcatctattgctagaactatctcattgctatctgttatagactagtgatacaaactttaagaaaacaggataaaaagatacccattgcctgtgtctactgataaaattatcccaaaggtaggttggtgtgatagtttccgagtaagaccttaaggacacagccaaatcttaagtactgtgtgaccactcttgttgttatcacatagtcatacttggttgtaatatgtgatggttaacctgtagcttataaatttacttattattcttttactcatttactcagtcatttctttacaagaaaatgattgaatctgttttaggtgacagcacaatggacattaagaatttccatcaataatttatgaataagtttccagaacaaatttcctaataacacaatcagattggttttattcttttattttacgaataaaaaatgtatttttcagtatccttgagatttagaacatctgtgtcacttcagataacattttagtttcaagtttgtatggtagtgtttttatagataagatacgtctattttttcaaaattcatgattgcagtttaaatcatcatatgacgtgtgggtgggagcaaccaaagttatttttacagggactttattttttgatctttatttgagattgttttcatatctatctaaattattaggagtgtgtgtatcagaagtaattttttaatgtcttctaaggatggtcttccaggcttttaaactgaaaagcttaattcagatagtagcttttggctgagaaaaggaatccaaaatattaataaatttagatctcaaaaccactatttttattatttcattatttttcagaggccttaaaattctggataagagaatggaggaaaatactcagagtacttgattattttatttccttttattaaaaaattacttctatgtttttattgtctcttgagccttagttaagagtagtgtagaaatgcatgaacttcatcctaataaggataaaacttaaggaaaaccacaataaaccatgaaggtgtacacatcttataacacagataaagttttggtgtgctacctattcttgagagagtgagtgagtgtatgtgtttaaaggaaacaaaatgggagaaataagttttaaaaaaatcctcattttgttaatattcaaaagatggactgagcttccacttgggttttatcttgttttaattgtttttgtatcaaaacttgaaattcctctatttctattgggatataaaagccttccccttcagtgaagaaaacatttattttttatttgattcctaggatttagtaaactctagctgtctatttaaaatgtactgaggcacaacaagtattatactggaagacttgccaaactggcaaagctttaagttcatcagcattctatgtggttcagagctgtgatttttgcaaagtattttaccaacctcctcgatggctttgataaaggttagatttgatgtttttttttagatttatttttcttactccactaaactataaagaaaataattacttagaaactccattttaaataatcatttcctagaaattcttaaatatatacagaattttaaagaaaacatttcatctgatttagttagcatccacatatcattgaggaattaaagtgtgggacagtcattattaaaaaaaagagagaaaagccctctattagacattccacaatccatgttttaagcttatccaaaggtccaaatgtcagccattctgtatgttcatgttgatcatttgcgaacaagaaagcaggtttctaggtatcacttaggatgtgaactgcctctcaactttaaaccctgttagctttacttttttaagtccacaagtgatgaaactagtttctcagctaggcttgtactttcctcattatttctagtatttcaaatattctcaaacaaaagagttaccacttttctccatttattttcagttatggaaatgttccctctcttcaccactaagctccaaagcaaatgaaagacgatcacatgtcaggacagtagtaaaggcagcttataaatgggacataaatcagagatgtgttggtattttgagactcaagactgtccttttttaaaataaaaataaaaacattaccaggttcccaagccaatctggcttaaccaacagtgcactgaaatattagtgtttacctccaaggctagggagccaaggggaggaggagaattggaggaaggggagataatgggaagaggatggcgccttcctgagttggctagagggccaacctttgataacagtttgacgaaatcaatcttttttttttttttttttgagacagagtctcactctgtcacccaggctggagtacagtggtgggatctcggctcactgcaagctctgcctcccaggttcatgccattctcctgccccagcctctcctgagtagctggaactacaggtgcccgccaccacgcccagctaattttttctatttttagtcatgcctggctaattttttgtatttttagtagagatggggtttcaccgtgttagccaggatggtctccatctccttacctcgcaatccgcccgcctcagcctcccaaagtgttgggattacaggcatgagccaccgtgcccggcctatagaaatcaatctttttgactcttctcacttttatctccccatgcccaaggtttgcctgttccataacactcactcccttcccccttgctaatcagaagccatctcctctcagtgtctgatctctgctcttcatacatgattacagtcatggggtagagagtgcttgctaaattatgcagttaatcctatggtgctttaattttcaggccttcaaaaaacacttgtacagtgatgtgcagatttttaaacagttgaacttccttgtactacagtttttgtattgacagccaaatttgtctttcattcttcagattgtgaataaagtgatttttacagggcttccagcaaagtttttcctttcatctaaggcttgtagaaccctagcttatatagctgcttacatgagaaatgcaaaatctgtattcaccatgactttagtaacaaaggtaaagttttttagtagtgccaaggcaagaggaacaatcttggtggtagtactaagttttgtcaatattgtggtttcctgattgtattgttggctttctctctgagcattgaggtatactagaagtagagcttctcaaacataatatcattacctcataagcattaacaaatcaggcccaaagagcgtaagtcctagaaatttgttttaaagcagccctagtcatggtgctggtgctaccgccttgttttaggagcctgcctcctgtcagtatgaaaccctcacctgaaaaatgccagcctggacaccaaacactgagccccttcaacaggcacattatttccccctgagatccataagggaatttagtttctactattgtagagttctgaaaagaggtaaaatagtagtcctttggtcatcctatttttgctttcaattttgatatttcagactgtaaaaggccttgggggatgatagtacatgtggtagcagtaatttttttgaagcaactgcactgacattcatttgagttttctctcattatcagattctgttccaaacaagtattctgtagatccaaatggattaccagtgtgctacagacttcttattatagaacagcattctattctacatcaaaaatagtttgtgtaagttagttttggttaccatctaaaatatttttaaatgttctttacataaaaatttatgttgtgttttaa

SEQ ID NO: 95005 - DNA, 1054 bp, Homo sapiens
gtgagttaacattgtcgaagtattctttctttttttaaaattttattttattaatataaatagagttgggggggtttgctgtgttgtccaggttggtctcaaactcctggcctcaagtgatcctcctgccttggcctcccacagtgctgggattacaggtttgagccaccgtatccagcctgtttctctttttgaatgataaatctgctctttttaacattgttatacttgtagagactgccaaattctcctccaaaaagtttgtaccaacatgtactccccccagccctgtttgtgtttgccagtgtttcttcaccaacactggttattactcattttttaatattttctaatttggttaaatttctgttttaatatgcatttaaaaaatgttgatgagattgagcattttagcctttttgtttgttttattgatcattgtgtgttttctgtttatatctttcatctatttctgtgtaaaggatattagcgctttgtcgtatgtgttgtatatctttttccccgggttaccttttgtctcattttgttcatggagtatttttgctgtacacaaccttactattttgtcctattatatcttttatgacttgattttaatataacaattagaaagcttttccctgcttcaagattataaaaatatttattcatgttttctttttttatttttttattttttgagacagagtctcactctgttgcccaggctggagtgcagcggcacaatcttggctcactgcaatctccacctcccaggttcaagcagttctcatgcctcagtccctgggtagctgggactacaggcacatgccaccatgcccagctaatttttgtatttttagtagagatggggtttcaccatgttggccaggctggtcttgaacgcctgacctcaagtgatctacctgccttggcatcccaaagtgttgggattacaggcatgagccaccacgcctggctgggaagttttttttccctgaatgctacattaatttttttccaaatggaaatactagtcagtttgtcccattac

SEQ ID NO: 95006 - DNA, 1073 bp, Homo sapiens
tttcggagggagccgctctcctgcgactcggggcgtcgccggggcccgtggccagtcggcgggcgggacgggggtggcgtgcggaacgcgaaggcatcagtttacgcggagccttccgacagcgccggccgcctctggctgggatgctgagagtcgtctgggggagaacaggcgagggttccaaaagagcagccctcggcgagttgtccttgcggggaccctagcggcggagggcgctgctgcagctgatgaaatcgcggagccgacttgctcggggtccccgcgccgccctcctccctccgccggtgggagtggcccgcgctgcctccgctctgccaggaacatgaacggactctgggcaccctagctttggctgcagcccaccagagcctgtcagtgccgggctgcgtacatagaggtggcaaacatccgggaggctcccagggccttagggaaagggggaatggagagtgacaagtacccatatttcagcggtacttgcagaatttcagttttacaagatgaagagttctgaagatggatggtggtgatggttgcacaacatatgaacgtatttaataccactgaactgcacttaaaaatggttaagatgggccgggcgtggtgacacgcgccgaggctgaggcacgagaatcgcttgagcccaggagttcgaggctgcagtgagccgtgattgcaccactgccctccagtctgggcgacagagcgagaccctgtctcaaaaaaaaaaaaaaaaaaaaaagttgataaggtttatgttatgtgaattttaccacaataacaaaattgggaaaaatatacaggggaggaggaaaggaaaagctctgtttgcatttttgggtttccttgggaaggtgatttggtcggtcattagagcgctggcattgttggcattgttagagccctgcaccttacaacatcagccccttctttttttcatctaacgttcactgtgtaccagacactatgccaagctgtgcgaattcaaagatgagaaaaactgttcttaatggagctcatgttcctgacaaggggcagaacacgcgtgtaat

SEQ ID NO: 95007 - DNA, 1440 bp, Homo sapiens
tacaggcatgagccacagttttggattttatttgaacagtcctcttgacttcttcctattctgttgattacctatcttaatgggatttttttctttcctttttttttttcttttttggcaggggaatctctccctaggtcaggttggagtgcagtgctgcaatcacggcttactgcagccttgacctcctgggctcaagtgatcctcccacctcagcttgtgagtaactgggaccacaggagcataccaccatgcctggctaattttttttttttttaacttttagtagagatggggtctcaccatgttgcccacgctagtcttgaacttggcctcccaaaatgctgggattacaaggcctgtgccaccatgcccagccctgggaattttttctaaacacatctgtgaatgcatttaattctgggataaatgttagctaatatagttacaattttggattccccgtgggacttagctgactctccatttccctgtttattttggggtagcagttaatctgccccttggcaaaagagatgatgctaaattagttaatgactcactcccaaggctgtatttcacattttgcagagttgtgggaagcagaggagggctgacagttatactatgaaagatattcattgcatgtgactttgtttttggttcttgttactctttgactgtttttctttcttttctttttttttttttaagcaaattggcataacatccagaacctgcttttggaagcaaagtttgggacttggaacactggcttttcccagaaccctgtgtccttaacttcagtatatgattttatctgaatgtgctaataccattttctctaagtttactgctttcaaaagaaactttttatgaggtgcaagctaagtcattctcactgactagatatacatatagtgtatatacttatatatatctccttatgtgtaagtgtatctattttaaggatacatgtgtatgtgtgtgtatatatacatatatatataaaaccaagagaaaagagtaagaaattagttttattgaacatatatgcctggcacattatatatgtttgttatttcattcaacataaatgactgttctaagccgttttaaagtagtctttcactctgtagtgttccaggattaggaatgtatttttggcctgcggtgggcattccaggtactaatacaaatcaggaatgaggaatgttgccaggtgtatttgtatcagcaaaacccccctattttaattttttttttttgagatggagtctgactctgttgcccaggctggagtgcagtggcacgatctccgctcacggcagtctctgctcactgcaacctctgcctcccgggttcaatcgattctcctgcctcagcctcccaagtagctgggtctacaggtgcgtgccaccatgcccggctaattttttg

SEQ ID NO: 95008 - DNA, 1173 bp, Homo sapiens
gtttcatgtgttggccaggctggtctcgaactccttaccttgtgatctgccctcctcggcctcccaaagtgctgggattacaaacgtgagccatcgtgcccggcctatattgtttgtttattcaactacagaatataatttatcgatttaaaccaccataaaaatgaagtcagttgactgggaaatgatttgaaatacatgcctggctgctaacaacagggacaaaacacgaactacaaatggcatataagcagataagaaaaactatttaacctcatggtgaggggtcaaacaattgcaaattaaaactgtaaaacacttagtaatgatcagggcgcagggtggtgtagcagttaagagcccagactgatgtgagactcagcttgaccaagcgctgtcagtcacttaaactccctgagcttcaaattaatgataataatgatttctatcaactttatccccctccatatgtagctggatatattcattcatttatttatttatttagcagagacagggttttgccatgttgcccaggccagtctcaaactcctgggctcaagccatcctcctgccccggcctcccgaagtgctgggattacaggcataagccactacacctggcagagttttagtttttataaaaattcaagttatttggttttgtgactctgttgccttctgcagaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggtatgtgtccttctgagacctcgactgcggttcagttgaggtttatatgaggcaaagtccattctaatttatgatttcttttttctgattaggaaacccaagcagaggaggctaatgtgattgaactgtatcccaaaactttgtcataggaaatcagactatatctttcggggtttatacagtaggacaggagatactggttggtattctctgtggcttctggaaagaatataagctacattctgttcttagtctttatatttgataggtgaccctgaatgcattttacatttgctttcct

SEQ ID NO: 95009 - DNA, 1180 bp, Homo sapiens
aggactataggcatgtccaccatgcccagctaatttttacatttttcctagaaatgaaagtctgtctgtgttgcctgggctggtcttggactctgtgcttcccaaagtgctgggattacaggcatgaactaccatgccctacctaaaatggtttctgaggggtaaaaaggccttgttactttatacacctggttcttcatgtggatttggcttaaaggcaaaataaactcaaaagagtgaatattttattagaaatgggacagaccaactcagaataccaattacgccttgatttagtattgtggtcttgatacaaaggacagtggagggaagcagctgtgatagacgatattggctttgctattggtgtttggctttgcttatgcgagttccttccatgcagatgaagtacatctcagaggcaagctgtagaagaatagatttccttgcgaagcagataagctggagtcaggcagtgctgactatgcggtggtgatttaaggcaactgtgccaatttctttttcagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggtaggtatatcccagaattgcatgtctgtgttaatattataaaagtagtactggcaaatggtaaaaactcatacagtcccaaagagtggaaaccctactgcatatcctctagtcttactccccaaagtttacctctcttaacagttttttttttgttttttgttttttttgagacagggtcttgctctgtcacccaggctggagtgcagtggcgcgatcttggctcactgcagcctctgcctcctgagttcaagcgattctcatgcctcagcctcctgagtagctgggattacaggcacgtgccaccatgcccagctaatttttttatttctagtagagacaggtttcaccatattgaccaagctggtctcgaactaggcctcaggtgatccgccccctcagcctcccagagtgctgggattataggcatgagccatcgtgcctgcccttaacagttgcctatgacagtttttgctttttaatccagaagtctcagtgaa

SEQ ID NO: 95010 - DNA, 1028 bp, Homo sapiens
ggggtttcaccgtgttagccaggatggtcttgatctcctgaccttgtgatccacctgccttggcctcccaaagtgctgggattacaggtgtgagccatcgcgcgtggcctctatttttctttttaattttttctttaagagtcagaggtttcatcatgctgcccaggctggtctcaaactcctggcctcaagcaattctcctaccttagcctccctggcctcaagcaatcctccctcctgctgggattacaggtgtgagccaccgccccagccctcagtgaaggaaatttaagatttgatagtggtgacagtgcacattcctgtaacattttgtagcctgtagtatgctttctcctgttttcttttagcccttattatgtgtagcaagttacagctccagttgactgatgaggcaaaattgggttcatgttctaggccatctgactttgttttcctttggactggcactacttttaatgtcaatacatatatttttataggcattccaaccctagggaagaatgtggttgtggctggaaggtcaaaaaacgttggaatgcccattgcaatgttactgcacacagatggggcgcatgaacgtcccggaggtaaggaaattgctttcagggaacactgtccttttttccccatgtaagaactttcagaagccatcctgtgcatgtttggaagtattaactctgttatactttgtatttgttgaaattttgttaacagacaattcagggagtaacctttgtagagaagctgcacccagtgtcacctgagtttctttattattcatttatcatgtaactagcttcagaaataaatttaagttttgagtataagcatggttgtaggcaattagaaaatttcagctatagctttgatagctggagctaaggagcaattcttattcaaagatactgtgtcatttagtggaaaaaaatctttagccgttgcaaaggattggattggtatgactgtaatgtgtcctgtcaggttctgttaattggttctaaggtaaa

SEQ ID NO: 95011 - DNA, 1004 bp, Homo sapiens
gtaaggattttcactttaacattaggttaattttttttttaacttctcacttttaaaaaattactgtgctttctgctttggacaaattatacttaaaattaaattaagaaaatgctataggcaggtattgaggtaatgcttattattgttatacttacaactcccacacagttaacctactagatatttctttaatagatttctttataggttacttagatgtataaatattccttgaacaactctgtatgtgcatgttattttactagtgtgttcacaaaaccttgaatgatgtagatgtgatttttgagttttatgcttatgtatgttactttttccttgcatgcttgtttaataatatattaaagtacacacatgtcctttgccataactaaagcagcctgcctgtcttgtttctatgtaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgtt

SEQ ID NO: 95012 - DNA, 1041 bp, Homo sapiens
agctcactgcaacttctgcctcctgggttcaagcgattctcctgcctcagcctcccgaatagctgggactacaggtgcatgccaccacacccggctaattttttgtagtttagtagagacggggtttcaccgtgttgcctaggctggtctcgaactcctgagctcaggcaattcacctgcctcggcctcccaaagtgctaggattacaggcgtgtgccactgtgcccggctggttcaaacttttcatataacccttaggaaattggatgtgacagggagaaaagataggaccttttcagcatttcttaatatgcagaattgccaaatattccaaagatggtctagtgacataaaagtatattacaagtttgtttgagaacatctatatttaaatctaacctttaaacaattttaaattgatatttgttttaaatatgaattgactattgcccctttatcttagctatggtttggggaaacaagcatttttttatttccaaagaaatgttagaatttctatgctgaactgcattttaaaataaaatataatatttagctttaggtattttaattactacaaaggggagagctttgcatctaagcaatacttttcatcaatagatctccagttttctataggcagacggactccctctgtttgataaagaaggaaacaggcacagagaagttaagaccctcccagtgaagactaagccaggctctccatctcccatctgggagaagctgcttcatcctagagggtggtctcactgtcagtttctcttcggtatttatccatgtctgtgaagtcatagtctgactccatctctatcttcacctgtggcaccatgaacactgggttccgtgagtagctgaaagcaggtgaagctggacaggatattttgaagtgcaaggtgatgctgaacgagaagtaggaaagaaggattacgtagttcttggtgttttgaacccatcccctagagcagggctctaatgcaaatacttccatctttgcttctgaactctcagcacatgccagaa

SEQ ID NO: 95013 - DNA, 1034 bp, Homo sapiens
gggacaagttttgtgcaagatagtttttccacggaccagtagggagtggggaatggttttgggatgagactgttccacctcagattctcttaaggaatacgcaacctagatcctgcatatggacagttcacaatagggttctcacccttatgagaatctattgctgccactgatcccaccggagctggagcacaggggttaatgcttgctcgcccatgctcacctcctgctgtgcggcctggttctgctactgttccatggcctgggagctgaggacccctgcgctagaagacctttgtccttggcagagatcaaagagaactgggccaccaggactggtactccaaccagatggaaaccccagagcaaagcctgcagactcgactaattctcactttagttgaggcaaaatccctcattccctcctttccccaggtgtccccagatccctgtggcatctcctggccctcttctatgttgtttcagaccacatcagtccaaacatggcccaccaggcctcccatgttttccagtggctgttgaaatggttgagggctcagaaccaagcttttccctttagagaaataggtagcatagcacttgggttataagtcaggcataattggaggtcctcgtggtggttgtgctgtgcctctgtgtgaatcctcagcaccttctcagcagacagctgagagggaggctgcctaggagggactgggcattgcttatggaaatcctgggagattatattactgcctttaacccctcccagcctcagctccctataggtggccagtcctgtcatccaggcaacatagcctgtcccgaggtcttctgaaagatccctaccttagtcccgagccccgtgcttctaatacagggcttgccaccctcaaagacagattaggggtgggtagccagggcatccttcccatcagcactgtccatcataggtacctcaagatcttgagtttctcagactcctcccccactcctatttctctcttccctggccctcccatgcctcacacccc

SEQ ID NO: 95014 - DNA, 1046 bp, Homo sapiens
cgaggactgtgatgaggaggtggggaagatgtgaggccggggcacagaggagaaattgagagaccttctctccacttttgccagggacagggagagggcggcttcttgggtggcctgcagcagtgcctcggcccagtccaggatgggctggggcatctgcttgtcttggtctggggtgttgagggctcttctgtttatgtgaatatcctcagggtgggccagagtgaatgagactccctgtccagggaaaaggtgactggccatgcccactctttccatcactgtgggctttacggccgtgatcacagcaagcgggttcctgtgggaagggccaggaggcagctccagcatggaaggaggttatgaagactgacctccaaagagtggagcagacttggggagaggtgtctaatggggccttataagtagactggactccagacaggcaggaggggctgggaacaagttttgcttgcgcctttgcctagggtattgaggacaaagatggggaaagaggcaggtatcctcgccaaaaggagactggctacatttcccagatgtctgggacaacatggttgccccatctgcccctcttctcccatggtcccttcccatttcatccccaaaacactcagggagtcaacagacaaggggccagtccagaaattatagtgaatcacaaaacatgaggcagaaagattcttaattcatgtgttcattacttatgatgaaactgtccccacaaaaggaagtgacttacccaaaatggacatgtagctacatttctaagaaggaattaagaaaataattcctgactttgctggtttctgatatgctaagctgcctgtgccatctcctaatgctgtgcttggttcccaatctcccaatttgacccaaactcacgtccctgcatccaccctgtcctgttctcgtgattttgccttgtgcagatgaaacctgttcaaggcaaatcccttctgactggctggtggtgattaaaccatcttctgatcagtcagaactcccctggtccttaattactgtgc

SEQ ID NO: 95015 - DNA, 1050 bp, Homo sapiens
aggcacagtgtaagtaaaggtaaattcttatcaatagataatcccttaaattagtaaatgaaaatattaaagtatatgcatattagttaatgacatggagggaacctctggaacaagtaaaatcaagcagacatagtggatagatctggaaggcggggctggattgagaaaaggggaggtgggagactttgcttttcctcataagtattttccactatgtgggtttttaaccaattacatatgttatgttaataacaaatttaaagagaaaagggggatgcagggaatgaagtcaatgtactgtcacctgcccctgcccttcaaattgccttctttgaaaagatattaaaaaggccacagggtagacgttgggggaccatctgtcctgagacttctggacatagagttggtttggaggggaggtcggaggacattgattcagaatgggcaggaaggtcaggttcagaacttggtctaggaagggcctccaggttcagaacctggcctaggaagggcctcttgagaaacagcggaacaagagactcttggtggacaaaaggtctgagtgtagccaatgatccccagtggaattggggagcctccctcctagcccaggtggggtacaacaacctgtcacaggcttgtaggaactaaggtttgcttcagagtccagcccttgccctcatcatacctgctgggtgccccagttcagactgtcataccagaacacatcttcagcagtggctgccatggccatatggatcataacagatcccacattgaccaccatatgccaagcactctaaatgtgtcacagttcacttacacctttgagggagatactaccatcatctccattttacagagaaggaaattgagtcttggagagatgacacgcttccccaagctcacacagttagcaaggagcagagcctggatttgagcctagttctgctgccttcagagcccagactgtaatagttcacctctttgctgccggaggactggggctgcctggagctgggtgggtgctttactcacttcttttac

SEQ ID NO: 95016 - DNA, 1170 bp, Homo sapiens
ccccatatatgaaagggtgtgacagaggggatggaggggagagaataaagatgagacactccaggaaggaggcgtccacaggacctgtggttggttgatgggagccaggcatcctgcctctgcacttttcctacttgctagcacagcagtgcatcctagaacacaatgaagaaacacatgtgagctcctaatcttcctagggagcttgtcattccttgaaccagcccgtccccaggaacatcactctggggggctggggtccctcagagggtgggaaggtatgctggctgcctggggactgcagtgggaaggacacagctgactcatcaggaagatgctgacccattctctcctgtgcttggtctccaagtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtaagctcaccctgcagttaggaggggacctgcagtcagacagctgctgagtcccccagagagggttctggtccaccgacaggatggactccatgcgagcactggcccactggggtttttcaagttaagtcagagagaactgtgttcccttgttggctggtccccttgacaacacttggtattgtcaggcttttatctttagtctttgtctatagtagtatctcattgtgttttttaaatttttcatttccctgatgactaatgaagttgaaaatacagctattcctgtgtttattggccacatgcccaattgcctttctttttggaagtgtctgttgaaatctcttgcacattttgggttgtctgcctttctgatttgcaagagtttgttatatattctgggtagaaatgtttttgtgattatatgtgttgcaaaatcttctcccactctgtgactgtttttttctttttacatccttaatggcatcttttgattaacagaaattcttagttttattgtaattgaatatatcaaactttcctcaaggcaaatattggacagcagatattcttgtatgttaccttctaaaagcttcatt

SEQ ID NO: 95017 - DNA, 1080 bp, Homo sapiens
gaggtgaacagggcagggaagttcatggtgtagagctgggaagtttataggctctgggccagcctttctgggatgggatcatggctccgagtatgaactgtgtgaccttggatgaattacataacctctctgggcctcagttacctcatctgtaaagtgggcatacttggtgaagatctgggaattaaacaaatgaatatatgtaaaggcttggcatagggcatggcatagagtaagttctttgaacatttttaagtctaaaagcccagtggccggtgaagattcacaaggcacgttatcctccagtttgtcttagcactttgtcttggctccagattccttatttcagtttttaaaaccagctgttcgtggtcaggcaggtgctgtcctggcccagctggtctgtcagagctgtggcccaggctctgtcccaccagcccttccctaactggggcaaagtgaggaaggtggagagggagctgccctcacaatggaagccaggccttggctctaaggaactggaaggagatgggaaggggttgggaatgcagctcccagccccacagctgctgaccctgccccgtgtcatgtgctcatccacagtgaatacaaccgtgttcaatgcttcagccccattggcaccagacaccaacgcttctctggtaagtcctttcctcttatgttagacatttgagtgcttttgtttgtaggaggagggagaaaagattttggaaatgagaccaacttatggcctcccagacttgcagaggtcaactccagctgcacgtcagggtcacctgcagagctttgtaaatgaacacttttttcttaggtatatactgtaaacatcccacttaaaaacatgcctcattctgttaaatccatgtttttttgtgcgttttttttttttttttgagacagggtctcactgtgttgcccaggctggagagcagtggcgtgatcttggctcaccgcaacctccatctcccaggttcaagcaattctcctgccacagcctcctgagtagctgggattacaggcacgcaccatcacgcccagctaattttttgtatttttagt

SEQ ID NO: 95018 - DNA, 1095 bp, Homo sapiens
tcagcatgtccaaaactgaaatcatctcttctgtgtcctacatgtgacaagccacaaacctggatatccttgactccttctttgatctctttagctaatttagttatccagtcctgttcagtttgtccttcattactgtctctcaaatttttccactttttttacatccacgaactttgtctataaataacttcttgctctgggcacttcagcagtttttaaactggttaccctacctccattgcctttcttcaaccagttctacacatcgatatgagggacctttccaaaatgcatactgggccatgtcactccccagtttaaatcctgaaatgatttcttcaactagatttaaaatttacataagatcctgaaatggttcctctatgtgtctagattttaaaatttaaactcactagaatggcacatgagaccatcaatgatttgggtcctgtccgcctctccagcctctcccgatgtgccaggtggttcagctttagtgaacccctgcagtttgcttgccacccggtgctctcttaggcctcttcccaccacccagaatgccatctacctccttccctccactctacctccctgccctcgccccatccccattcctcagctgacatcctgtccatttattaagatagctctggcaatgccatctcaggaaatttccaatccctatggcctgttaggtgctcctcttcttgaggcagcaaaagataccgaccttttttccaggtgtgcttggatttagttgctttgtgactttggcaaggtttctaatctctgatctgttttcttacctgcagaatggaaaaatgatatcttacagggttgttatgaaggtcaaatgagatagtgcatgcaagcatcaagcactgtgctggcacacagtagccttgcttctcttctccagtatgtgctcctactacgctactttatgccagtaagcatctgtttctattttaagtgttagttaactcctctcccacttcagacaggagttcctttagggtgtcttccatctctgcatcctgccaaatacaagtaaagggcacgtatttgaggaggaggaagatgacttttatt

SEQ ID NO: 95019 - DNA, 1050 bp, Homo sapiens
cccagtttccagggactgtggggaggatgtcagggatctagaagttctgtccttgtccagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaagtcaggcactttccctggggccttgcttcctctaatcctcccactgctggagctctctgcctcctaacccatacccctactcaggttctcttatagtgagactccccattttctttacccactgccaaccccattgcatcaccccagcctaagcctgtgctgctctgccctggcttctcactggcagggctattccaaggacctctcaggactgaatagtcaaggagtgctttagagaagggacactgccaaagcccagattctctttcacagagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggtgagtactgtggaataggcagcactagcacagaggagattgtcttctctcctgtccttggcctcattttgacctctgccccaccccccttacccccgggtattcagccaggaacatgcttacacagtttcactctgtgccagttttcaccaagttttcccttccgctgaagatgtgtgctgagtttctctgggcaaaggagggcattactaaattgttaatgaggctcagaataatgatgacagttggtctctagtagatgtcctttctggctctgtaatctgacctttctgcccagccctatatcccagagggttgtcagccagcagcaggctgggctgactctcctggggcatccagccctgcccgatacctgctcttgattgcttctctgcttggacactgtg

SEQ ID NO: 95020 - DNA, 1048 bp, Homo sapiens
cgccagctgaccgcccatctacaggtacatgcccactgtttgctctctgcccaccatcaccccagggcttccttatgacccagctgtgcttcactgtctctcctcctaggatgtgaatcgggaactgacaaaccagcaggaagcatctgtggagaggcaacagcagccacctccagagacctttgacttcaaaatcaagtttgctgagactaaggcccatgccaaggtcaggaaagtgtgtgggtctgagggagccctgcctgggatgaactggtatggggtctgggcttcagattcctgggggaaggggtgctttgtgtggtggtttggaagactctggcctgggcttgccctagaagcaagggatctactggagcaaggcatgggaattttggggctctttcagctctggctaagagtcctcctccctgttcacctcacaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggtatggccaatcaatcacatgttccacagaaatctagtgaacttgccatgaaccaggcattgaagatgctgagtgaagacaacagagtctctgcccacaaagagtttatggtatagtggaggaacacagcaaagtcaccgattaatatatattacaaatggtgtgttttcaaggagagataggttctgtgagagagcacaattagagatttgatttagaggtgagcagggtgtgactgagggaataacattgtctgagggccaggaggtgcctaggggttaaccttggggatgatgggcaggatagcattctaggtggagagatagcaggagtggcagctttaagtcaggaaagaccttgattccaccggtcccactaccctttcattttcacatcctgactcctcacaacctccagtaatcacatcactaccctttccccatgcaagattc

SEQ ID NO: 95021 - DNA, 1050 bp, Homo sapiens
ccaggctcagatggcgctgcatccagttatcagctcaagcagcttgaggagcagaatgcccgcctgaaggatgccctggtgaggtagggtcttcagtgcttgcctctgatgcttactcttgtgtctccaaatgtgttagagcacccatcgccagagactctgacacgtgctttcctccttctgccttcctcacatccctgcaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtctggggagcccagcccctcacccagaatcccccacctgactctcctatcagttgatgcctcctctttctaggtaccttccagcagcccttctccctatcctccccgtaacacaggtggatgctgctctgggtgctgaggagatggtggagatgctgacagatcggaacctgaatctggaagagaaagtgcgcgagttgagggagactgtgggagacttggtaagagaagagcagacccctgacatctgacttggacctgctgagaaaaagattgacatgtgacccttggcctttgagcagggtgtgcggtgagggacccagcctgggcttgctaccctgaccctgccttttttttttttttttttttctgagatggaatctcgctctgttgccaggctggagcgcagtggcgcaataatctcggctcactgcaacctccgcctcccaggttcaagcgattctcctgcctcagcctcccgagtagctggtactacaggcatgcgccaccatacccagctaatttttgtatttttagtagagatggggtttcaccatgttggccagcatgatctcgatctcgacctcatgatccgcctgctttgacctcccaaagtgctgggattacaggtgtgaaccaccgccgctggccgaccctgcctttctttagcccaaactatggtgtggt

SEQ ID NO: 95022 - DNA, 1039 bp, Homo sapiens
ccgctggcagcacccatcatccccacgccggtcctcacctctcctggagcagtccccccgcttccttccccatccaaggtaaggcctggggtaggggtaaaggagaatcaagacacccagaggcttgtggctacccgctgtgtcttgaaaatttcctggggttggcaaagacctagaacttggatcagaaagggtgaggacatagcctatggatatcttgctactgactgagccatcctttcctttcttgcccttatgccatactttccccatatatactgtgctacggtttcctctcagatgttcttatgccactgactgttggccaccctggggctgggtgatgtttgcacactttcttgtgttctttgcgccagctcagtgttggtggagaggaggagtgggctgtgcacagaccgtgaggcctctcctttgcaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggtttgactctggatgaagggggtggctggggcagcctgagacctaaggaagcatgctggaaactagactggagctggagcctggaacatactgtgagaaaggcctggggcatctctgtgctggtaccccctcccacctccacttcttcctcaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggtaaggggcccacagctgctgggggccaaacggtcaggtgagaac

SEQ ID NO: 95023 - DNA, 1092 bp, Homo sapiens
gcttttcttcttgacttttagaggtctgggcccttggaggtgggcctggaagtcactggatatttctggggaaaggggacattttgagatggagtagagctgcattcagagtgggagtgggtttgtagacgtttttttagggtaatgaggagctggagaagggaaggaagtccgttgagtgtgtaggccttatctatgaaatccgcaaggcagatactgagtaggacctaggaacaaaaagctctgtgtacgttgtcttctggggtcctgtgaatatctggaatccagctttccaagcttccagtctcccagcctccatttaccactcagtaagcagaccttttcctttctgactcctgaaggacttaggtccacgtttatctcttccttactagtgctttcagagatgtatagttttgccttgctgtcagactgcctgggtttcagacaagctcctctaggagtgggaaagcagggaaagcagacagttgggttagcccaggatcaaggtttgataaggtgagacaagaggagatcaaggtatcaaaggatgctggggtgccagtaaaaacaaggtagaaatggttcagacaggggagaaatggtagaggtggaaaagaggcttttcctcctcactttctcctttttcattctccaaaatcttattttcctataatttcctgaaatttctctaagactattggcagacacagagattattatttatcagacacagagatttttcccctcctctcttctcatttttctagatattttagtggtatttaatatcattggagaggaaaatggattagaaatccaagaggtgtctgtctcctccctggctggggtaacattaacccaggattgtcctatgggatatgggcctgggcccggtaatgctgtggaaggagcacctacctgtagagatattcagatgtgcccctctgccattttttggctatgagacttgggcaagtcatttgacttctgagacatagttctgtcatctgtggaatggagagaatggaatctgttttggctacatcacaggttcatttttgaaggagatagtgaagtacatgtattcgt

SEQ ID NO: 95024 - DNA, 1081 bp, Homo sapiens
cttttaaagtgtgagcagcttcagtggagtggtagggatggagccagatagcaatggatcgagaagtagatgggaagtgaagatagagaatgtgtactcactttgagtagttcagcagagaaaggaagaatacagaatggtggcagcttgtggaagaggtagcagggacttgtttttcctagaatggaagtcttgtttatgggttttctgatgccatgtaagatccagtagacagggtgcaatgaagacacaagagaaaagacgattgctaaatcaagtcctcagaggagaggggaaggggtgggccctgaaaagaaggggataccattttctttaaagaggaatgttggaagaaaggaaggaatttaggaagaaagagataatgacatatgcatgcagatatatctaaattttcaaagaaattcttacctaatagggccagttttctttttcagcaaggttatctgctgagaggtgggaatgctggtgttggcttgggtgggagtaaggacttgaaaatgtaaaggaagcttgaaataactgttaagaggaaagaggaagacagtggaactgaaataagctccaagagtgttgagtaccctctgaactgaaatcctacactataagcctccccttcatctttctcataataataatggctgacatttattgagtgctttatacaaggcactgttctaagtgcttttcaggcattctcatgtgatttttacaacaatcctgttagaaagttattgttattatccctttcttccagaagaggaaattgaggcatagaggattagtagcgcttgtatttgatgaatctcttacgtctgcagaaatggattccttttcctgaggcatcagagaagacagaaatttaatcccaactcccggtttctgaaccttgagagcctagagtctagggttgctaaggagggaatcttaccatgccagtttgtgggcatgatggtggcatggagggggcaggacagtgggatcactgttgctgtcagcttttgacaactacatagggaaactcggatattcttgagtgatttttccagcatcctgactagaa

SEQ ID NO: 95025 - DNA, 1042 bp, Homo sapiens
cgggttcatgccattctcctgcctcagcctcccaagtagctgggactacaggcgcccgccaccacgccctgctaattttttgtatttttagtagagacggggtttcaccgtgttagccgggatggtctcgatctcctggccttgtgatccgcctgcctctgcctcccaaagtgctgggattacaggcgtgagccaccgtgcccggctgttatatatttttttagaggtggggtctcactatgttgcccaggctggccttgatctcctaggctcaagggatcctcccacctcagcctccctcacacaccactgcacctggctacaaagcttctctggttattcgtgggcagctgagattgagacccaatgcctgctcttgaactgcctaaaacattagtttcttgtcagttttactggccacagcccacctggggactggggagtgctttagcctgtccactgactgacatttccttctcacccttcccccaaccctggctaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggtgagcaagggggagacgaggcctcgatggaggcaggaggccttctgggtggtggtggtgcagcatgtgcgtgtgtggcatgtggaccaccttaaagatgacttccccatgaagtcttatcagggacctgggagagaccttggtgttttaccaccactgtgtgttgcccagaggcgcatttgtgagtagccagggcaggacttagaaaagtcggtgtgtctggtgaaaggtagctgatctgaagggtagcaagtaatgcaaaagcactaatttgctaagccctgtctgtgatccagtaagactggctatctggcttttggaaaattaatttcctcaacgc

SEQ ID NO: 95026 - DNA, 1048 bp, Homo sapiens
cccgcctccgaaggcctgcactgctcaagaccctgccttccatgtcccttctttcccctcccccgatctggccgacctcgcctctccatcttcctccattttcagacagcaccccgtctctgtctctccctagcgagctctgctccagaaggcgcggagtcaaccttcccctatgctgccgctgcctgtagctgagggctgcccacctcccgccctcacagaggagatgctgctgaagcgcgaggagcgggcgcggaagcggcggctccaggcggcgcggcgggcagaagagcacaagaaccagactatcgagcgcctcaccaagactgcggcgaccagtgggcggggaggccgggggggcgcacggggcgagcggcggggagggcgggctgcggctccggcccccatggtgcgctactgcagcggagcacagggttccaccctttccttcccacctggcgtccccgcccccacggcagtgtctcagcggccatccccctcaggcccgccgccgcgctgctctgtccccggctgtccccatccgcgccgctacgcttgctcccgcacaggccaggcactctgtagtcttcagtgctaccgcatcaacctgcagatgcggctgggggggcccgagggtcctggatccccccttttggctacgtaaggcccttaacccggactctgcgccccgtcccatgcccgctcttgagtatcttccccaccctattaaattacatccggtgcttcggcttgtacagaactgggggagtgggatgttgtgggcagaccagtctccggtatacacgtattttgcccctgtcggagcttgcgtcgatgcctggggcttggaaaccaccgcaaaaaaccaggctgcaaaccagcggaccgacttttgggactccgcctcttccagccgggattacctggcgtgcttcggcctttggcgtcattccgaaaacataccgcaagccaatcagcggcaaccttgctcttcggggcggctgttcgttggttgatatgccagagcctgttctgttgtctgtattgg

SEQ ID NO: 95027 - DNA, 1151 bp, Homo sapiens
ttgcctcttgcagggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgtgagtgacttgatgccctgggtcagctaccagtggccctccccaaaccagaaccccaaatcgtctcacattcccttttccacacatttcaaagtatttttccctaatataaaaactagcaccctatacctggttgtcttcaaccaatcatgccaattttctcccctgcaggcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagctacttgtggatttgggtggactaaagctcaactcactgcattgcacttgacctgactgggtttgaaggggacaggttatggccacttgaccccaccttccctgaggacagcagacagtgctgaggcc

SEQ ID NO: 95028 - DNA, 1309 bp, Homo sapiens
ccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaacattttgaactctattgcttttgccagatttgcctcaccaagaggccttaggtcagtccaggcctcagcactgtctgctgtcctcagggaaggtggggtcaagtggccataacctgtccccttcaaacccagtcaggtcaagtgcaatgcagtgagttgagctttagtccacccaaatccacaagtagctggttcacatctctttaa

SEQ ID NO: 95029 - DNA, 1006 bp, Homo sapiens
ctcagctcactgcaagctccacctcctggattcatgccattctcctgcctcagcctcctgagtagctgggactacaggcgcccaccaccatgcccagctaattttttatattttttagtagagacggggtttcaccatgttagccaggatggcctcaatctcctgacttcatgatctgcccacctctgcctcccaaagtgctgggattacaggcgtgagccaccgcgcccggccccgaagggctaatactttattctcatacttcaccttcttctaggtgaagagaaacggattcgggaattctaccagtcccgaggtttggaccgggtcacccagcccactggggaaggtatgtccttggccgcgggacagtaaagaccccagagcattcttcttgcccagttttgctctctggggaaagaggagtatggaatgtgtgccaccagccacctcactaccctatctttctcagagccagcactgagcaacctcggcctccccttcagcagctttgaccactctaaagcccactactatcgctatgatgagcagttgaacctgtgcctggagcggctgaggtgaggagaaggtcaggggttgcaggaggtgacagtgccaatgacccagagccagggagggtctaggggagaggctgagcagtgagtgagtgcctatccccttgaagagagtatatcatggctctgggtggggaagaggaggaaagataggattccctaacctgtgtctatttccccccagttctggcaaagacaagaataaaagcgtcctgcaggtgagaagggctgaggggagggcctctctaaggagactcacctcccatggtccttccctcacacaccttgccctcttccctcccctccctgctcccagaacaagtatgtccgatgttctgttagagctgaggtacgccatctccggagggtcctgtgtcaccgcttgatgctaaaccctcagcatgtgagtagtcccacagtaggtttcttga

SEQ ID NO: 95030 - DNA, 1023 bp, Homo sapiens
gtagggcctattatgatgatttctacaggaggttgaagagataagacccttccctgtgctcccccccccccactccttaattacggattgagcaggggaggggccggtggggctcaggtgagcacacagggagaaagggacgtgggcggggccttacagagggtgagcgaatccgaaaagacctagaacctcgttgctgggagacaagtcccgccctgcaggcggcaccggaagtggccggctgggatcagcctttaagatggcgtctcctcaggggggccagattgcgatcgcgatgaggcttcggaaccagctccagtcagtgtacaagatggacccgctacggaacgaggtgcaagggcggcagggttactgctgtggtcggccagcggtgcgaattggggcgggctaaaggacgggcggtggctggccgggcgcccagtgcgcctgcgcagagacagagtgcccagtgcgcctgcgtggttgcgatcgggttgccaaactccggttaggacgcctgcgcgttgtgtcgccgacgttgtgtagtctcccctgggaaaggagggtcaggcgagtccacgtgagggaagcccccgctgtgcgcggagccctctgctgggcggagggggagtgccagcccccaggagctaatccccggctgatggcgcagggcgcggggcttggccgtctagtgtgatgaaggaggcgacccccaaggtgggaaggcgcacgggttggggtttgagggtggatgattggtgacggagggtgtatcttcaggaggaggttcgagtgaagatcaaagacttgaatgaacacattgtttgctgcctatgcgccggctacttcgtggatgccaccaccatcacagagtgtcttcatacttgtgagtgccttggagactgcctagttcttccagtccctagtcttcaccaagctgactgccagcttctgtgcggcctgcctcacgcatccaggcaccccacccagcccatgaatccagtttccagagggcctgagaat

SEQ ID NO: 95031 - DNA, 3515 bp, Homo sapiens
gatccacgtcttcctggtcagctgcgcgctgccagacagcgtccttcgcaggttccgacgcgggcgttcggggagtgtcagagctgggtctggcccgaggccacacagtcaccacctcctgtgtccccagattcgtagtgcggaccatgtgtgcggtgctagggctcgtggcccggcaggaggactccggactccgggatcacagtgtcagggtcctcatttccaaccatgtgacacctttcgaccacaacatagtcaatttgcttaccacctgtagcaccgtgagtgagagcgaggccgagagcgccacggggcggttccctggggcccagctgaaggcccccctgtccccactcgcgttccccatggaggatactgagccttacccctaaccccgatcctctacccaacatgtcagttttttttttcattttcctcaatatttttcttcttgctttctcttctcctggttcccagcctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcaggtgggtttagcacaggtatggggcgccagctgggtaggtggtcaagcttgtgggcccttgagtttttacaactttcttcggcccttagaccccatcatctccagttcatttcctttctgtccactttaagttctttctcctgaatcccttcattcttcaattatgtgcttgtagagtttgacagttgcctgttataaggcaggtgtgagctgctgactaggctggctggattcccatcctactttctccttcctcttctagttcctggccattttctatccaagatgtggtacaacctcttaccctgcaagttcagagacccctggtctctgtggtgagtgtgtgttgaacagggaatctctggggcttgaaggggaaatttcccatccctggccctggcttaggcctcatctcatgccctcccctcagacggtgtcagatgcctcctgggtctcagaactgctgtggtcacttttcgtccctttcacggtgtatcaagtaaggtattaactgtcctcacattttggtcgctggggagaggctcacctcaaggtcaaggaattagtggcctctgccctgtccatttgtagatctttatatcaaggttctaccacagaggcaacacaaagtatttacagtatttactattttcccacccaccatgcaaagaggtaccaaagtggggaatggtgacagcctctaccctgggtgcccacaacatagccctggattgtttctttgcaggtggcttcgtcctgttcatcgccaactaggggaagcgaatgaggagtttgcactccgtgtacaacaggtggtcgggtgcacagacagggtggaggcggggtccctgcttaggaggagagggaggaaagcttgagatcttgacacttccagtcttccaattctccctagctggtggccaaggaattgggccagacagggacacggctcactccagctgacaaagcagagcacatgaagcgacaaagacaccccagattgcgcccccagtcaggtatgtggtctctatacattacagcttttggggtttttttttttcggcctactgtgattcctcccctatttctgtgctagttagcctctccttctagttctctacttaccagaatttcttttttctttttttcctttttccacagcccagtcttctttccctccctcccctggtccttctcctgatgtgcaactggcaactctggctcagagagtcaaggaagttttgccccatgtgccattgggtgtcatccagagagacctgggtatgggaaagggtggccccacactgggagatgggcacagggaggaaaagtgggttgtgaaggaagaaagtaagtagggagtggactcccttctcttttctccccagccaagactggctgtgtagacttgactatcactaatctgcttgagggggccgtagctttcatgcctgaagacatcaccaagggaactcagtccctacccacagcctctgcctccaaggtgagacccaggaaatggtcagatccaagtgttggggtgagttgggggcaggctatgtactcccttatccctgacctttcttttttgatcctgagaccctagcatagtgcctctcttgcaaagtaggcattcgatgcgtgtttaatgatgatgactccgcaagccctctgacattgtgatcacctcagtttcccagctctggcccggtgacccctcagccaacagccctaacatttgccaagtcttcctgggcccggcaggagagcctgcaggagcgcaagcaagcactatatgaatacgcaagaaggtgagggggttagaggacaattaataggatgtggcaaattggagaatggaattatggagctactacggcaaagcctgaataatatctctccctatgtcccacaggagattcacagagagacgagcccaggaggctgactgagctcaaaggaacaggatggcacccagagccgcaggacggagactgggggcagccctcacccaactcacaacaggctggatgggtgggtggtaaaaagggaaggatgaggctcccccaatgtcacattaaattcatggttttcattcaaggcatctgttgtctctctcggtctcaaaagccctgtgagtgggttccttattccttggctgcgggggatgggggtgagagtcttctcgtacatttgaagggggtagtcagactgcaactgtctaaaatcacctcctcatgccaagtgatgagtgataaattaaggaagtgtaactgaactgaagacccagcttgggtgatcagcccaggttttggaggaagctgctgcaaaactacaagtcccagcatgcctttcacaagcacactacacatcatctatagagttcacacatgctcagtgtggtagctggagcctgttttccataggttcctgactaggttaaataaggtggagcaaatagccccaccccaaaagcaggcttcaggatttgaagtttgagcccatccctgaggtagagccggaatttacctttgtacttcacacggtcagggttggtggtgactacgtgggtctggagctgactgccgtcctgacacgtcctagagctgcaagcaggtttgaatccaggatccctgtgactctgctgttcctctccccaccccctatattctttatccttttcccttcaggactttcccacaggttactaggtctcacataatttctactgcccttgaggacccctgcctaagtaagatttctactacctgccaacggggtaatagtctcaggtagatttctactacctgactatagggactgtcgactaactctcagtagccctttatcaaaa

SEQ ID NO: 95032 - DNA, 1427 bp, Homo sapiens
atcctggaccggtaatggtgggggtagaccgggaggcactgaagccacaggctggagggcgggcgggtaggaggggtcagagcctcctcttatctgtgctttccctccatttcaggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaaggtgggggctggggtaggccaggtctggttggagctgcttatttgctcgcatcttcagatgacaggtctcttttacccattctcccttaggagcctctccccacgctgcctctgggacgctcagctgatgtccggcaaggggagtttgttgttgccatgggaagtccctttgcactgcagaacacgatcacatccggcattgttagctctgctcagcgtccagccagagacctgggactcccccaaaccaatgtggaatacattcaaactgatgcagctattgatgtgcgtcctgataggagagaaatgacaaatgatgggggaggggggagaggctgtgtggtacaagcaccaactgatatatggtggatgagcctatatagagcttaggctgcaaaaatgtggccacttattcatgggctgagaaagaagagaatttggagaaagtacctacatcctggtatgcccccagacttagaatccccagatctctttcatgttttctccttgtcctacagtttggaaactctggaggtcccctggttaacctggtgagtgagacatccttccttccaagaatccctgccccaggtcagtgtgggaagggtaggtttcccctaattcaaggatgtttggtcaagtttctgagcagttctttgttggctatctctcaatatccaaccagatctccccaacacttgctggtacttttgttcgggtgcccccatcccctactatttgtttaggctagggaactgggggctgtatccctgcaggatggggaggtgattggagtgaacaccatgaaggtcacagctggaatctcctttgccatcccttctgatcgtcttcgagagtttctgcatcgtggggaaaagaagagtgagcctgccttatggggaaacgggttcctttaatgtggtggaaataggggaagggcattcagtgggacttcctggagggtggtctactgggagaagagggcagggaaggaaggatgtagctgggtggggctcatttgtccctctgtcacagattcctcctccggaatcagtgggtcccagcggcgctacattggggtgatgatgctgaccctgagtcccaggta

SEQ ID NO: 95033 - DNA, 1024 bp, Homo sapiens
attgctagaagacagaaagtgagttgccattgtattttgtagtacctagcccatgtcctgtccatatatttatcaatgtgttgatgagagacttgaggtggaactcaggatggggagaatgcctgggtttggctaatagggtgatctgtgtactttcagcatccttgctgaactacagcttcgagaaccaagctttcccgatgttcagcatggtgtactcatccataaagtcatcctgggctcccctgcacaccggtgagggagaggctgcagtgtgatatggggatgggcaaggtgtgcatgtgtccttgaactaggctttgtactccttcctttctctctgtccatttttctctatagggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacatattatagtaaaaaatgaggtgggagggctggatcttttcccccaccaaaaggctagaggtaaagctgtatccccctaaacttaggggagatactggagctgaccatcctgacctcctattaaagaaaatgagctgctgccatcttttgtgggcagttagtcaggtgctgctctttgtggtgtggtgggctctggtctgttctgctcggtgctgggcctgggagcaaagattcccatgcttggctacagatactgacagctggcctctgaaggagggtgaaaacttctgcttgacagttccacatc

SEQ ID NO: 95034 - DNA, 1002 bp, Homo sapiens
gacgggggcttgctgtagaggggctgttctcagccctaggcagagaaggccttggctgaggagccatagcgcctggcctcccgttgcccggtgacagggatggtggtgttggcaggaggctgggacaaccctaccccatcccccgcccagccttgaggcctggccctcctgggcctcttgaccctgcagggcatctgagagcctgcgtgttggggagggcgtgcagcaggttctccaggcgagctttggtgccagccttccctgcctgggaatctgctgggttaggactctgggctcccattcaggggatctgtgatcccagggccgcctagggccccttacgtgcctctctgcacaatcagtacagctgtctgtcctccctctgagtaaatggggtcatctggatccctcccacgtccgccccttggctcttgtcaatccctctccttctcacccgcggtgtgcttggttcccctatactgagtgcttagttctttgcctatcactttctatccgttgtctctctcctctgtgtctttctggttttctctctctcattcccacagtctcccttcctctcacatcctgtctgtctgggtcttcctctctctctacgtgtctcttgctcagtctctatctctttttattgacccttctctgactctcgatctctcatagttgtctcttatctctgggtctctcaggctgtgcctctatgacctgtgcctcagcccttatttaatgtgtttctctccctgtctcttggtccctggggctctttctctcctgttgtctctcgctgtctctgtcttactcagtgtctgtttttctttcgtgacttctccctctctttctgactctgggccccactcaatctgtttctctcacgcacactttgtctctggggcacccaggccttccctgccatgcgacctgtcagtgtctggcagtggagcccctgggggctgctgctgtgcctgctgtgcagttcgtgcttggggt

SEQ ID NO: 95035 - DNA, 1037 bp, Homo sapiens
cctccagggaacccggccccgcctcccgccccgcctcccgccgcagggccaggaagcgcggaaggaaccgccgggggccatggacggagcagtgatggaagggccgctttttttgcagagtcagcgctttgggaccaaggtagtctggcgcatggatgccgaaccttatccgggctagtagtgggtgagagagcccagaaacagggagaggtgggcagcgggctggagagcggcgccgggagttggagagcctgtgactttcccgtgaagttgctttgcacactcccgggaagcgtctgtagtctaggggttctggtcctggggagacggagtggcatcgtccttgggaaacttcgcccccaaccccgtttggaagccccagatcccaaatcgacttgcgccgcaacctccttccccgtcgggacccgggccgcctgcgcacgccactccctctcgagcactctctctctctccctagaggtggaggaagacctgggccgtgctctacccggccagtccccacggcgtagcgcggctcgagttctttgaccataaggggtcgagctctgggggtggccgagggagctcgcgccgcctggactgcaaagtgatccgtctggctgagtgtgtgagtgtggcccccgtcaccgtggagaccccccctgagcccggcgccactgccttccgcctggacactgctcagcgctcgcacctgctggcggccgacgcgccgtccagtgcagcctgggtgcagacgctgtgccgaaacgcctttccggtgaggagctgcggcgatgcggggtgggggcagttacagaggcagagaaatggggctgcctcagaccgacccccgctccccgctgaggaaattacgggtttctcgatgctctctactacagaaaggcagctggactctggcgcctaccgataacccacctaagctttctgccctggagatgctggagaactccttgtacagccctacctgggaaggtagacgcctcagaagcccgggcagggatggagtgaagaggagg

SEQ ID NO: 95036 - DNA, 1047 bp, Homo sapiens
cccacctggcccccaagagctcctcgacagtcccccagccctgtatgctgagcccttagactccctgcgcattgctccatgcccttcccaggactccctatactcagaccccttggacagcacgtctgctcaggcaggagagggagtacaacggaagaaacctctctattgggacttgtatgagcatgcgcagcagcagttgctgaaggccaagctgacagaccccaaagaggatcccatctatgatgaacctgagggcctggccccagtccctccccagggcctttatgatctgcctcgggagcccaaggatgcatggtggtgccaagctcgggtgaaggaggagggctatgagctcccctacaaccctgccactgatgactacgctgtgccaccccctcggagcacaaagcccctccttgctcccaagccccagggcccagccttccctgaacctggtactgcaactggcagtggcatcaaaagccacaactcagccctgtacagccaggtccagaagagcggggcctcagggagctgggactgtgggctctctagagtagggactgacaagactggggtcaagtcagagggctctacctgagaaggacggcaaggctgaggtggctaagggggaccatggggaggtggcactagggatcaaagaagatggttagaaccagcagaagccagagggtgggaggggccatgctgtgtgagaccaggggaccagagggatgggagagtcaagggaaggacaatcccaggaagtcctaagaagtggggcagatggcagggctgaggatgggctctgcatcccccaaagccatcccttccctacttccccaaatgaagggacggctgtgggaccaggtctgtggaaagtggtgcatggtcagaatgggtgcagtttgaggggcctgtgtggaggcctcagggagatgttggactgtgcctggatccttactcctgcattgttctttgccagagacctatttaaaaattttaaaattctcattaaagtcagcttgggtttaagaagtttat

SEQ ID NO: 95037 - DNA, 1038 bp, Homo sapiens
taaaataacatgaagctgaagtcccctttgttcaactaagtatttaatttgcattgctgtataatttttggtggtttttatattctagaatgttttggggttgtttgtttgtttgtttttacagtggatttctttctcccatgttttattttttatttattttatttatttatttatttttcttttgagatggagttgcccaggctggaatgcagtggcctgatcttggttcactgtagcctctgtctcccagattcaagcaattctcgtgcctcagccttccacgtagctggaattacaggtgcccgccaccacacctggctaatttttatatttttagtagagacaggatttcaccatgttggccaggctggtcttgaactcctcagctcaagtgatccacccacctcagcctcccaaggtgctgggattacaggtgtgagccaccatgccccacctagaattttttttaacacaagaaatgcacaactccaataaaattcaaacagtatagaagtatgaagagtaaaaagggaaagtatctcagaaccctgccctatttccacttcctgtccactgttaacagtttgatgatagccttccagagctttgtaaaatgcatttacatatatatatgtagatagttttatttttatataaatgggatcatgttatatctgttctacagcttcctttatttacttactatctcctagtttttcatgtcagtacatttagctttgttaacaaacacgtaatactccatagtttgagtgtgtcataatttaaatattccctattgaggggatttgaactgcttcccgtttggggtttttattattacagcaatgctataccaaacatctttgcatatgcctttgtgtactgctcaagaatgtctctaggctagatgtctagagatacagtcaatggatcaaaaaataggtgtggaagctgggccagtgacaagtgcctataatcccagctaatcccagctacctgtgaggctgagacaagaagattgctttgaggccaaga

SEQ ID NO: 95038 - DNA, 4087 bp, Homo sapiens
cccgagatgccagacagtgtctctccgcacagggcgtgtgctggtccagaggcccgtttttccagtcgccccacaccccgggtccgcgatcacgctccccccacccatagccgagcctgacgcggcggtggctcatgcgcctttccgtcccagcctttagccacggaccacacgtcccatctcaggcgccccgcccctcccccgccccccgcccccggcgcgcctccccaggctgccggctccggtgtctgagcggccgcgcccgcgagccgtgagcgatgattggctgcgccacggcggcgggcggtccgtgggcgcacacaccctccccgcgcagccaatgggcgtgcgcacgtcactgatccggaggcccgcgggccggcagcccctcaataagccacattgttgcatgaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggtaagtcagcgcgggcggggcggcaggctgggctctggcaaagtggtctggcctccatcagtctcttcctcgaccctgcggggacccgcttcctccctactccgggcctgggagcggaaaaagtttgggcagccgggacactcctgggcgccaggagccacgtccgctaagcacagccggcgagtgcgcgcgggcggggagccgaggtcgcgctccgccgggcgccctccctccctgagctccggcacgcgctcacgctctctcccccagtccctttttccctgttactggaggggcgggtcaccccgcaggtagtcagggattgctgcgcccacgtgggagggagcccccttctgcagcgcgagttccggcgagagcacgtggagagaatcgtggctgcgggaggctgctccgctgccgcgtggggccgccgggggccgtccgcgctcgcggaccgcgtgtaggagacgagcggttcccttctccttccccgcggccctgcgggggtgggctcgaggagaagctgacccgggaaggagtaggaaaggggcagaggaactccgcccgccgcgccccctccccggaactgtggcgcccggaactgaggctcggcgaggggcgtcccccattaacccccgcccctccaaatcagcctcgggaccgcccagcctcgtgtcctcaggatctgcctctgagtaaggggaggactttggttgttactttctggtttgccctaaaagttactcggagaggccaacgcgccgcgttcctggattacttgagattcttgagatttatgtccttccgaaaacgagcttttttttccttaagcctcgacctgtctgttcccacctggctccgcagctccctatggctgagcgctcaccgcggccgggtcatttacataagaaagagcctcaggccaagccgggaagctctcattccccgcctcggggtatgggggtggggatggggccggggccggggacgggcagggccaggggcgcgctcagaattgagtttctgaaatgcccgggattaggggattggctcctggcccgggcctgggctacgatttgaggtaggggacaagttgggaggggattagctggagggaggttgttttaagagctgtgaggcaacggagcgttgctcagttacatacttggaatttcaatatctgatgggaacacatttttgggaaaatgtcttgccattaccgttctgtgcgacaacctgctcatattcccattctggcggtcccgagggcataggaggcatattaatgtagtgatggcgcgtgaacctccaagaaaagcagaagttacccagcctcaagtctggaggagcgagcagaggcggttgatttacttgggttttactgtttgtaaatggctgttattctctaattcctgggatgtggctctgcaccttgattcagtttacttaaaaacgtgcctttgatttgagctggcaggatcttggtaacttctcaacttctaagaactcttggggaaggctatcatctcttggcaagtcctaaaatacacagtggagcgtcattaatctcagggagttctcctttgggtattaccccaggacatttgaatccttgcataaatttactcttcctcaatccagaggagggcaccagggttggaaccccgttggagttataccactctcaatcttggaatgggggtcatctctcttcccccagagtggaacgggaattaaccagggtatctggaaatgagttgtaatctctgtcttgtggtttattaaccatagcaccctgagcctctttggacagcccgtttctctttgtgaaatgcaataataacagtaggcttgtccactttatggagttgcgattattaagcgctgcagtgtgcaactgtcattcctgtaggttttctctacccttgcagccacctgtcagtttgagaagtgtccctgaagacccttgggtgtatttcctctaaactaccaataggggcagaattgaatcaggcctttaactcagtaattgtcagaacctgggatttgactcccagcttaggtgagcgaagctgtttgattccagtggcagttacatagaaagcagagactcagagtatcttggaaccatctttctgagctgccattggaaagaagaattaagagagaagaatgaaaatttagtataactttagagtcttttgaaaagaccttttgatttggacccttctgaaatccccttgtgataagataatcttacatattctgggttgtagtctgaggacgtggaaggcttgggttcacctgcccaacgaggtcacttgtcgtctcctgatggacaagcccagtgttttggggcattagagatgagaatcagggttatttcctcacttttgccaattggaactcaggagcgactgcagagcacctactgtgtacctggcactgttctaagctcttaggtatgtcagcttattaacattcaaatcagccccatgaggtgaagactgattgttattagcatccctgtttaactgaggcccaggggtaacttgcccaaggtctccagcttttctgtacgagctgggaatcgaagccatgcatttggctttagagcaccatgctcttgagcacatacttgcctgtctctggggaatgtgagcgggctcctggcccgggcctctgcccactcctggctgctggtagcacccccacccatcatgaccacagatggaactagctcttctgttggtttgatcagtggcaccagtaccctctggctactccagctgagagtcctggattcattttcatcaactctctaactctgtcaactggtctcttggttactttggaggcctgctaagggtgtccctaaaactctttctggagccagactggatcatttcaggagctctctacagctcttaattgcctcccgcttctaccccccagcttagcctcatcttcctctccatcctttcattcctctgtcctgcctgttcacactaggtccttttgcccttgtcttttttttttttttttttttttgagacacagtttcactctgtcaccaggctggagtgcagtggcgctatctctgcttagtgcaacctctgcctcccaggttcaagcgattctcctgcctcagcctcctgagtagttgggatt

SEQ ID NO: 95039 - DNA, 1050 bp, Homo sapiens
tggcctaatatcttaaccaccgactctcaaagattccaggcagaaaagtgatatgcagtgttgatcagaacagggccaaccacgatcacgttattggcatattggaaacctcccagaggagaggggaaggtgtttgagccccagccttagaggtgtcatttggttagtctggaatggatccttggaattcttactgttttctttaaaagctcctcatgtgattctgatgtgcagcaagtttggaaactcttatcacaagtgacagaatggagattaggcagaagtatcagaaagcagatttatctttgattgaggaaactctttgaaacaagtagagctgttcaaaaatggaatttagagaaatagcgagcctctcaggcttggaagtattcaaacctaggccacatgactatcaattgggtggagagagacaaactagataaattcgaatactatgtttagtgggattttcgaactagttaccctaagggcctttcctttctatggatgaatacttttcagctgcagtcccactgctgtgtgtacatctgctatcacctgcttggctttctcctttgactttgggcctggtgctccctcccactgatggcactgtgggtgaaagttggcaagattctgaaaattgcattcatctccttctcaatccaggaaaatcatctttgtatggtggctgcttcttgtttctgacttctgcttcccttggctaccaacacagcagtgcctaccagggctgggtgggctccactggtgtgtttaggaaactgtggcattaagtgattattaattatcccttcctgagtggccctaataagctgagtggacacatcatcatgccctggtgccatctgttctcaagttttgagagttcaaagagctctgatgtgaaagaggggaagtttgggccaagctactggcctggacatttttcactgtttcatatccacagctgtttcatatcttctctcttagtctcctcatgtgatggagaggaaaataaggtcccagggtcatccaagaaaccacagggca

SEQ ID NO: 95040 - DNA, 1059 bp, Homo sapiens
cctcataataggtgcctccattttagagatgaggtgcttgtgaggcccatgacgggtggtgggtggggggtaggtactcacatctagaggacaggagagagaacccaaggggcagctgccagggcagaggaagaaccaggaggcacagtgtccaagaatctaagggggacgagatctccaggaagctggcaggtcgctggtgaggcatctacaggggcgttgttgggaggggagtaggggcagggcgtgggtcagggcttgttaatgccacgcgcctgtgctgtttccagcacatgtgtgtccttgaggctcatctccctaagtgcctctagggacctggttcgtctgagactgtatcgttcccaaaataagtaagtgtttgctgaagccttgggacccagcctggacccagtgctgagggtatgaccttgcttaggattgtttcctgagtgtgtttcttggcccttcaaagagcccctcgaggtgaggggcctcttatctcttccatgtcctctagattggcatgtttacctaccactccctctgactggaaaccacacccacttctgagatttttatttgacattcagataaatgtacacactccggaaggccagggccttgtctttatttcacccagcactaacactaagtaagtaccctaaatcttttctaaatacatatgggctaaggactcttttgggcacctcaatgtattaactcatttacttttcaaaaacctttatggtaagtacaaattttatccacaatttttagatgaggaatttgaggttcaaatgtcaaacaagttgtccaaaatcctacagccagtgggaggccgagttaggaatcaagcttgtgtaagccaaagttcaggcatcggtactgcacgtgatgtgttatatgtgttcatgtatgtgttagcctgtgcacttggcgctggagcacactgcaaatgctcaactaaaatttttttggaacggagttgggactgattgtttggactgtattataggcaggtgaattaagtttgttggggagaactaattatggggcaag

SEQ ID NO: 95041 - DNA, 1041 bp, Homo sapiens
gcagttacctggggccactggaaatgatattgtagggcagaaagggcaggtccctttaggggcattaagttataaatatagggctggttcaggaactgaatgtgaaagtatgcgtttgtgactttgacccacctccaagtttacggctgcatgcctcaggcattgagtgacaaggaagagccagaggctctaaggttggatcaaatacagtccagtgttctgatttgcctgagcctctcccagttttggcattgaaagtcccatgtcataggaaacccctccatcctgggcaaactgggatggttggccaccctacatggccctggagctcatgccctcactgctgctcagctcaactgtggcagcagcccttgagctgcttccttgtgctatcccagccctccacagtgccactagagccactagagcccttttggaaacagatctgaccttcttaagaacgaaagaaagtccttggcaatggtatttgctgtgcgtttatagccatgtcacgtgagccctatgttgtagctactctggacatgccattttttggcacccacaaattaatgccaacttatagttataccaaacctctgtcctgccttactggacaccagagcatgccacaaacctccatggccttgacagggagaaagggaacaagtaccttgataggatctattaacggaggaataatttactgtgtttcttctttgttgttgttgtcatttgtttgttttttttttgagacagagtctggctctattgcccaggctggggtacagtggcgagatctcagttcactgcaacctccacttcctgggttctagtgattctcttgcctcagcctcccaagtaactgggattacagggctacgccaccatgcccggcaaatttttgtattattagtagagacagggtttcaccatgttgaccaggctggtctcaaactccagacctcaagtaatctgcccgccttggcctcccaaagtgctgggaatacaagcatgagccaccacacccagcctgtgtgtttc

SEQ ID NO: 95042 - DNA, 1892 bp, Homo sapiens
aagtgaagtaactctggaatggaaaaccaaacatcatatgttctcactcataattgggaactaagctatgaggatgcaaaagcataagaataatacaattgactttggagactcagaggaaaggatgggaagggagtgagggattaaaaaaaaaacagccctgtgagtttccagttttaataaagctctgagaattaaaaaaataataatgtaaaggtgtatagcatgaaattagactatatgtaatgtctgtagaggagtgaatcccactggccgccccttacccacagatattcctggagggacttggagttttaagtctcggttggttcctggaagaattttgcccaaaattaatagtggcccttcctttctctgcagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccaggtatgacccttctctcagggcagcccctggtgacaaaaaacttccttggcatgttctttctgtactttctccagccgctcccagcgtgtggataggcagtcacccaagacactcatggatgccagcacagctgtaagggctccctctcagccggagctcaggctgttctggttgtattttatacccaacatgtactcagtattaaaaggagtgactagagaagaagcatgaaatccaagtaagacgctgttcagtgttgtcacatctcgggcctcagggcttggaagaggtcaagccctctgattcgtggtcggctgttccctctcccacacaaggctccctcctgggaaaggaatttctgaccatgagtagaacacgctggggagatatttttagactcattatttgtctttggggtggccttgaggtaaacctgctttccttgttatcatgctggggttggagaagggaggctgcatccctagggctgtgggcatttgagctttaccgaagttgtcacgtggctccagtataacgtcaggagggacacagagggtagcggcccttccactgccactcctatgcctgcaccaagctgaggtattaaagagattgggtcctgtattcaggcactctagctgtgtgattctgggcaagtgatagacctcagtttattcatctgtaaaaagggatgatagtgtacggattgtggtgtagattagaggagatgatacctgttaagtatttggcatagtgctggtgcataatctagtactcttcgtgtttttttcacaggggtttttgtctgtttatctaattgcttcttgtgctgtcactttctgtggctagtaattgcattgttccctgttgtgggggatgtggttgccttttcttcccgttgcctcgatctcctgccttgggccacatcccccagatgataaatgtttaagaaccaagtaaactagataagacaaaacaaaacaaacaaaataacatctaaagtttggctgtgattatgtaaaagacttgtaacgtgatggtgacttgttaggtggatttttaagttttacaagaacaacaccctccctgttgcttgtatcctgacaacatgcaggggccaggcaccttgcagtccctgcagcgtcatccctagagcctggcaaggacaatgaagtgcgtctctgccaattgagaaaaaaaatccattttaaacattcaagatgtgagtgaagttcttcttgaaaaaagcttaaaattgctcagaccacctagttagagggtatcaagaaaacctactctccatgcaatatataagaaaaacagtatagtccggattaaaaaaaaaaacaactatgagaccca

SEQ ID NO: 95043 - DNA, 1484 bp, Homo sapiens
ttttcagctctattataatcttgttaccaccgcagtatacacaatctgtcactgactgaaacattgttatgcggcacatgactgtgtcttatagtgccagttgtcctgagtttctttttcctaggctagccaggaagtaacacacaaattcaatcatgactttaccccagtggcagaggtctctgctaatgacggaggtttgaggggtgtggtgtgagtttcagttttagtgggaaatcaatattcacttcttggtccctttccagagtttcctggtctcatggaccaagggattcaagtccagtggagtggaaggcagagacgttgtggctctgatccggaaggccatccagaggagaggggtgagtggggtggcaggagcttggggtctgtgggcttttctgggtccaccctgaagactccctgagtgtccttgactcatcattgtttgcttacgtggagcttaaggagagttctcttttccctgacacatgtactcaataattttgtatgcgatctgctgctttgggggtttttagattatcaaatggataaataatcttagccttggcacaagaaaagctctttagttcttaacctgaagaagacttgaatgtgatttccaagtaagaaagttggaatgatgttgacatgggagtggaatggctcagagagagaatgaattaaaagtcttatcacaggaggagttatggggagggaggggggagagagagagaaggaggaggaggaggaggaggagtgatatatagctggtgttaggaaagtcgccctctgtgatgatgaaggtcagagccctcccatttgtctccacaggactttgatatcgacattgtggctgtggtgaatgacacagttgggaccatgatgacctgtggttatgatgaccacaactgtgagattggtctcattgtgggtgagtgaacaccgtgcatgaagggcccgtgctggccaagggatgggggtgtgggctggaaagggagaaggggcccatgggctgggtgttcctttgtagttcatattagaagataatggtccagtcactttggagagccgagcagggactcatggagttgggggtggcagaagattagaccatgtattgtgatgcccccagagtctgcagtgagaaatcccagccatcctggccgggcagtctcgggacagtagtataagagggaagaggggtgggaaggggccggagcaggcgtgtgcatagccgtcccttgttttggcaggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtgagtaggcccttcctgtgcgagtgggcttggcgggggcctgg

SEQ ID NO: 95044 - DNA, 1051 bp, Homo sapiens
aatagactcctactgctttagagagagaaaccaggtgggcatcaccgcagggttcacatgttgagagtggctgacagcagagacactgtctgtctcccctaacacaagcagatgtaacacaaactctcacacacacaacttggtggtaaagcaccaagaacagggccttgtttttacatagcacatgcataagaaatacttgtgtttctcaactccgtgtgtctctgtgtgtgtgtgtgtgtgtgtgtgtgcgcacgcacatgcgtgtgcgtgtgtgtgtggtgtctgggagaggagcctcagggtggctgtgctatattttgcacccccttcctcctcctcctgcccctgcacaggtggactaagcaatgaagagggattctgtccccactgggtggtgaatttgctggaactaaagggcttccttgccaccccccgacacacacactggccacagtgggtcagacacaggcccacatgctatctttctgtttcccagggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccagtgagtcagtgtgcagggcctggagatgcggagttcctggagtacctggggctgagtgactcctcatgccagctccattttgcatttcaggggtggtgtggagggaccatagagctgagggtcttggtggaatgaaagttcccacctgggcaagggggaatgggaggaagtcatatctggtgtgggtggaggtgatttctgaaggctactgatgactcgggctctccgcagagctcctctggctgctggacactctctttgccaccctcttgtatgcgttattgttcctgtctttactcttagaattcttggtgattc

SEQ ID NO: 95045 - DNA, 1051 bp, Homo sapiens
ggggccttcttcagtgaggaagaggaggtcttgtgtggctgcatgtaggggacagtggcttattaaaaggtcttttcctttcattggcgggggtgaaccaatcctgggtggtcatagttgatatggttcttgtagtggttcctaacttgggacagtggagagaggatgtttagggcagcacccactcctgcaggtgccttttggcatttggattaaggcggtgggcaactgtctaactatttgcaccattgaccctaaccatggacacctgtctcttacccgccctggggaactgcagttttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacaggtacacggcagggttgccacctggctcacatggtgggcctttgtcctggtgttgataccctgggagggatcccttagcattagcattggacatttgaaccagaacacgtttcttcagccgtattactagggagttctagtctttgataaactcaaacaaggtgctcctctgcaaacagtagtaatggtcaacacttattgaatgcttactgtgtgtcaaagcactttatgtgtatgagctcatttaatctttgttaactgttaaaaaatattagcagttaattttatgtattcacctatgtttgacagaaaactgaggcgcagagaagttaagacacctgcctaaattcacacaactagaaaatgtcggagctgggattcaaacccaggaattcaggttctagaatctgctcttgcaatcaccacattggtctgagtcagggttggca

SEQ ID NO: 95046 - DNA, 2033 bp, Homo sapiens
aaactgctttgcccagtgagcgaaccaagcacataggaagaagttgcacagcagggtcagctgcgtggtgcttatgagcccattcactggggtcggagggcctcggagtgcatcctgcttctctcttccaagctgtaggccttgagcaagtcactccagagcctcagtttcttataaagtggccataaacatgatagatgttccacaagggtgctgtgagggttaaataatgtaatgcatgatctatgcttagcccagtacctgctacacagtaggtgctcaataaatccaagtaagtaccttaggaacagtttaatttgcgggtgagatgattggtgactctgggggatccgtctgacctgtgaggttgagagctagaagcacagctggacccccagaactgacctgggagctcttccctgatgtcctttccatgcttgtgtgtgatttttagagcatcctcctcaagtggacaaaaggcttcaaggcatctggctgcgagggcgaggacgtggtgaccctgctgaaggaagcgatccaccggcgagaggtaggagacacatggcacgaggtctgatgtgtcagctcctcaatgattggcctggtctgtgtgttcagaaagtgaaggcaacagtaagtgtggctgcatgggttgggaggaagattaactcaagcgtcgttcagcagtttagtgtgcactgtgtgtcaagcaatgctctcagcactggcggttcaggagtgaccacaacaaagctttgttctataaagtccatgacctagtggcaggtgctgttaagagctgtgaaacacacacacacacacacacacacacacacacacacacacagtaaaggaataaaagaatggccactccataagcaaaacagccatgagggctgctggttgcacatttttatggttatttcttgattatatgctaaacaaggggtgtattattcatgccttccctttttagaccatatagagtttaaaaaaaaaaaagaaagaaaaggagtgaagtggggtgaggagagcagatggagcaagtgtgctggaaaggggcactgttaaatagcacaacttgggagggtctcaccaaagaggtgacatttaagcacagacctgaatggaatgagagggtcagccatggtgtatgatatatattttatatacctgtaaatctcccatgcaattgtctgaaaggagaatattggggttcacctgtgaactgggcatctgcttcttccctctcaggagtttgacctggatgtggttgctgtggtgaacgacacagtcggaactatgatgacctgtggctttgaagaccctcactgtgaagttggcctcattgttggtaaggacccagactgtcctttccacatggggatgcacagccttgggtgtggaggggttggtgctgagtgaggccctggtatcctgtgattggcaggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggtaggcacccaactggggccctgttaagtgtatcccaggactggatggcaacaagtgatcagagcttccacaatggcatctcccaggacgccggttctcgtgagatgttaataaaggaggttttcttggaaagggtttcttgtcgaatgcacctggaaagttctgagttagtaaatgtaagaagcatctcccacccaaaagcctaggagaacaggtgggagaatactagaccctaggtctggcactctaaggagaaacaagtagaaagttgaagcacctgctgctgacaggctgaagagcatctcttgggtgatgcagacaggagcaaatcctctccctcctccatcttccagcgccgagcaccacctactgtcagaattgagcaaggggccagcccca

SEQ ID NO: 95047 - DNA, 1327 bp, Homo sapiens
agatgttgtctgtagtgtttcctaactagattaatcaaacaccctagtcctgcagaatacgctttgcaaaacatgtgtctagaatagaagttacagactaaaatgcctctaggggccaggcaggcaacattaatgaaggaagcaggctgggtcaagataagatggggtggtgatgggctattggttgaaactagggacctcgtttttttttcaaggcaggattcaggaccaaaagaccctcaagccactgcataataacgtttagttccagtggccaggatgggggccctacagctggcagtagttacttgagtaatgatggttaggtccaagagaatgtatactgaatgcctagtgaggttaaagattaagactcagcattctcccctgctccgagaagtccagtggggttatggtgtgttccttctcgagttgcttcttgaaatttcgaaataagccttggaaaggaaatgagttcctttccctgtgggttcctttccaaggcttatttccccaggagccccacgggcctcgggcactgtggtcagtgttgctgaaggttgtgaattagcatgcaaagacaccagggatcctgcccaagtgaatcaagtagcaattcctttcccatcaggggagtctgcctgtctgccactgctgatgcactgggggtgactaagctggcctgtcctgtctcaacacatccctccaccttcctacttaacctccatgaatgttacttgcattgcaggttcgagaaaatgatcagtggaatgtacctgggtgagattgtccgtaacattctcatcgatttcaccaagcgtggactactcttccgaggccgcatctcagagcggctcaagacaaggggcatctttgaaaccaagttcttgtctcagattgagaggtgagagcttagggctcagggtagcaggggggccatgtccttttttctcactggcagacaaactgaaggatttccataactcagggcatgactcatacaaaagtcagtttagtggcaaacacattcatgtctatagtgtttactaaaagcacattatgggcagttgtcattttaagggcaaacagagcattctcatgaaagtttgtgctaagcctggcctgaggtcatgcaaagtgatattgttgggttttagaccatgtatcaaaggtagaaagatacctgctcatagcatgtaaattgaaacgcacagaggaagataacctattaaagcatccacacttggcttgaaagcccttcctaactgctggctgcagtaatcaggcagccaggattgagtaaaggttggaacgtcaggcaatgcag

SEQ ID NO: 95048 - DNA, 1048 bp, Homo sapiens
acagcagcgagaaaatggacatgaaagagctttgtaactgaccactgtgataaacagtgaatttgctttgttttgagtatctactttgtagtagtaatggtctatctggagtagggagagtagaatgaggagctgtttgtattcctgtcaccgtcaggaagagtcaatgcagtgcagtaggttgagcagtggtctgaatttaggaatgggaaccacctcgaggggccagctcctggagagctagacccccacagagcctcccctgtaaggactcaggccctggtgtggtaggctaccagccttcttggtgcatgactgaacacttgctgtctccctcccaccccagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcagtgagtgcctgatcccagccccccctgcctaccttctttctgtctttgttctttcccttttctttctctctttcctttgttactttatagtgaattatcagccattccaaatagtgtatataatacatggattatagtttaaagattcataatcagaagtaggcctgtgtttcaccccccaccgtgggaagccccctccgagcccctccacaactgtgtcatcattctcccatgccaggggtaagtgttgtgctgaatcagtcccttgcttttcttttccacccccatatatgtaggtatgcatccatattgtttagttttacttatttttgaacttgccacaaatagaatcacatggtatctcttctgtggctggcttttctcacacagtgtttgttttgagacgcatccgcattgaagtatacagttggtagttcattaattttcagagctgtatagcgtaccttt

SEQ ID NO: 95049 - DNA, 3406 bp, Homo sapiens
gtcctggtctccccctccagagttgtgctcctctgttaggcacacttgtggcttccatggttgttgaacttctcttttactgactattagttttaagaacacagtttgccaggatctcagacgtttgtcccagaattgaatcctagctctcctaatggctgatatgatgtggaaattgggcatagtactagtgtctccaagccacggttttctggtacttaataatatatagtaaatgtttaatacattatagctgtcatccttctcctcttcttaattatttctgtgtttccagcatcgcttcttagctttcatttctaagtgcaaatacaaaccaatcatgactaagatggtttttcctgtgtcttcctcccaccttttccagctttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgagtagatctgcttcttcatcttgacatgtaatgaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataatcaaatgtgattcatgagtgtttttaagagagtagtcatcttccggtcgtatcagtacttcctggccagcccgatgagtaatttatgggtgtcttgattttgagtgtgtgtgtttgagaggcatgtggcttttccagaaactcagtcccagtggaattagaaggcagcttttcctggactgccttggaccccttagatttcaagccactgaagagctatggctagtcctgcggtctactgtttaaatagcttggctgaaattagcaccaccctgagggcctctggctggtcttggttggcaaatgtgattcatattcaggatatatagctctcgtgaacatccaaaaagcacttgcctctgtcctctccctaccaagcttttccttctccccagtaagcagaacacaggtctggggagtaaattcatcaaaagtccctagtgatacccattaacattcacatg

SEQ ID NO: 95050 - DNA, 1017 bp, Homo sapiens
cattatctttatttctccccacgtcgccagagcctaacacacagtggctccatctccgctcactgcaacttccgcctctcgggttcaagcgattcttgtgcctcagcctcatcatgagtagctgggattacaggtgtgcgccaccgtgcccggctaatttttgtatttttagtagagatggggtttcgccatgttggccaggctggtctccaactcctgacctcaagtgatccgcccgtctcggtctcccaaagtgctgggattacaggcttgaaccatcgctccaggcctcgataaatgtttaatgaataaaacgatgaaaggacccgtcgcctcctaaatgcagatctcgagggagcctccaggtggcgctcgccgctcggagaagcagggagtcggtgcgccgcagctccggcaggcgtctgggaggtggtcgcctcctcacctgcccaggcggccgtcccccgggagcgggtggcggtgacctcaggactgacgcactgcctcctccgggcgggtgcgcagcctgcgtcaggggcgctgttctccctgtgctcttggaccccgcagttgttttaggaacattcactggagagcgagaagggggccgccttccggtgcccggtgggcaacacctaagccgcggtgtttactggtgagggagtcggctgtctgctggcggctgtgacagctgcaacacgccacacaaagatgttatttacctgtcatattaatgatagtgttagcaagtgcgtggcacgtccagtacttttttttttttttgagacggagtctcgttctgtcgcccaggctggagtgcaatggcgcgatctgggttgacagcaacccccgcctcccgggttcaagcgattctcctgcctcagcctctcgagtagctgggattacaggagcccatgacgaaggccggctaattttttgtatttttagtagagacggggtttcaccgtgttggccaggatggtctggatcacctgacctagtgatcctcccgccccc

SEQ ID NO: 95051 - DNA, 1028 bp, Homo sapiens
gaagcctaggtcccagctccgcagggctcctcttccaagctttgaaattattgcaaccccagtatcttccctgtgttcttcagccccagaggtagagctgcctctggcagttaccatccctgtgtttatcttgatacttcctttttgcctttcagcctctaatacctgcttactcaattgcctagattaaattatttctgttaaaatgcaggtccttttcctgttttctttcctaactagatctgactgttaacatgccccttggaggcattgcctgagaagcacatcagggtgtagccttacctctctgtgctgctccgaggaccctgatctcagaaaccctgccagtggccccaacatgtgaaccatcgtggtaaaagaactctctgatcacaagaaagtcccctaatctaagataatgttgataaacaagctaactccaggagggagggtttaatttaagaaagccagtagggaccctaaatcttttcattccaatcaaagctgtcaaagccagttatcgtcagagccagtcaggtggccccaaagccgccatctacctggcagctgtcctgtcaccacggaaaccacaagttggtgaacaaggcccgaaggaaccctgctgaaactcagttgcttgacatatttgtcattatcgagtctgccagagtgcagcatctcttgcaagagtgattctctgaaacttctcctgcttcaatccctctacccattgtttcccaaatagagaatatgcccacctctgagaaagacatgtgctggcaggcatcacaggcccaagaggaggcacttgtttactcgacaacagacaaggtgactgtctgctgcattggcaccaggactagcattctttgggcatccccaactaccttttcaggcccccgtgtcttcaggctgtctaggtcctggactggtggtcgtcaagtctgcccaccctcactatccagcagcaccagtggagcatgcttcataactaccctttcctctctccgaattgagtttgatgtcat

SEQ ID NO: 95052 - DNA, 1056 bp, Homo sapiens
gcaacaaaagttttcattagactttaaaaactttgagtcttactcatatttaatccttagttgctgaagaagtgactttcatatataggagaccctaagggggtacattctcagtgaagtgacagccatgggggagggaaagattgatccatatgaggacttcaaggtcctggcatatcaggacaggtctttaggagtcctgttgacataaataaaataggtagattattgagactgaggccaggccctaaacactagtgtattaatttgctagaactgccataacaaaataccacaactgggtagattaaacaatgacatttgttatctcacagctctggaagctagacttctgaaatcaagttgttggcaggattggttccttctgagggcagtgagggaaggatccattccaggcttctctccttggcttattggtgggtgtctccttgtttatatcatattcctgctgtatgtatgtctgtctgcctatttctcctttctataaggacaccggtcacgctggattaaggctcactccttaatgacttcattttaacttaatgatctctctaaagaccctctatctaaataagttcacattctgaggtactgatagaaatacaacatgaatttttgcggagacaacattcaacccataaaaactagaattaatattcctgagaacaaggggtggcaaagcctcctccttcatctggggtgaggggagtcttctgagtagataaagaactccttttagggtagaaaggagctgaagttcatccagtgcaagtactgagtgaatttattctaaggtcccaagacaagagaaagataaaaacaaaaacggatgtatcactgaaggagatgtgctcggccagcttccggcagcagcaagaacagtgggtatataagctccagtagccaaggttgcccaggttacccttttcaggggcagcagtagaggcatagttggttccggagtcagaaagacccagcatcttctgctgatgctcaagctgcatgttttttttcaatcttcgcagctacaaattt

SEQ ID NO: 95053 - DNA, 1329 bp, Homo sapiens
agaagtagagggggcaaagaaccaggtagctgactcatttaatcctcccaaaagggtttttcttattgcagtttctttgcaactctgaccatattgtaatattaatcaatcaatctatcacttgcctttgttgatatttctgtaccctccccctgccctaaatttatatgtggatgccttaacccccaatatgactgtatttggagatagggtcattacagaagtaattaaggttaaatgagggcatacaagtagggcattaatcccacaggattagtgttcttataagaaaagacaacagagagctcctgctttctctctctctctctctctctctctttctctgtctctcctctcttcctttttgcacatgcacaaagaagaggtcatgtgagcatggagcccgaaggtggccatctacaagccaggaaaacaaccctcatcaaattggctgacacctcgaccttggacttccccctccagaactgcgagaaattaatttctgtttaagccacccagtctctggtattttgttatagcagcccaactggactaatgaaatttatttaaattatatttcccccattagaatgcagaaaccaagcatctccatttcccaaataccaccagtacctggcatggtagctttcacatggcagacactcaataaatatttgttgaatgaatgattagtaaatcaataacataataggtagtattatcctcattttaaagtggagaaaattgacagatatgaaaggatgcttaatactcacaacctagggacacaaatggcatttccttaaccaaagttagttgaaagtgggccaggataaaataacatcttcagacacaaactacattaaagattgctttagctgatccaagagaagggtcatatttgttccaatttcagtctagtgtcctctctgtaaaagggattagagatttgccaatccacatctggttcactccctgtaaatcaatgccctcagagtcagtagacagacacaaagcttagaggaatttaattgccaaaggcaatgtggggatatgagaggatgagcatttgctgtctcctgagagacctcacagggtggcactgcctcggtccagggtctggtctatgccctgcaggtttagaaactggatctgtcagcacactgagagtggatccatccctcagcttcaactctaattaattaagctcagagagctgatgcatgaaaccagcatgtcaatgtattgattcacaagagggataaaactgccactgtgtctggaacacttgtctctacatgacttgcacattcttttaatgaagtcaga

SEQ ID NO: 95054 - DNA, 2030 bp, Homo sapiens
atgatctctactaatgagatatcttcagaaggtagaattaaagcaaaattaatgtacacagaattcctatttcaatatatttattattcacaacatttctacacacacacacacacacacacacacgcatacacacacacacacacacattcctgcacaggtaatttatagtggctaatccactcagtactgtggactttggttttagagagcattgttttcaagggtagtacagataatctgcctccaacatattctattcttagggctctaaagtcaaaggagtttgtacagacccctccctgctaaggtaattatgtcctcttcatatcttgcatgaatgtttgctcttagagtgatgatctgaaatatcaacatcctgcaggacctagtctggtctggaagaagaagagatatgtcatctctatgggctttgatcttggtaggcatatttattcaccaggtacacaaatgcaactttaaaccctcagccacatttagtaaactatttcttcatctgttgcagtcttattctgatgggaaaaatttcctctgtttttcaagtttaatttattattttttcaaattacaagagcaatgcatattattgtaaccagagagataatgccaagatcggtagagaaaaacttaataatctcgacctcctataaccatctctcttcccatccccctgaggtaatagcaaatgttaacagcctgctacctctgcacatcttccttccttcatgatttccctacacacacacccatacacacacgtgcgcatgcacacacacacccactcaaacacacggtgtacgtccaggagtcagaagtggctacagagatggagtcttcattattaaggtgagaaaatgataagacaaatcacccttctatttctacctccatggaaagctaaatcttccatttatatttttatagtcttttcagcactgtcttaatggtcttgagaacatattaccctgaaaatgtaaaaatagagccaaagaggtgaaagctccttgcgtggcttctgaccagggatggctgcttccatgggctttagctctgccagttctccctagactggggcaggtaggcagtgaggatttcagcatatattaagtgccaaatagaaacaaatatttgtttctattattagagtaaaacaacagaagcctgtattttgaccagaggcctggaatctactactttgtgaattagctaagcagccccagttgaacgtgaaccagcctggaacagagtggactgcagaggcaataaacaaggatgtcgtgaagaccctgtttctttctagcgtggcatcccaggataaaatatacaattaatagatactggaaggcacactttctgattatggagaaaccatcaaatttggccatggttttgcataggggctaggttggaaattcaactagaacaatttaatgtctactggcaaagcttcttaattatggaatgaaagctacctcaaagtgcctggaggcttgagctgaatggtgagatcttcattgacctgacctcctctgtgctgaagtttgctgacttgaggagacctcccctaagaacagaccctcccctcagggctgccttcagcgatgatgattgacgctggcaagtcagtcaagtgggaagtttgcagcacacacggctcaaaggactcacccagtttgccctgttggaggatgttaacctttgcacactatttttgacatttaatttttccttccatttagtgcatgactctttttttgtctttctagtaaattcatttagttagtattattctttgcctattttgtcttttaaacttctggtttttaatctttcgtattttatattatttattcttggtgttcatgcttcttattctcttttctgctattttatcttattgttgtgataatagtatatttgcagtaagctccttttactaacttcatttatttctacataatgttttatctggctttgaccacaactatataaggggacagcaaagtgga

SEQ ID NO: 95055 - DNA, 1756 bp, Homo sapiens
acaggaagccatcttcattctggcacgagccgcggtgcgcctgcagcgcgagggcatgcgggagtgggggaggtggagtgtggggcggggcctcggggcctcccgcgggcggggcttagggcggcgtggcccgggttttgagatgtgggcgtggacccggaaggcggaggaaaggggccggggacctgtgcgagttttgttaacactcctccctcttgttgaggacctggatagtgagtgactttaatttgtatctccagggcctcgtacagaacttgtaggagtctttagtgaatgagggagaatactgggaagagggtagcggaatggatcttcatgaagtccaggacaatcttagcttccagaacattttcttgccccgagcctttcttctccctttctgcccccacccacaaaccggagccctcacctcctcagtgtgttagaacccattactaaaactttgcttttttacttcacaggaactgtttgtggagaccattgcaaaagatgcctactgttgcgctcagcagggaaaaaggaaaacccttcagaggagagacttgggtagagtggcactgcagtgtctggggacagacaagggagggctgggctggtttccccttgtgcaggttgagaagacgtcactctgatctgagaggtgccacagcgtctctccccaggatggtttctgttggccacagtgccaggaagccctacctgtagaggctgtctgcttggggtggcggggcagtgtgtgaaggtgtctggggttgccgtagcggactggatcccttcataccttctgccaaattgcaccagaaaaagatatttctttttcacctagcaactggggatttgatttctgactcttgtctggctgggaaccctcacctgggtaagatttcgtataccgtattctcatgcgccctgcgtctattgccacgttcttctctgacaactttaagagcaaagcgaataaataatttaggggtaatttaggaggcccccaacccccgcgttgaatggtatttgcctatgcttttcttaactcttctagggagacagctaatatatataagagttgctggtagagtagatatggatctcaaggcagcaagggacgcatcttataaatgccctcatttgcccaaagcctcatgcccttcactgcagattgtgctgttttctgactgaggtcagcatggctgaagttagtcaggtgtctcttttccttgtgtttcagataatgcaatagaagctgtggatgaatttgcttttctggaaggtgagttccctctcagtgggcaatcatttccgcctgtcttttgcatgttgatgtgaaattcaaaatctcataaaacggatgcctgcttcttgtttgtgtagggataattctccgcacttgctattaggatagaaaaaagtaacttgctaaacctagtgaggttcagttttctcccttggggaattaaaatttctacctgaaaattgctaaccataaagaaataggagggaatataaagatcccagtggagttagatgaattcgaaagttcgattcctactttgatcgccatccctaaatgtcaggcttgccccccctcatcatgttacagatcagaaacaattgttaacatttaaagggtcaccgcttgttcttttttcttcaacaatctgtgtgaagtgattattttgctgcaataagacttgtacttgtctgtatttttaggagtcatggattaacttgtgtacta

SEQ ID NO: 95056 - DNA, 1038 bp, Homo sapiens
atgtagtcatgtgctgcgtaataactttttggtcagccatggactgctcacatgagggtggtcccatcagattataatggagctgaaaaattccttttgcccagtgaggtagtggtcataacatcctaatgaaatacattaccttttctatgtttagatttgtttaaatacacttatcctcatgttacagttgcctacagtattcagtacagtaacatgctgttcaggtttgtaacctgacaacaataggtataccctgtagactaagtgtgtagtaggctataccatctagctttgtgtaagtaccctctatggtgttcacacagtggtgaaatcgcctgaagatgtgatgcatttctcaggatgtatccttgttgttgagcgacacatgtattttgattgaatagcttagcaaaagccatgtatccttattctcccagggtgttctcattacctccttcaagccttattacctttagaaatatcttgatttattccactcttttttactcctttgttctgcatctccctgtcaacctaggcccctggtccttttgatagatattttttaaatgtcttattagatagatagactaccatggccaactctatgtctagactattgagcattcttttaatttgcagatttttcttcagcctctctttccacctactcatttttcttaaaattaacttttgttagtcctacctaaggcaggcactccttgtgacagactttctgtaagttctgcagtcaaaaatgtttggagcctactttacctcttcatttttaattaccagcttttcaaagacatgagtgatatgatcagatttgtattttaagtgcacaacattgctgccctggggaaaataaactggagggtactaggaatagaagtggggtggtcttatgtagttttccactctagcctctatcacagcatagtgcttagcttggatttttaataaatggccatttattgaatgattggtgtgtttattttcatcctctgccttcatcctcatttatctctgtaa

SEQ ID NO: 95057 - DNA, 1891 bp, Homo sapiens
atgcagaatgctttgctgtgggaagctggcagttttagaggctgttctagttttctccatatagttcatttggttctttagaagagagccctgtgatctttgttttttttttttttccaagttaggtttaaatgcctgtcttctggttgtcctgcctgtggggagggttgtggggagataggggcaactgtttgtcatacagaccctctggtcattaacccattttcatctcacatcaccattcctggtgacttgagcctggagcttcctcatggttcttttaggcatatgggcctccttttctgctgcagccccctctgttcattctaggctcctttttcctctgctctatttataagcatactttgatcaggtttctgttactcagttttttgttgaaatccattaactgccagtgggcccctatttgttgtagatttatactttttaaacttttttaccttttgaatggaatcttggatgggagggcatacgtacttgtgggcccagtcccccatctggaactgaaactttctaaaaagattataaactctttaattagagagtttacctcatttattttatattcttttcttatatggtcttcatcaatgttcattaactaacacaacgacttcttagcccttttcccacttctaattctagctcttccgactagtatgcttaattcctaactgcccaccatctgtaatgacatgttttccctggggatattttggatggatcatcctcaaaattagtattttggtcttagagaactgctgccaataccggagcctcttctgcattaagtttgcccagcttgttacactaatccagcttctgaggtcccctgatatactcattgctctttgtatgtttaggtactttagattgattgccgagcggggcagttttgtgagccttcatctgaagccttcagttcacccctctgcacaggcctcagctttgaagaacggagtctttgcacttacacacactcttcctgttctgccttcacctatgccgggataagcagagatctcatcaattagctcttctctgcaaggtcttccactatttctgtctgtcttccatatcaagcctggatgcagctgctgctgcttagagcagagatgaagaaagtgttctgcataagtggcttcctgaatgatgaggaccagaataaaggtttttgatcaacctcagtccagtgtgttttataatctcgcctttgttcctaccctgtgactggagagtcaccatacctggtcacagaccttcctgatcttccctgccagccattctaacatacagtcctttcattaattttgttcttttatttttccagcacatcaccagaaagtggttccagaatttatggaacaccacttgccctcaggagttcaaataaatatggtcctagattgaaagccagttaaattttttttaagttttatttattgacatatccacatactctatatttcaccaatttaaagtgtacaattcagtggtatttagtatattcacaaatatgtacaccagtcatcacagtcgattttagaacattttatttatttatttattattattatactttaagttttagggtacatgtgcacaatgtgcaggttagttacatatgtatacatgtgccatgctggtgcgctgcacccactaactcgtcatctagcattaggtatatctcccagtgctgtccctcccccctccccccacccgacaacagtccccagagtgtgatgttccccttcctgtgtccatgtgttgtcattgttcagttcccacctatgagtgagaatatgtggtgtttggttttttgttcttgcgatagtttactgagaatgatgatttccaatttcatccatgt

SEQ ID NO: 95058 - DNA, 1284 bp, Homo sapiens
tgagattcttaatcctgagttctcgtttcattgcactgtgatctgagagatagtttgttataatttctgttcttttacatttgctgaggagagctttacttccaagtatgtggtcaattttggaataggtgtggtgtggtgctgaaaaaaatgtatattctgttgatttggggtggagggttctgtagatgtctattaggtctgcttggtgcagagctgagatcaattcctgggtatccttgttgactttctgtctcgttgatctgtctaatgttgaccattttcatatgaatggaatcatgtaacaatgtggtctattgtgtctgggttttttcactttgataatgtttttaaggattatccatgctatatagcatctactagtacctcattttaaaaaattgtggtaaattgtacataaagtaaaatttacttttataacaattcttaagcatatagtggcattaagtacattcacattgttgtgcaactaaccccatcatctatctccagaactttaaaaatcttcccaagctgaaacttcatactcattaaataatcattcctcattccctacatcctgcagtccctggctaaattttggtttggaggaaaggtgtgggtgacataacaggaaggaggcagagtacctagaaagtagcagttaaggaaagcagcaggaagccttggacagtggttctcaagtattactgggtcatggaccatttttaaaatagtccatgggatttgctccctggaatgatgcacagatgttcagtactgtcacatttaaaaaataagctttattttggagtaatactagatttgcagaagagttgcaaaggtagtagagagaagtcttatatgccccttacctagtttccccattgttaacgacattaccaagtacatttgtcacaactgagaaactgacatttataggttactgttaactacagtctatttggatttcatcattttcttcattaatactccttttctattcccagatccatgttactatatcacatttacttgtcatgttgtcccagtcttcactggtctatggcagtttcttagtctttcctcatttttcatgaccttgacagcctgagtagtgctggctgggtattctgtaggatctccctaactggggattgtcttgtttttcttgtaattagttctataacgttgcatatgattttgagcatgaaacagaccccagaggcccttctgtaggcctcctattatcattgccaatgggaatttaaaaggacatcgtgg

SEQ ID NO: 95059 - DNA, 1172 bp, Homo sapiens
tgattatgaataatgctactgtaacatttgcatataggtttttgtgtgaacatcactttttgttgtctcttaggtatataggagtaggattgctggatcttatttaagtgtatgtttaattattaaagaaaatgccaactattttccaaagcggctgtaccattttgtacttataccagcagtgtttaagaatttcagttgttttgcatccatgtcagcagttggtattaaaaatttttgccattataataggtgtgtaggggtatttcaatgtggttttaatttgcatttaccagatatgtattatgtaaatattttctcccagttccacaagacattaaattttgaaaaaaatgctataaatggttcttagctgcactcagctctgttggtgagatgactcaaatgaggcacctgtgccttccaggggactcctcacttttccaccttttggtataagcccctgtggagaagcagggcttcctttgtggtcaccaactcctgtgccctcctcctgcctcagtgtctatcagtcacgggctaatggatcagaaagagaccaggcattcccagtatatctgactgggagcactaaagcagaatttcctggtggtaaagatcatgcttggagacggggaaaagcaagctattgaaatctgatattaacagtgtgaaggactaatattcaaaaagaatcagagaacattatgctaaaaagtagaaaactgtcctatttatttatttatttatttattttgagatggagtcttgctctgtcgcccaggctggagtgcagtgggatgatctcggctcactgcaacctccgcctcctgggttcaagtgattctcctgcctcagcctcccaagtacctgggattacaggcacgtgccaccacacccggctaattttttatatttttggtagagacagggtttcaccatgttggccaggctggtctcaaactcctgacctcaagtgatccacctgccttggcctcccaaagtgttgggattacagacatgagccactgcgctcgacctaggaaatttaaaatgtgttcctgatttcttcattgtatctgaatcagggatctgacattcctcattcaaggcttcatatctctggacatcttaacacttaaagcatttttctttttttcccctaattagct

SEQ ID NO: 95060 - DNA, 1034 bp, Homo sapiens
gtgcttggcacatcatgttcagtcaacattagacattgctatcgtagcttttcttacctataatcttggccttcagtaatgcatactgagccttccagactttcctgttctgagtgtgggttgcctatggtaacaaaagctctaaataagtaatgagggctatttcaaagacacataagggaaacaccagacatgtacatcagacactgagcttggctaatgagagtatgtttctgagaaaaaggttcattttatgtgctgacaatcccaggtttctcggcctgagaaatactcactgagattattaatgttaccatgaaggggctctttggagacagctggagagctggacagccaaagacagacaacatgtcccttgccctccccactccctaatagagtgcaggatagcaaaaggagaaagacatgcttttaaaaagatgtctgtgctggtcagcttgtgatgtttcttgatgagccgataatgagcgcatctctaccttattagaaaagataaatagagactgactagggcgctgcagggcagtgacagctgtagaaattatctgctctcatctcagggatgtcacaccagtgtcacaaaacagagatcaacatttagcttttaaaattacctgagtaaagatagtgaattcactagagactgtcaatgcattttaaagaaatgtgtcatttcagaataagcatctgtgaaactgtatttcaaaacattgtgtgacagtatttcttatttgtcttacctgctaaaaagaaactttgtgccttctgtgtttagaaataataaaatactaatctggtgaatgctggatgaaaattttagggataatttctagattcctcctctttaaattgttactatatggcgcatgttaaaaacgaaagctaaattgggtttttgttttctcttaatgtccctcataatcatgagtgacatgaaatacagtgatttcatgacatagtttgtaaaagtgagaaggtctgtaattcagaacaagtatcctagtagagaaaaa

SEQ ID NO: 95061 - DNA, 2020 bp, Homo sapiens
attcctgaaaatgtctctgagcctccactggtctctggaccacactttgaaaactgctgctgtagtatcttgctgctcaaagtgtagctcagggactagcagcaacaatatcatctgagatctgtagaaatgtggaatctcagaccttcagaatcagaatgcacagtttataagatcctcaggtgactcctgtgctcatggaagtttgggaggcacttcttcagtagcttctagccaggacagtattctggggaccttatatgtctgaaaattcctttcttctagcctcatgctggcttggtagtttggctgggtataagctagatgctaggtggataatcattatagttttccgtttttgtttccccagagaataaatcaatggtatcgagtgggagagttggggacattatttacttggcagagttggggaaaggacaaggggtttctcagtgccctgtaaatagacttcccacctgtctcccttttttcagttccttgcctcattcctgcctccctcagaacattgtcctcatactttctgggtgtctgaaggggcattgtgatcttgtcctcattgttatatcatcttctactctgaataaagtcctttacagtaatttcatagtgatcttttctttctggttcaattgcaatccaggatcacaccatttatttaggttttatgtctttttaaatttacattagatcttcagacttttgtttcccatgattttgacattttgaaaagaaaacaggtcattaatattttttaagactataacttgggtttgtacaaggttttaaaaagtcacacaatgttatttgtatcaacaagggtcctggcaggaaacacaggcactcagaccattcaggagactttagtaaagagtcaatttttggaggtgtgggcagaattaaggaaggcaatagggatggtgaggtgcatcatccttactgccttccttcattaggaataaaggctataaaggcgcctcatttatagcttcctctgcccctccccttctctttggatttttgttttcccttttattatttcactgtccttttaatgatgtttcaatggttgtgtttgcccaggagtgtcccaaatagttttaattaccagaacactacaaaatgttctgctctctgctggagctaaaagagtttttctggcccatcttttatttttattttttcatagaaacgtataggttccccccccccccccgcctcaatctattggcatttttattgagatcatattaaatttatagtttaatttaggggagaattgacatctttaaattactgagtctttcaaagacagggtatggtttttcatttattcaattatcttttatgtccctcagtagaattttaaaatttacttcttgtagattttgcccatgttttgaattttatctctttggttgttgttgtaaatgagatcattttttcccatatactttgtaactgtttggtgtttcacttaccatcctatcaatgaggatttttgatctgtaaatctccttttgatatataaatctccttcataacttaaaatgtattcactagatgttggtttagttttaaaagtaatacatgatattataagcaatattaacaaatgaaaagtaaaatttcctctctcttggtccccatttcacccctagagtttatcactgtgggttatttcttgtataatttttccagagcttttttttttttttttttttttttacttatacatgggtatatatgtatgtaacaagatattctttcttgttgaaatgatattctttctcccttttgggtgaggcccaatagcctggacacacaataaaggccttatacttccatgggttcaaccacctttgtaggctgtgctaagagattttaagtgagggttgtctgcattagacagcttccctctggccaatgagagtagggggtgtagaggccgagaggtttctttggagttttcttctctctcttttcttctaagagttcttta

SEQ ID NO: 95062 - DNA, 1058 bp, Homo sapiens
ctaacccctggccttaaaattattgctaagtcagtggcagtagggatgagaaggagaagaaggttcaaacaatgtttgggaggaagcattgaaaggagtcgataactgatcaagggaagataagatctattttgtacataatgaagatatatgtgggacaaatagagatacagaggtctaggaggtggttggatacataagtctgaatttcaggagacagatctgagctagagatttgggagtccactacctgtaggtaatatttggagccatggtcatgaatggcaagctgcgtaaggagactggatgaagcatgagaagtaggccaaggacagaacctcgggaaatactaacagaagaggagaacatggaggcttcagggaatctgtagaatcaattatgagccttaggatgatcacaagagaatggcctcaaggaagctaaatgaaagattttcaagaatgaagaaaagagtgttaaatgccaccaaagagtattaagagaaagactgaaacactgtttattggatttgacaattagaaggatataggtgacctcaccaagagtagttttaatagtgtgaattaatatttgtcatgtggttgaatcagggaaaaggctttctgggaagagggaacaacatcaacaatgagataaaatgtgaaaaagcattacattttagtaaaacagcatgtagttcagcactcagagtaatgaatatagtactgcaaaaaaagaaacaccttaaaattcacagaaagatctgaatttagtagagggaaaggacaaccaatattttattagaatttattatggttacttaatccaagttatcttcaaactcaaaggtgattataaatctttatgtatcagaggaatgaagctctcagcgttgattgccttctcaaggtcacatgttggtaatggcggccctagttttgacagtagttctttatgaatcacgtggtcctgtggtcttatacttgatggcccccggctttgagagaaaatggattgggaaggaagattattgatctggaaaggctctagtgaagtta

SEQ ID NO: 95063 - DNA, 2107 bp, Homo sapiens
ctcatgcctcagcttcctgagtagctgggactacacgtacataccaccatgcctgactgattttttgtattttagtagagatggggtttcatcatgttgcctaggctggtctcaaactcctgagctcaggcagtctgcccacctcaacctcccaaagtgctaggattacaggtatgagccactgtgtctggccatatggaacacattctaatgtaactgtgaactaagagctagtagtccaacagatgttgagtattacggtttttccctaaaaaatttaaaatgtctcactacacccctttaaatttgctaggatgcctttgcacacagtttaggaaccacaatatgcatgcaattttgaattctgatttccttgcttgacatattataaattatcttctcttgtttttatatcgttataacaactgattttaatagctatataatattcactggagtcactgaatcataatcttaaccattcttcattttggacattttaggttatttgcaatctgatttttttaattaacaaataagaatcagtgaatatttaattattttcctcctctcctttcttttgttcagatgtgtgtttttgaactattcctttgtaataattgccaagagttgtattactaatcgagatgaacatttttatggcacttagtatatttttctctattgccatttaaagaaaacttagctcaatctgtaatgtcgccaatatcatgggaatattttaccataatcttgccctcttcaggtccaagtatagttggtgaaaatggaatctcacacttatttgattttcatttttattgctaatgtgagtacatttactgattcctttattgaaaatctaccatttgccactgtgttactttcctgtggctcctgtaacaaattactgcagacttggtggcttaaaacaatagaagtttattcgctctgaggtctggaggccagaagtccaaaatcataatgtcagtagagcaacccccctttccagaaactctgtaggagaatccattccttgactcttctagtttctggtggctgttggcatgccttggcttgtggccacatctctctttgttgcatcttcacatctgcttcttctcttgtgtcccaaaattccctatctcttaggatggtacatgtaattgtattcagaccccatcgggataatccaggatatacaccacatctcaaagtcttaattacatcttttgccatataatgaacatgaacatgaatgtgaacatgttttcatggggtcaccattagcctgctacggccagttacaatgatgtacaacctctgcaggaagggagacaactaaacaaaacaattatagtgaaatcctacaggtgctgtgacagaactctgtgcagggtcctgaggtggcacaaaggagcaagtgggtgatcagttttataggagggaaggtaagtgaggaagtctgagaaagcatttatggaagtggtgatatttgaatgggttattgactgcaaaatatcaagagtgtttggagattttgtagatatgcgtagagctggatgggaggcttggtgagaactgaaatgacaaaagatgatgcttcatggaaaatataaaaagaatagctaagccagtgaaattggctaaatatctggtcagttttcttcatgtgtctttgtgtaaaatagaggttcttcaggatcttttgaacattccaagcatggaggagctgtgattagacagaggacactaatgtgaaacataccatgttataagatatatgttaggagtgcatttctttacaaggaccagaaaacccaaataagaatgtcttggctgggcgtggtggctcatgcctgtaatcccaatactttgggaggccacggcaggcagatgacgaggtcaggagattgagaccatcctggctaacacagtgaaaccccatgtctactaaaaatacaaaaaaattcaccaggcatggtggcaggcgcctgtagtcccagctactcgggaggctgaggcaggagaatggcgtgaacccaggaggcggagcttgcagtgagccgagattgtgccactggactctagcctgggcaacagaacg

SEQ ID NO: 95064 - DNA, 1026 bp, Homo sapiens
ctaacttctgtagctctcactgattggggaacaccacactcagccctctccacatccctgcgctgacaatctcagagcttccagaaatgagaaatagcgacccctcaacaaagtgagcagtacctgatgagtaagagagttaaaagataaaatgaagcagtttcagtatattttctgatacttctagatttgtttgatttttctaagttgtatttaatctctattaagttttcttcctttgctgatacagattttgagccatttattaaagtcacattcatatatcaaaatagcaaataatttaggaaaatggtgcttttttctttttcttaaatgtgaggaatatttacttacattggtctttggtttttagtgtcctcgtctttgtttccttcagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaagtatggatttaccaatatatgaagattaggatattttttattagaatataatatgagagaatctccataaaaaatgtaatatgctggctcacattttatagtgttgataatggtttttaacatcgatttggtccatgatattgtgacctctaaaagatgtatctgtatcaaaatgttattatcaaggagtatgtgtaataatgtttattaatgcctgacctcccaccttgatgtttttggacaggttaaaaaaaatgtgcagtatcttactttcaaagcattgaaaacgatcgtttttacctgtataaatatattttttttaacatggaagcatctatagagattttagatgtcatgtattaaaatcttccctgctgtaataaaaaatttcctctaccaataat

SEQ ID NO: 95065 - DNA, 1021 bp, Homo sapiens
attatacattttattagaacaaacattacaaacaatgtgttgttaataccctctgtttcttcccaaaactaaaggttcctctatgacatctcttcgtgtaacgtggcccttggcaatacatgtgaagtataagtgcacattgctttgtctcacaccagatctttgaggagcgaccaggcaggaaatttgcatttttaataagctccccaaggtgacctttatgcacactatagtttaaaagctacctgtgacagccaatataactgaatttatttacaaattcagtatatgcaaaaaaaaaaaaaaaagaaattcaaatggagaattgatgacagcttgtacttcacacccttaaatgttagtggggaaagaagggcacaaattatgatgagtgggcaggatgccaagctcattaaaattcttactggctcattgcctgatttcccagtgacctggtcatattttaagcaattcatcaatcaagaataaatatttagcgagaatgtgtggcatgctcaaggtgtggtgtgatttctcctggtccccgggcatatggacatatgttatatttgcatgattgattgtgcatgatctctcagtatttctccaatctgttggcaggacgaaaccactgctatacccaaattgccctcaacaggctacttatgaagggggaaatagcaatgaaataagcgagtcgggtttacacattaggcaaatccaataggattattttcaatgcagatgaagcctcaaaatagttttgggatggacacagaatctgggctttcagatcgttctctgtattcctttttatcatattagctaaaccacctatttgaaacgatacaaatttaaaacatatttctcatatagactaggtgaagtttaagaagcaaagaagttggaatggaatgataggtgtttgagttggactgagcttctctgacacgtcatctctaaaatgtggataaaaatggacactttcaggacttctgtaactatgaagagcaaatgagtt

SEQ ID NO: 95066 - DNA, 1261 bp, Homo sapiens
ttgtgttgttttgttttgttttgttttgttttttgagacagggccttgctctgtcatccaggctggagtgcaggggcatgatcataacttaatgcagtctctacctcctgggcttaaatgatccatcctcctacctcagcctcctaatgtgctgagattacagacatgagccactgcgcccagcctacgtctgttttattaacaaattcatgtctgacattcaacaaaatgcctcacacttaccaaaatattaaaatttctcactactgacagtaaatgacatgaactgtttcagtctttgtgcaggtcgattttgcaaatttaattaaaattctaaaaatatatttattttccttaagtgatttaatatttagaaacttatccaattaaaataacttccatggattcaaaaagtatgtgcataaacagagacttcacaaaatgattgtaaaaattccttttttttttttcccggttgctgctcgctgtcccggtccgtgccagctcccagttcgcctcgtcgccatgcctcggaaaattgaggaaatcaaggattttctgctcacagtccgatgaaaggatgccaaatccgtcaagatcaagaaaaataaggacaatgtgaagtttaaagtttgacacagcaaatacctttacaccctggtcatcactgacaaagagaaggcagataaactgtagtccctgccccctggtttggcagtgaaggaactaaaatgaaccagacacactgatttgtgctgtattaaaatactaaaaatcctaaaaaaaaaaaaaaaaaaaaaaaaattccttttcgttttccatatgcatgtgcatctacttatgtaatatgtttattttacatacgcgtactatttacattttgaaattctcagtgtattttaatcatgtattgattaagtaactacaaagtatctgtagttttaatactttataatcatttgaaacagtgtggtaaatccttatatactaacatggagagatgcattatgcatagttaagaaaaaaatgaaaacataaaataaaaaggcttataataatgtgtatgcattcacacatgaatattctttcaattctcaaaaatatatttagtagatagtgcctcggaatagtataaaaagggactctatttactttttcagtttataattgagcacaaataattaaaaagaagctactatattaacattatttcctaatcatgtatttaactgagataggaaggagaaaaatatgacaacat

SEQ ID NO: 95067 - DNA, 1049 bp, Homo sapiens
ttattgcacaagaaattctaatttataggcagaagaacaaagaataaattaattgccaaagaagctatgttcctattaaataatttaaagttacttttggactgtaaagataattcctcaagatatgttacctggcatactaacagttctgattttcagttgttggaatctactgtccaaatctgaattgcggtgttgctgaaggataataagcaagttgaacaatgttaacctttggtcaagaaatttcatttagacaatttgggtccctggtgggacactggacacctcacatggcatatagagtaagcactacttacctgaatatcacataggttgatactcaagtggaaaacaacccataatttaggagtagactgagtctgtatatgtttccaaaatgaattaaaatgataagactgtgaatgcagtgaaaagcaaggaaatgaatttgacagatactaaattttattttcaatttcaaattactggctttctattagcatactccaggagtggtgaatttctataaaattggcacggagtattaaattttatgagtgtgctattgtaagtataaaaacccatttcagtgagatatggacatggttatttctttttactcagcaaactctaggccatgtattattagtcttaacttatcaccttgaaagacttgaggctttggagctttctttgtatatatatttgtggtaacattttgtttatttgggtagaagaaaaaggagattctgaaaagggtatactagtttgataagtttattaaagcattctttaatatgcatttatgctttgacattgagtattattacagtaatattttcaaattattacaatgatatttttgttcagcagcacttctttgagtgttttgttaaaaggtgtggctttaccaaaaatagaagtcttgcaaatattgtaatatttgaggaaagtacttaactacactttagcaatagcggagatacccgcaccccaccctgccttcactgcaaatagcaaaaactacttagacattgcatatcact

SEQ ID NO: 95068 - DNA, 1064 bp, Homo sapiens
ggcgacagagcgagactccatctcaaaaaaaaaaaaaaaatgtctttttcatataccttttagtccagttatctaaagtccttctgttgcagacaaaagcaatgcattaaaatattttctcaaattaaggacagtgaagtggctaattcatatttgttcacataatacagtagaatgcttaaaacttttcttgaatttcatacagagatttggcactgtaagtagtcttaacatccttccagtcccctatctatatgccttatatttcctcctagtattccatactgatttaaaaaaattaaatatgtgaattttaagatgggattttccttatgatattacttccctacaatacatgactgtgttatcaatactaactaattcttcccttggaattaaaccttcatgataggactgatgtgactgttgacccttaaaagacttatgaataaggaagaagagataagggaatattagctataaacttcttactcaacatttaaagcaaactggaactgtgagagggaaccaaaccaaggccccagttgtatcaaacacatacacacaactttatgaattgaacaaaattcatagcaatatgcaatgatacagtttgctcatagctatcccacagtttctaataaggatggataagggatgaaatgaaaaacagaagttatggggttctgagtagaattctttcactgtcatgagaaaaatgacattaggaatttactgttgattaatatttaaaatatcccacaaaaccttaccttatatcaataatgatatatatgaggcctatacatttattgtataatgttgaaatggcaagattccttttggagaaattgtacattattaaaatgatgaaactgctaatgagaagagatattcatcttaggaagtttagtccttgaaagtgtctgaactttttataaattcaaaaaaggaaggagtttcaataggtcacattctgtattaagaagccttattagaaaactaacacaatttattaggcaactttattacaaaactaaaaaaaaattattaggaaattaaga

SEQ ID NO: 95069 - DNA, 1021 bp, Homo sapiens
gagcattcactgtaatttagttttaacagtgggttttcctggtgtatctaaaatatagtttaactttctttaaattatttgttttacacctagaaaataatgtatcggatgaatataaggaatttgtttttcagatgtgcacatattccctaggccacaaccaactgggagatataactagaggtgtgttaattataaaagcctcattggtgggcgggttggcatcccaccttgttccccactccactgcctcttagcctcaccatgtccccgagcccttttttatcccctggcagatcccaggtggctcacacctttcaccatggcggtcatgaaagacttcctgctctggagtctctgccctgttcccattgcagccatcctgccccgcagcatgcagctgtaaaccgccccatgctggagcccctttcccatctctgtggtcctggccttctgtttctgttccatggcagctgacaccgcccaggggagttagggtgaacgtttgtcgcattactgtcttctgatgttcctagtattttaactctttcaatgtcctgcagcctctgcttcctacgtcactgtaggcttgcaaaacctctgtttggaggaagacaggagggaccagtgagtgtttaactctcttcttattctgggtaaggtctctgtgatacagtgtgaagagaagtcctcctgcgtcttctccccgatcccctattggaacacagagacagtctccatggcatctcatccctaggcccactaggcagtttttgcaccagattaggctgtttctacactaaatgttacaacttggggattcctccaggtatcacctcaggaactggaaatgttttgcaacaaatcgggaaagggggatgagcagcaagagaggaagagaaagcaatggtaaaatattcctgatttggaaatttttattttattcttatttttggactgacccttattgcctctcggtggccacttttaccatgaatgtttttggttttggtgttgtttt

SEQ ID NO: 95070 - DNA, 1153 bp, Homo sapiens
aaggggatggtttccagttctcatggtagtgaataagtctcacgaaatctgatgattttataaggggtttcccctttctcttggctctcattctgtcttgcctgctgccatgtaagatgtgccttttgccatctgatatgattgtcaggcctcctcagccacgtggaactgtgagtccattaaacctctttttatttataaattacccattttcaggtatgtctttatcagtagtatgaaaacaggataatataattagaatatctgaatatagggccaaatctagagaaagtattctaaaggcaaattcacaaatcctttctctggtagctaaaagaaaattatctgataattgcaaatgcttgcagaacaatatttctcaagatcaaattcttcgtcaaataaatccctcttacatatcattaacaacaaaacgaaaaaataccatttttataattttaataaaacaataaaagtttaaagataaatatttttaaaacgtgtgtttccaaaatggtggcagtgatgcaagagggtacgctgagcagcacctatgacagtgtgggcaagaagggctttaaagtgaaaaagtggaatgcagtaaccctctgggctgtgatattgtgcttggtaactgtgccatctgcaagaaccacattatggatcttttttgcatagaatgtcaagctaaccaagtgtctgctacttctgaagagtataccatcttatggggcatgtgtaaccatacttttcacttccactgcatctgtcactggatcagaacaccacaggtatgtccattggacaacaaagagtgagaattccaaaagtatgggcactagaaaaagacatcttccattaagtttaactatttcgttattcattaatgattttccctcctgtcacctaattttaaattagatagaactgtgtcttttctgctttgtcttttcaatttgctgtttctacaaccatattatattctgtgtcaaataaagtccacttggattctagaaaaaggaatgtatttttagaactgccatcttaaaaatattcagtcttctaacagatgaatatgatgtgtctcttcatttatttagatcctgaattttggttgtcaatgttttatagttttcagtatacagatattata

SEQ ID NO: 95071 - DNA, 1116 bp, Homo sapiens
ggttcttgacattttgttcaaatccttgtaacaatctgtctttagctttattctctgagaaactgagcaaacctgtttccattgccttcttagaagggttcatgtatatagcactacagaagcataatgaagtttctcagctcccaaaattattgttattatactgctgtgaaaaaataaatattattcaaaacctccctctctgcttctggatttaggaaatgtaaagttgaagctctgcatctgtttcgtgaaattcaggctgacacagactgattttgaaagctgttattctgtgttcaaacaccctcatcctggtacatttttcttctgtaatttgattgttcaggggatcctaaagataataggtttcaaaatcattttgatcctaaatgtgatttggatcttttatctttattcattccatctctcttctctctctcttctgtttctgaaggaatttgaaaagaggaagatgctatgaaagaaaaaaaaaattcctaaaactgtggaatggatcacgtagacatgtaacccagcagcagtttgcttctgttgtccactgattaatcagcctatgtgcctgacactggtcttgcagtacaactggaagccaaaacaaggtggaagatgtcctgaattaagatgttttcaccacattgtattacagagacagccaataaatctactatttgatttcaatatggttttggaggcttattattgttccagtgtgaaggatgaggagagtgggagaaatggaggtgtatttatgtgtgtgtatgttttaatatgttctttttgtttgtttgtttgtttgtttgtttttcttggagacagagtcttgttctgtcacccaggctggagtgcagtagtgtgatcttggctcactgcaacctccgcttcccggggttcaaacagttctctctgcctcagcttcccgagtagccgggattacaggcacctgccgccacacccggctaatatattttttttgtatttttagtagagacggggtttcaccaagttggccaggctggtcttgaactcctgaccttgtgatccacctgcctcggcctcccaaggtgctgggattacaggcatgaggcaccgcgc

SEQ ID NO: 95072 - DNA, 1099 bp, Homo sapiens
tcctccccaggcatcaccccacactttgtggtaggtaagtcgttctcctgctgaacagatacattcaggccatcagcccgagagcccgcacttgacctgcagacttggttttcacctgtgaccagtattctttctcccgatctcagagggaaataagtggttttttctctttttcaaggctgacctaaagatcctatcccttgtgctttttttcaggctctggcttccttccagttttagactttccttgtggaatggcacttcccttcagagatcaagtagaaaagctttactgtctatgtcctggggaggctttccttgttgcttctcacttagaattaaatgtaaaggagtagtgttgagttatgtcatcatttcattcagcttgagggagttaagccctgttcctgtggtgaaaggagagatgggggtgcggtagtgactgaagcagtgtggtggccaccagcccccactcagtgaatttgtgctgtggccattgttgtgtcagagaactgtgggaaaaaaatcaagcaactgattttcagaatttctcttatactgaggaatgagtgaaaatttttcttcaggggaccaggcaagagagtggagatcactttctctctatatgtatgaaaaaaatccaccagtgaatgaattaaatgccacataaaataatactggagagttaaaggaaccaataatatcatgtacagggtggtttacacaaaacaaggcatatttatttgtgttttaaggaattttcaagggctattttgaatatacttgattttcttttgtggtgattttaagccctaactcccatattagatatgactcaggtttaccctcattctctcattctctttccttacttttcattcattcttgaatcctcagcaatcaggctcctgtctgtcacttagaagctatatgaccttgggaatgcttaatctctcgttgcctcaggttccttattggaaaaatgacgatatagtagtgcctgcctcctagagttattgtaaggactgcgaagtttaaatgacttagtaacgtatagcaaagtagtgcccggcacttagtaagcactcttactgagcca

SEQ ID NO: 95073 - DNA, 1078 bp, Homo sapiens
taagccattcatgaaggatctatccccatgacccaaacacctcccaccgggccccacctccaacactgggcatcacatttcaacctgagatttggaggggacaaatacccagactacataaggtagtataagtctaatctattacattctgccactgtaggtatgattagtacctaccaaatttatactgatactagcttcttcataaagattctcagaagaggtaatttaagtctttcttgcattgtttttatagtcataaaataaccttaactaataatatactttctcctttgtctaaattaaaaaacccccctgcttgaatttaagcctttccttttcatttcatcgtttgaagatactattgattttgatggcaaatcatggaatgaattttatacctatgttagtcactcgaagtgtttggtaatttagtttaccatgttttagtctaacatagaaacacaatctaatatttttgaattctctttcgttaaggcattgtgtccagatctggcaccctgacttatgaagcagttcaccaaacaacgcaagttggattggggcagtctttgtgcgttggtgagggacttttgctaaaatcattttattggagtgtggtgtcttcattggatgagtataataataattattgattttattatttgcaaaagattttgatactcttatgaaaaggatgttacgatctcaaatttaatttgcttaagtgtaaagttattctgtagttgtttcaagattcatggtccaagatttcatttctaggttgaagaactaacatcttggaacacgtggctcccgaagcaccttggtgcctgaaaacatcacttggtttgattgctctgaagaaatggttccttatattaggacttttgttatcattgccattatgttcatcagtgctttatagttactgaattctttgccattcagtgtctcattcttgagggaagcctctcaggtgcctctgagctggaaaattgtactgttagagccttattggtgagaaagtcaaggttgaggaaggttcatttcctcagaacctctctttttatcacac

SEQ ID NO: 95074 - DNA, 1023 bp, Homo sapiens
gcactttgggaggctgaggcgggtagatcacaaggtcaggagttcaagaccagcctggccaagatggtgaaaccccgtctctactaaaaatacaaaaattagccaggtgtggtggcaggcgcctgtaatcccagctactcaggaggctaaggcaggagaattgcttgaacccgggaggtggagcttgcagtgagctgagatcgtgccactgtactccagcctgggcaacagagtgagactctgtctcagaaaaagagaaaaaaggaaaaggatccagttgaagtggagagagaaaatacaatgaaaaatgaggaagagttcttccatgagaaagtttaaggatttcataagcacccttgaagttgaaatagtgaagttttaagagaagcataaagtaatgcaaggtctttttaaaactggtcagtagtttctgtaacttgaatcttttagaataaatagggaataaaagccagtatttttgaacctcagaattttggtattttaatgccagaaagtaaaccttaaaacccaactggtcccatacctttgtacggcagatgaggaaatcccaaaagtttccagtgagtatcagaagtgatactagcacccaggtcttctgactctgcagtatcctttccgccagcatgtaccatgtgataacttaagcttttttcgaagctctgatttttttttggcagtcttagtgatgtgttgagaaggtgactatcctgctcaaaggtgttgccttccttttccccgtgtttgccaagtgcgtaggcctgtttttcgaatcagagatgcatttaaagtgtagtttggaaaatgagatcctcaacagtgatgttgtggatattagcatctgttgccattgcatgtaataaccaaatctttatttcagaaatacaaaatagccttgattcagatgtaccagtgtagccatgagaaagtgatttgattttctgacatcaaatttgtttctccatagaaatgtaattgggaatattaaaaataatttaagtacag

SEQ ID NO: 95075 - DNA, 2533 bp, Homo sapiens
aggagcaaaagcaagaggcctgggggcgactggggtggggcgtctcctagagcgaggattgctgcagagtgcgcgtgcacgcccgcacatccacacccacggctacacatcatatctgcacacgcacaaaaccacacaccctcccacgccggtcccatatcctttctgcggggtgagcagcagattcccggaaagggggaaatgtagccgcaaaagcaaagccgggggcctggcgcccactctggcggcgactacagcccccacgctgggcacactgcgagctgggggtgcccggcgcgggagaagccgcgcccagccgggctggtagcccagcggggggcgcggcagggcgaggagcagcccgcgctgctcccgcccctcgggtgccagcaccgcccctgctgcggcgggtgaggggcggggcggggcgcggcgtatataaggctaggggcgggcgccgctcttttgtttcttgctgcagcaacgcgagtgggagcaccaggatctcgggctcggaacgagactgcacggtgagtgcggcgccggggcggggggcccacccagggtgtggtcggatccggtgcaccgggcgggcgcgccgcaaccgcgacaggcgcccttctcggaccggacgcaggggccggcgaccacgccctgggaccgagaagaggggtgcgggacgcgcccagatcctcggccttggggctgctcggcacgccttggcgcgagtgccacgtcgagaggcgtcggcggggagcgcggaaggggacgctggcccccaggcccaggtcaagcgccttggtttgcccactaggattgttttaagaaaatggcagacaaaccagacatgggggaaatcgccagcttcgataaggccaagctgaagaaaacggagacgcaggagaagaacaccctgccgaccaaagagagtgagtgtgcctcggtctcccgcgccccagcccagcccctcaccctgctcttccttgcaaacccactcctccaccccccaccccgccgttgtccccggtgtgggcggccccggccactctttcagtttcacaaagcgccttgtttctccccagccccaagcttccttctaaatccccacacctcgtgggtgcctcgcccacaccgggaagcacctcggttgcgggtgggggttgcagctcccctccagcgcccgcttcccgctctccacagccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggctggcgtggtctgagtcttttagttgagtatgcgtgggcagtgccactgcagcaaagcccctcgatggagtagagttcctgccgcaaaggggaggaggtgggtcgcagaatgggctgactcggagggagtttttaattttggctttacctgcttctccgtaagatttcatgacttgttagccacttaactcttgctcgtaagcaatctgtgtaaaatttaaccccactttgtccccaggttgcgttggaaaatgctttttcaaaagagcaaggtttgcttttgataagcttcgaaagccccactgtttccctctggcctcctcctagctgactcagaagggaacactgattttaaagaaagaaaagacaatctggaatgttggaaattgggtgaggtcacaaagtctccggaagcctttcttcgggagcttaaaacaaaggcgggatctagggatacagcaacgggaacgtcagaactagaagaaccaacactagaactgggggaggggaggggggaagagcttttgtcttttaaccctagttcagaacctcccacaaaaacattagccattagaggaagtgctagactgatctgctaccacccagtgctcagcaggaagggtggggatgtggtgggagggaggaagggtgggctggcgctggcgctggcggccaagctccaagggatgacacctcaaacccacagggaaggaataggaccagcccaagggggcctgacagttgggaacctggggctgcaggccattcagaagcagaagaaacaggcttataaagacaggggtggagttttctttaaggaaggtggataggacactgcttagagattcgtcccacatttttgcccggccccaagaggctgggcactgggtgaagacagttaattcgaataagatacggtccctgtccacgaggaatttaaaatctggtgagtgagatagccacagcagaccagagtcaggacacctaggcttggcagggagactcatgcccaaaggcattctctctgaactcctatctgcacctccc

SEQ ID NO: 95076 - DNA, 4869 bp, Homo sapiens
gtcgcccccgtcgcgaccgccggccgcggggcctccgggcggctgggcccggcgagggcagcgagaggcggggctggcgtgcgggcggcggaaggaggcggaggaggaggaagaggaggaggaggaggcggcggccgggagccgggggagaggggcggggggtgggccgggggaggggaggagcgggatttgcggagcgccgcgccgctgccgggagccggcaggcccgagagtgaccggagtcacggcgggcgccggcggagctgcggcgtcggacccgcctcctggaggagctcagccccgaccaggcccggccccattcccgccccgcgccgcctccccgccgccgccgccgccgccgccgcgggagcgctcccctgcccaccccgcccccgcggccgagcccgggagtcgagtgggagtcggccggccggcgcgggcagcgccgggaccccgcgggggacactgcagccggagcccgggaggggccgcgccgccaccgtctgaactaggatgtcccgacatgaaggtgagaggagcccccgcccccacccgcacctcccgggcctcggcctaccccgcccgggccgggcgcggcggagggcggccgggaagcggcggagactttggccgagcccgagccgggcccgaggcgctggacccgggagcgagcgagcgagggcggagagccgcggcgccgctgccgccacggccgcggcccttagctgggcctggtgctggaggcggggcggcccgggcggccggagggtttgcactgtcatggggcggagggggaggggaggcggcggggcccgttaccggcgggagctcggccttcgggactgataccggacgccaaggcccgcccggccggttcaggagccgcgggccccagcgcggcctagcgctcccgccgccccggaagagcccggtgtggtcgcagagccgggccgcgggcggcagcaggaggcaaaagagccggcccgggacccggcaggcgcgtccggtcgccgggagacgacggcgagtgtccccgcctgcgggcgaccgcggggctggcgggaaggctctgcggccaagggacgggaagccctcgccgcctggagcccgccccggcctcgcggctaggcctcggcgcgtccctgggctcgggtaaccaagttcccggggtggatccgaccccgccgcagcaagcaaactccctgctcagtcacccaggcggagcagggctcgctccccgcggccctggtgccctcgccggcatgtgctgcctaccagaccaggttttggaaaatgacgatggtgaggtctgttcatggtcgggggtcgttttggaccttgttttgccattttaaaacacgattggagtacagttgcaaataagcagacagctctaagcccagtcccagggcacaaagagacaaatgtttagggtcgatgtataggctttgagctggtaagaaataagttaactttaatttattgccatatggtttagaaaaggaggagggggttgtgttttctttgtttcactactacaggtttttggataaaaagtgttaagagtcttggcgaaaagtttgtcctgctaaggttaatacaagattgtagaagtggcttgaaagtttgtgtactccggattttaaaatcctgtataggtgatgtaggagtggagaaagtttagtgagtcagtttagtgtgtgcttagcactatgggaaggatattctttgggaaatacggaccttagaatttcaaggctgaaaaactcagattgattaaaattgtatttagaacaagtttcaaaattcgcattactaattgcgacgttgaaattgactcaacattctgtgttcaacgattctgtattttaaaagttacaaaactaatatgaaatatactatattttcttcgcaaagcatttgttgagtacttacagtgttcaagtgttgggcattttgaaataatgaggtacctagcctcattgaaagggacacagaagtaggaagctatgcctcttttccccacttcgtctgcttaatcgaaatgtatccttatctctgtaattttaagaactcgtaattaaagttataatcagttttcaatttgggatattaaagtttatcttaaactgtagtcctgtgtacattgaccaccttcaagacaaaacaaaagtgagcaatggctgcaagctctcttactcttgaaaactgggagggttagttagagaatcacagccatggaagagtgtttcagacccattctccttggtctaagaaagcatacagatagttccagacgagcattctaattgaagtgtcctgggaagaaaattccttcacccccagtgctctgttagagtaattaaaatctcatatttggaacattcttgaatgtaacatatattctgtaatttaagcccatttccccccatttggtgctgtgcaaaggtgtgtggttatgaaacttatattaccttttagttacttgaatattgctgaacctcagcacactagtagcacacctttcctagtaacttatgttaatgtcagtaaatagaacatacctaatgaaaaaggaacatacctaaatacatctgttgaagacttatagtacaatattcgacaagtgattctctttcaagggtctagtttatggcctaagacaggaatagcagtctcacgaatcacatttaactcattagatacatattttgtggaatattagttcagactgtcattattgtcatcagtaagactttgacctatcagtaaatacagtgtttggcacccttgctattagttcttttcttacctttgccttttttgggccaaagaatcccatttctttcagcatttctttctttctttctttttctttatttctttcttttttttttttttttttttttagctggagtctcactctgtcaccaggttggagtgcagtggcgtgatctcggctcactgcaacttccacctcccagattcaagcagttctcctgcctcagcctcccaagtagctgggattacaggcgcctgccaccacacccatccaatttttgtatttttagtagagatcgggtttcatcatgttggtcaggctggtcttgaactcctgacctcaggtgatccacccgccttggcctcccaaagtgctgggattacaggcgtgagccaccacgcccagcctccgtgtttctttagtggtgtaatttttgcactctcagtcatctgtccacctccaaattctctgtagttctcatttcctttcagtagtgtgatcctgaactggatataatagtctggtaaaaggtttgaacaagcctatcatgttgtacttgcttggtgcttccttttcagggccttatgtgtgcaggtaatatgttactttgtctttgtacccaccctaatgaattacactaaatcctatgattttattaatgtaactttggatgacacagtcctgagatggacacctgtcaagcttgaaggctcaaccttgtgaagcagtgcctctgagaaaggcaatgcaaccaggagcatagagagatgctctagtcccgggttcagcatgcttcttctgtaaagggctaggtggcaaacattgcaggcttggcggagctgtaatagtacgaaagcagctatagacaacctgtaattgaaagatcatggctctgttccaattaaaactttatttgtggacactgacattttaatttcatatatatatatatatatatatatatatatatattttttttttttttttttttttttttttttttgagacacagtcttgctctgttgcccaggctagggtgcagtggcgtgatcttggctcactgcaacctgcacctcccgggttcaagtgattctcctgcctcagcctcccgcgtagctgggattgcaggcgcccaccactgcgcccggctaatttttgtatttcgtttagtagagatggggtttcaccatgttggccagggtggtctcaaactcctgacctcgtgatccgccggcctcggcctcccaaagtggtgggattacaggcgtaagccaccgcacctggccgaatttcatataattttcatgtgtcatgaaatatgatttgtcatttgacacccccaccattcaaaaatacaaataaccattcttaactttcgggctatataaaagctggtggtggaccggccgtggtggctcacgctgaggcagagaattgcttgaacccaggaggtggaggttgcagtgagctgaggtcgtgccactgcactccagcctgggcgacagagtgagaatccatctccaaaaaaaaaagtggtggttggatttggcctgagggctgtagtttgccttactttacctctgccctagactggcgctttagagagttgatagagcttgaactatcaagagtctagaaggggcccagtcagcttgggattccgtcattttctttgggtgatgggaaatgagttcacagactgaaccagctcctccgtacttcacttttcagcagcaccatgaggaatggaaataattgttcctcaggagtggacaacaggctccccaccctacagacccttagtggagatggcagtaccctacatttttcctgcttgcccgttaatacttttccagtgagaattgtagggccacttttaactcactttgtggtgttcttgtcatgttaacattttatagactttagcacccactttgtgttcaccctgccaacactgtctagttcacagtgaacccaatcattttttatcttgatgtattttttaaaatgtctcactatcatactttcaaatacatttaaaatgtaagtatgttattcagagcttaaaatctacttttaaagctttc

SEQ ID NO: 95077 - DNA, 1044 bp, Homo sapiens
tttttttttttttttttttaaagacagagtctcgctctgtcgcccaggctggaatgcagtggcgtgatcttgtctcactacatcctccacctcctgtgttcgagtgattctcctgcctcagcctcccgagtagctcggattataggcacctgccactgctactggctaatttttctatttttagtggagacaggtttcaccatgttggccaggctggtctcgaactcctgaccgcaagtgatccacccacctcagcctcctaaagtgctgggattaccggtatgagccaccacgcccagcaccttcttaactctttctgggctacttttgattttgggtaaaattgtttgagatttcaagccggttgcagtgatgtgcacatgtagtcccagctagatgggaggctgagagaccctatttctttaaaaaaaaaaaaacaaaaaaaaacaaattgagatttcaagtagagtccttatctttatctgatttataatttctctagctttttgaagattttcacatgtaaaaatgatagtggataaatgagcaggtggtcatattgttatgctagtttcagaagtatctgatactatttatttttaaaatgtaaaatacaagactacgtaggccattaatctacttagtcccaactttttttgtttttatttttttaattggcaaaaattgtatatatttatcatgtataacatgatgttttgaaatatgtatacattgtagaatggcagctccaactttttgaaagttgtaccactcttttcttagtagattctaattttctctctctctctccttttttataattatttttttttactctctgttgcccaggctagagtagagtacattggtgggatcttggcttactgcaacctccatctcccaggctcaagtgatcctcccatctcagcctcccagagtgttgggattacaggtgtgagccattgctcctagccttaattttctcttctcaaaaaatgttatctgccactgaagcacacatatagacagaaataatttggtttt

SEQ ID NO: 95078 - DNA, 1035 bp, Homo sapiens
ttttagtgaaggctaagctgtcattgaattatcctagaaataatgttttttaaatcactttatgagctgggcgctgtggcttatgcctgtaatcccatgggagaccaagatgggtggatcacttaaggtcaggattttgagaccagcctggccaacatagtgaaaccccatctgtactaaaaatacaaaaaaatatctgggcgtgatggcaggcgcctgtaatcccagctactcgggaggctgaggcaggagaatctcttgaacccaggaggcggaggttgcagtgagctgagatcacccattgcactccagcctgagcaacaagagcgaaattctgtctaaaaaaaaaaaaaaaatcactttataaatatagctgtggggctactttcatgcatatggactcaaaggaagcgctccctaaactgcatattcataaaagttaaaagtagaatgctgttcctaataaaagtctttttttatagaagattaattttttaattaattttagtgttgtgctaaggaccatgatgtttttcatttccttaaaattataaggtattttttcagtctttgaagttattcattaaaattgagaaaagaacccgtaagcagtatacagatcagagcatcttaaaatttggtaatttttttttttttgagaccgagtttcactattgttgcccaggctggagtgcagtggcgcgatctcggctcaccgcaacctctgcctcccgggttcaagtgtttctcctgcttcagcctcccaagtagctgggattacaggcatgcgccaccacgcccggctaattttgtattttttttttttttgtagtagagatggtgtttctccatgttggtcaggctggtcttgaactcctgacctcaggtgatctgcccacctcagcctcccaagtgctgggattacaggcatgagccactgcgcccagccagttatttttatatgttagccatgtcttgatttatgttaaagatctgggataaggcagacagtttcctaaaggaacatattaccta

SEQ ID NO: 95079 - DNA, 1052 bp, Homo sapiens
gcaccttccaccattccctctctgctacatccctgatggccctcttggtgtttgttaaccatggtaactgcctgtagaattgtttttagttgttggctctctgagttgtagcaaagtagaattatgagttcatccaattcatatacacagtcaattagcctcatatctttttttttttttgtcttgaggccgggtctcactctgtcacccagactggagtccagtgacataaacaaggcttactgcagcctcaacctttgggcttacgtgatcctcctgccgcagcctcccaagtagctgggagtacaggcatgtgctaccacgcctgaataatttttgaaatttttgtagagatagggtctcattgtgtcatccaggctggtcttgaactcttgggctcaagcaatcctcttgcctcggcctcacaatgtgctgggattataggtgtgaagcaccacacccagcctagcctcatctcttctatggccacagtgccagccagcagtccatcaaactttgccagtggccacgggggtactggcaaagaagtatagatggatccctgtaacttaatcactgctactagaaaaaaaaaaactgagatcagaagagtgggtcagttgtattaccctcagctagaagaaatagcagaagaataagtggatgaagcatcttgatatcatgactaattaggtttgcacattatcttctgttgaattttttttttttttttgagacagagtctcactctgttgcccaggctggagcgcagtggtgcaatctcggctcactgcaagctccgcctcccgggttcatgccattctcctgcctcagcctcccaagtagctgggactacaggcacctgccaccgctcccggctaattttttgtatttttagtagagacagggtttcaccgtgttagccaggatggtctcgatctcctgacctcgtgatccacccacctcggcctcccaaagtgctgggattacaggcgtgagccaccgcgcctggccttttctgttgaattttaatgtttttttaatctcttttg

SEQ ID NO: 95080 - DNA, 1315 bp, Homo sapiens
tcttttatatttaaagaagcttagcagaggctgggtacggtggctcacacctgtaatcccagcactttgggaggctgaggtgggtggctcatctgaggtgaggagttcgagaccagcctgaccaacatgaagaaaccccgtcactactaaaaatacaaaataacctgggtgtggtggcgcatgcccataatcctagctactcgggaggctgaggcaggagaattgcttgaacccgggaggcagaggttgcggtgagccaagattgcgccattgcactccagtccagcctgggcagcaagtaaaactctgtctcaaaaagaaagaaagaaagaaagaaacttctattatttatttattttgtgaagttggggcctcactatgttgcccaggatggcctcgaactcttgggctcaatccccttgcctcagcctcccaaagtgttgggattacaagcttgagccaccatggccggccagagtatgggctactttagatagggtggtcaggaaaagcctatctgaagatggacatttaaggaaaagccatagttaaatgagagagatttaaaggaaaaaaaaatacgactgaggatacagcaagtgtagaggtcctgaaattggaatgttcttggaacagcacagaggccatgtggctggagggcaatgattggggtggaaaggggtaggaagtgaagttggcgtagttcgagccagatcttggacaccctcgcattgtaggctgtgttgaggactgttgaactgtgaatgctttgagaaacacatttcggaagccctgcttctatagaaaggtctttttgactaactaaatggcagggggtggaaagtacatactcagtttgtgtcccaaacatctctaagaacatttctttacaaactttccctacatttaccgttcttttaagctttgtctttcttgacccctgttactctattactctatttaactgatgtttcctgaagggtgtggggtttggtggaaggtgaatcttcctagtttgaatgtaaaacccttgggcctggcctggcgcggtggctcacgcctctaatcttagcactttgggaagcccaggcaggcggctcacgaggtcaggagtttgagaccagcctggccaacatggtgaaaccccgtctctactaaaaatacaaaaattagctgggtgtggcagtaagtgcctgtaatcccagctactggggagactgaggcaggagaatagcttgaaaccagaaggcggaggttgcagtgagccgagattgtgtcactgcactccagcctgggtgacagagccagactccat

SEQ ID NO: 95081 - DNA, 1032 bp, Homo sapiens
gggacagggacttatttgtttagacttgggttcaatgctagtagtctgttttctcatctgtaaaaggaggacactaatgcctgtttagctactctctaaggcctttgtcaagatgaaatggcggtgcatgttaggttttctaaattagataaagcactgcataaatgtaaggtgatggtattttttatcacggtagataagataagaaatgaaggtgggagcaaggtagataagtgaaggattttgattgtcatgtgaaggtcagtcttgttcttttcccatacagattgtgggacagaggaaggagtagtgcattaaaagttttaagcagagaaagggaacaatgaaaattggtatcactgaagcagattgttatggtagtatgtgagagattggtgcctgtgcctgtagcagggagacctgtagacctttttgctggaatgagcttgagcttgaaataaaaaggatctgaattagtcaatcgtcacaggaacagaaagaaaaaagatgccttaagataaaggcttattgttgagagagcaaggaataaagtataaattgcaggacagccagccagagtgctggaagaattgcaggttcttgtagtaaattgggcatctaggaggggagagacaggaaaaagaatcattttcagcttttgatgttttgaatttaaggtgatggtaggccactaggtagaaatcagaagtgggaaatactactctggggttcaggagagagaaattggggctagatttaagaatttcatagccttctttactgaagcctggggataggctagatttctaaggatgaaagcatagagaagggagaagtatgttcatatttagaagcaagagcagaggagtcagggtcagcccaatcagagagctaagaggaggaccctgcttgtgtattgacttggaagacatcttttatagtataatagcacttgtcatgtgagtgttgacttacttgtctgtctgctttaaaaatgtaggcttctgccgggcacagtggctcacacctgta

SEQ ID NO: 95082 - DNA, 1030 bp, Homo sapiens
aatgaattagtttattttagtccatttctctccaatataatcaagaggaagatagaataatagaccttttggtccagaaggaaatcagccgcaacagcctcctccccagccccctttcataatacctccaactgtggtctagaagaaagattgaaccatactacttgagatcatattacaagttaatgacaaagtcaggactagaatctagatcccatgactcatatttcaacccattttctactatgtatgctgctggtatgagagacccaaaactgcaggctcagagagaatttattagttcatcagtaccctgaggccacacttctgcaatggatgaaattttcctgtttactcttaagtttttcctgagataatgagtagtgaagttaggaatggaactttggagccagactgtctgagttcaaaccccagcctggtcacttactgtgaccttgggtaagttgtttatctctctgcatcattttatgaaataggcttaatgtttagtaacctcagagaatggttgttattagatggttttatatataaaatgtttggagtagtgcctggcatatggtaagcaatcatcattttagctctttttctttttttgagatggaatctcactctgtcgcccaggctggagtacagtggcgcgatctcggctcactgcaacatctgcctgccgggttcaagtgattctcctgcctcagcctcccaagtagctgggactacagacgcacgccaccacacccagctaatttttgtatttttagtagagatggggtttcgccatgttggccaggctggtctcaaactcctgacctcaggtgagccaccgcgcctggcccgttttggctcttagtaaccatcttcattttcttcttggatacagaaaaatagctgtctaccatccttataaatactttgcatacagttttaacgattttatttatatgtggtttttttttgttttttgtttttttcttgagacggagtctagctctgtcgcccaggctggagtgca

SEQ ID NO: 95083 - DNA, 1058 bp, Homo sapiens
gttcttttctttgagaatggaatttttatgtatgtgtgtgaaatgtgtcataacatttagaagagtgtacaaaagtatgtatctagtaaaaagagaataaaaccaacgtccacacatccactactcatattaagaaatagaacatctcggccaggcgcggtgctcatgcctgtaatcccagcacttacggaggccaaggcaggtggatcatctgaggtcgggagtttgagaccaggctgaccaacatggagaaaccccatctccactaaaaatacaaaattagccaggcacatgcctgtaatcccagccactcaggaaggctgaggcaggagaatcgcttggacccgggagccagaggttgcagtgagtcgagatcgcaccactgcactccagcctgggcaacaagagcaaaactcagtctcaaaaaaaaaaaaaaaaaaaaagaaatagaacatctcatccacatgtccatatccactaactggatctttgttttgataatcctcttccctttctctgcaggtttactcccagtatatccatttctatctgagccacatattgtttagttatgaaacatggaatagcaagcccaggtctcaccatgtgaggaaagagcagtttgcactattaggtggaagcccttagaagagaagctgaacagagtctgccttcggcttccccgagtttccaagagtctggagaaatcattgggcaaggtcacaaatgcaccttggaaactcaggacccaacatatatggagcgtttagcagggttattgtatggaccagcttggatttccagcacaggggtagtcagaggactgcccttcacttggcccacctccagctcccaggaacaggtcagagggggacactctcatggggtgaaatgagatcagctgaacctttttccttaaggcgagatcaggaacttcgacatcacttgggcaggaccagccaagtccagataagatacggggactgggccccaggtaccactgtgtcctcaggttacaaagaaaatgtatgatattgtgtgattttatgtatgtatgt

SEQ ID NO: 95084 - DNA, 1033 bp, Homo sapiens
gatgcattgttaatgaatattaaagccagtgtttaaaaacttttaaattttgtataattatactgtatttgtataccttggtttgagattcacatcaaactgtataagcactatccattttcctcattttatgtttatgcttagtcccttccttctttcttttccgtattaccgtatatcactctcagtgatacaaagacatcctttctcagagaaagtctcccaaagatcagttcatcctaaccaactgtttactgtacctttcagcttgcatgtcttatcacttcaaaccaaacatgtctaaaatcagactcacatgcctcctaaaccagacataaaccacaactcttttccgccagtgctagagtattctctatactttgtattaattattcctactcctatacagagctttatgtttgttgtaggtccctttattttaaaatccgtgaagaaactggagcagacataaagaaatgtaatttaacagttgacggtaggattttggaggacttgctaacattttaaattggttagcctacaaaacaggggaaagtgacttagttcatgtttgtggtgagtttttgagactggatttaggataactgctctatatgtggagaacattagaacaaagggacctgaagttatatttcagtgtcttagcgaggatttcaggaactgcttggtatgaagagttgtgtcagggtgagtctgttgtacttccccagctagaacaagtcatctttcatcattttcatatgtttggctttgtttctgtaggtctctatcccttagtcttcatactgttttaaatgcttatttacttatccttattccccatttaggctctaagcactaagtgggtactgcaagtgctcaaaaattttggttgctagaaatagtagtgttaagtcaatgagaaatggtcttaaaatatagacccagggcagatcttttcccacctcagtacaatgagctgtcatgtgccttacttgactgggaatctatcacaaatacatgtgcagacatt

SEQ ID NO: 95085 - DNA, 1123 bp, Homo sapiens
ttttttgagacaaagcctcactctgttgtgaggctggagtgcagtggcgcgatctcagctcactgcaaccctacctcctgggtttaagcaattctcatgcctcagcctcccaagtagttgggattacaggtgccagccaccacgcccagctaatttttgcatttttagtagagacggggtttcaacatgttgaccaggctggtcttggactactgacctcaagtgatccacccgcctcgacccccgcaaagtgctcagattacaggcgtgagccactgcacccagcctgtatcagtcattttaaattattttcatgtggagtataaatcagagtaatgaatccagcacatggctaaaacttcccgtatcattttactaagtcatttctagtcattttggaaaggacatatgaggttaaatgagcacctgaaacattcataaaaatgaaatcaagagtggcctttacaactggtaactaaagatatttcttttttttataggtgtcagctgtgatgcatgtttaaaaggaaattttcgaggtcgcagatataagtgtttaatttgctacgattacgatctttgtgcatcttgttatgaaagtggtgcaacaacaacaaggcatacaactgaccacccaatgcagtgcatattaacaagggtagattttggtaagtaattaaaaatttaatgaattacatcatttagaattttatgtacgttgaagaagtaaaggcaaagtgttctaaaactccccagcagcataccataagccccaaattcattaaacatgaaataaatcttacttttttttgagacggagtttcgctcttgttgcccaggctggagtgcaatggcgcgatcttggctcactgcaacctccacctccctggttcaagcaattcccctgcctcagccacccgagtagctgggattacaggtgcacaccaccacgcctggctaatttttttgtatttttagtagagacagggtttcaccacgttggccagactggtctcgaactcctgacctcagtcaatctgcccgactcagccgcccaaagtgctgggattataggcgtgagccactgtgcctggctttttttttttttttttttttttttttg

SEQ ID NO: 95086 - DNA, 1026 bp, Homo sapiens
ggatattacaaatgtaaacaggtacctaagcactccttgatcacgtgacgttgttgaatattttaggcacactttcttttggagtgcagtggcatgatctcggctcactgcaacctctgccttccaagttcaagcgattctcctggctcagcctccggagcagctgagattacaggcatctgccaccatgcctggctaatttttgtatttttagtagacacgaggttttaccatgttcaccaggctggtctcaaactcctgacctcaagtgatccacccaccttgtcctcccaacgtgctgggattgcaggcatgaaccactgctcctggcccacactttcttttttacattattgtatcgtacgattacatttttatatgtttaaaaactaatattcctcaatgcaattctaccttatttttcagatttatactatggtggggaagctttctctgtagagcagccacagtcttttacttgtccctattgtggaaaaatgggctatacggagacatctcttcaagaacatgttacttctgaacatgcagaaacatcaacagaagtggtaagtgaagcagcaaccttatgactaaaatgatgttgtaaagtatattatttctaacattaataaagctaggtcactgtcatctgcttcctgctcagtgtaatgataccgtttgcatagttattaaaatcatcttttaacagcaaattttatacatcatgggaggctgcatttttgcaaaataatacctcttactgtccacactgggtttcttaacctgtagctaaacccacagcatggagtcttgaccaaattcaggagccctttattcaatgcattgtgaaaggttaaaaggatggcaacctgcagtgcatctcttgttatagtatccttgctatctgcttaacttttcttctacaaggaacttcacaaggaaatttaaaaacctttggtagtatcataataatccattgtcacatctcattgtagcatatcgctgatcttacctggttttcatcag

SEQ ID NO: 95087 - DNA, 1064 bp, Homo sapiens
actcctcagttttccacaaccttgcctctggttggtttgccccatgcccccccatcccgcccctgaaagtaaatactcaaaatttgttgtttacactctggcatacctgatacacagtttgaaaattaaatacccaccacctacaaatgctatcatggtctgtttcttgtgagttgtgtttatgccttcattaagtttccaggcttttggtacatagcccaaggcagttgtcactctattttcatattggtttttgtggaatattttaaggatttatctctcctcattagcccttaatctttgcatgagtactatatctacatatgttcccacccatacacctagacatttcaaagtgaaaaatggcaagcagataagaatctttaatataaaagtacaggatttcttcaggtcatgtgggtcaagtcctagaggcagggctggcattcagcaggtacagccaagtgtagcatgctgactagtgtccattctgaaggattggtgcctatgccataccagttgttaagtgttttgaatgcctctctgcatatatgtgaaacatactatcagctccagtgtgctacagttatatgtaaatgtccaggtgatattactgtgtgtcccctctcacccctcaatgttttgcattttttaattagggaattcaagagtgatttacatcattttggtttaggggattatatctacacagcaacttgctatatatctccttttctattcctcttaacatattcctttctaaatgctctgtttgctatcttgctttgccccacgttacctgcatgtgtcctctagaccagggttccccaacccctgggccacggacgggaccagactaatacccgtccatgacctgtttggaaccaagccacagagcagaaggtgagcagtgggccagcggacattaccgcctgaactccactccctgtcagatcagcaacatcattagattctcacaggagcgcaatcccttttgtgaactgccttctgatttctttggaattatttttcagtgtagctaaattatattaatactatttcaa

SEQ ID NO: 95088 - DNA, 1385 bp, Homo sapiens
ctctccttccctctgtttcaccaattctgttaactatagaaaccaccttcccaacctgtcacccgctccccgaactgtgactgtgtacacaccattttattcctactttctcccatctcttgccaagaggcccatggaaagttgttctactactccttgagcctgacctggttacaagcttctggcctaccaccccatttcttcaggaaataaggtttaaaaatgggcttccataccatattccccttggaagtcacattcataaatttatagaccacatttgcatattatcagtaatcataatttgtcttacattcaacatgtctgttgaatgtttgcacagttgcatttaatcagatctctgctgtcttatttgggaattggctctcaagtatagcttgctttggagaagtgtgccataggcttgtatctgtctttaccattcaagactggacttacacgtaaatgtgcactaaatagcacattttaaagttttttttaatggaaactattttgctagaccatacaaatgaatcaggcaggctgttagaaggccctgccagagatcaagtttggtgtgtctgaaactgttgtgtttgaccctgagggaccttgtgtgaacagttcttgcttaggtttctactgcttttcactgatttaggatctgctgtgttttctgttggttaaaacttgataatagtaaaacttacagcagaatactcgtccagaaagatgtcttattgacgttcatttattaagctgctttctttacttccatttcagatttgtccaatatgtgcagcgttacctggaggcgatcctaatcatgtcacggatgactttgcagctcatcttacacttgaacacagagcccctagagatttaatatccttttaagagatgacaaggaaaagagttgtttgtaatgtttgtcattttgattttttgttttggagacaagatctcgctgtgtcgacctggctggtctcaaactcctgagctcaagtgatcctcctgcttcagcctcttgagtagctgggactataggcacacatgtgccactgcatccagcttgtcattttgattttttttaaggatcatatcccccaaaagaggaaaagtaatgtccaaattatttttacttatttgaacttttcctaaaagtgactcagtgctgagatgcaatttatttctctttttatatactatcaccattgtatgaaccattttcattaagtgaaagttgacttgtccttcatctttagttcattacaattagattttttttaaggcagtttgaccaaattgtgtcttccaggatggcgttttcatacaaaagaggaaaatgttaatccaaattaaaatttaattagttaaatatgaag

SEQ ID NO: 95089 - DNA, 1026 bp, Homo sapiens
agtttgacttacactcagctgtgtaagacggttgaggctgctgggaatttttcttcgtgataaatgtcatgttaatctatctgtgtgtcttatacaagaaatgcaaatctgttttctgcttagcagcggcattggaaagaagcttgaagacagagtaaaactaataatccaaaaggaacctttgatgtgctgaatatacattcagtattgttcctttttcattataggtggtatttgagatttcatgagctatatagagaaacttttttacctcacacacccaatacacacacacacactcacatgttgccttacatttgagtgtctttttagggttaatagccctcatagatagagttgggacatttgcactttaagttaaatgtgctgtttttaaatgcttacaattcaggaaatctttacatctgtctagcaaggactcaggtgattttttttctttctgtgaaatactttcgtttttttcttaacttttgggttatgatgaatcgagtggtgttcgacatgtacgtagaatgtttcaccctggccggggattaggaggtcctcgtgctcgtagatcaaacatgcactttactagcagttctactggtggactttcttcttctcagagttcatattctccaagcaatagggaagccatggatcctatagctggtaagttagtttcacattaataagggaaatggcaggggaaggaggagctccttttaaaactttttgtgatgccaggtgcggtggctcacacctttaatcccagcactctgggaggctggagcgggtggatcacttgaggccaggaattcaagaccagcctggccaacatggcaaaactccatctctactaaaaataaaaaaattagccagatttggtggtgggtgcctgtaatcgcagctactctggatgctgaggcatgagaatcgcttgagcctgaaaggtggaggttccagggagccgagatcgcaccactgcagtccagcctgggtgatggagtgagaccctgtctc

SEQ ID NO: 95090 - DNA, 1033 bp, Homo sapiens
gcaacagtgagcaagaaaacaaactgttaatgagttttaatgataaagagtttttgctggcctgaaagtgtctgcaaggcagtcatcgattccctataagcgaggtggaccctccacttggaagaaggcatttcactgtaccttacttagatgaggatgcggggacaaaagtttacacctctcttaatgagtacagccttatggacacaagacagtctggatcataacaggccactaagtaggctgtacagtcagatgcagcaggttctcaggagccagtcagccttgctgagcactggtagtggtatctactgcagtggtactctgaaacagcagtaccagaaggtactagagggagaaagcagaggcagagagtgtgcaagggccaccatcagaaatgatccaggcctcttggactgaatcctaataattcattcagtcattcagtaaatgtttgaattcctgctatatcaggccctgttctgatagctgggaatatagtcaacagtagacctcatccctgcttccatggaacacatattgagagagcttatattataattgggcccacagataaaccacttcattaaatactaagagaaagcttcactaaattagtctattatgcaaataattttaaagacaatttaagttttacttcaaacataattcagtctgggttaatattcgtatgcatttgcattctctgtccacagtaactcctgccttcaggaggcattctagaaggattcagctcttaaactgtgtgctgtggtggttacctacctgttcacaatgcttttgatgttgttccagtaaaagagtgatctgtagcgttttgttttcctcagtattaagcagacattaattgtcttcatttccattggcagagcttttatctcagttatcaggagtgagacgttctgcaggaggacagcttaattcctctggcccttccgcttctcagttacaacaactgcagatgcagctgcagctagaacggcagcatgcccaggcagcacggcaacaactg

SEQ ID NO: 95091 - DNA, 1388 bp, Homo sapiens
tctttttatttacccccagatgaaattctggttagatactttcccaagcatctaatctgtaagaaatcctgttttccttagaaaattttcacctagctttctctggagtggaaaaagtctaaatgtctttttttttctcattgagtctaattaaagcatagatttgcacctccaggtaacagtattgcaacaagtgtggggaattcgtctcaacacaattaaggataaattacagccaagtattccagcaatgtctcattctgaattttgccacctgtaaaacttcacagtggagagcactgtagaaattggccatgccattgttcattgactttttaacaataaggtcttttctttttaacttacacaggttgaatgatcctaaaatgtctgaaacggagcgccagtccatggaaagcgagcgtgcagaccgcagcctgtttgtccaagagctccttctgtccactttagtgcgtgaagagagctcatcctcagatgaggatgatcggggggagatggcagattttggtgctatgggctgtgtagatattatgcctttagatgttgctttagaaaacctaaatttaaaagagagtaataaaggaaatgagcctccaccacctcctctttgatgacatcccaattcgcagacaatgtcctctgtgctgtatttgccaatgaaagtggacaacaactatcttgggtttgtttggtgattgtaatttcaggtctgtcactcttgttacattgtgtacattcaaaaggaagagagaaaatatatatgataatcatttccacttaactaatttttacttctagcaggtaaatgtaggtagcagtgcaggggtgatctctgcttcctgtaccttgacatgcaaaaggctctcctaatactccacattcaaactgaagaggaaaattgaaatctctaatgaagctgctgtgtgtatttatgaatattaatgaataaaaactgcttggatggtttaccttaactactgcatgaggttttttgcagcgtgcatgagttttagtgaccttgttatttaagaagttaaatacaaggagtaaaacttaaaaaaaaaatacaaagcccaaagctttcccaaacattattcaatggttacacgacgaagtagcttttgaataatgtctgcctgaatcacctttctttgtgtgcctcctacgcacaaagccagctctgcagtggaatctggggattatagccgggtgtggcactccgccctgtgtgactgtcctgtcgccctgttagtcatcttgcctgtgtggagctcagcctgtctctttaactcatctgtagaagacacaccagtaaagctactgttggaatctgctgcaggggcctttgtgtgccctaaaaacaaatc

SEQ ID NO: 95092 - DNA, 1527 bp, Homo sapiens
ttgttaaatatgttttattcaggtgtagatgaatttcatttattgactgttcaacagagttaacctgaattatgttgtctttgtttttaaaaatctcacattctcaatcatattttgcattatttatgtatttgctttgtagtttgctgagacagatcagtatcaggggagctttgaggatttgccttcccagatttgtcagtatattacaaccaaattcttaatgctaattttagcaccttttatttattgggttttttctggcataaaaagtaaagccttttaattgaatcatgccacctatatgcctatattattaatcctatgtgtaaaaaaaatgtacagctttttttgggtttgttttggggtttggaagggccgggttattttttatttcctgtttcagtttttgtgcatagactttcacaatagctccaaggcagggacagcgggtttgggggttgggagggcagtttttggaatgtaaatttaggacttttaaaaaggtgcgcacagcttctgataaatttataactagacttaacctaatcatgtctcgttccagttctcttttctctgagcccttttcaaagtctcctctctttctcctgtcatccttttcctttcctgtccgtgtatctccgtttcttcaacatgacaagcatacagacttgaacacccctccggtgttcttccgagaactgtgaagtccatgttcatccaaatgtaaccaaaaaagaagtcaccctacatgtctgaaaaactgttgcttctcctctgaaacttcaaactccaacgatttccaaatacaatagctttgttttctttagttctgtaatggataatgtttaaaggaaaactttacaccaggcttctggttacactagaagtcaagcccattagggattttcattttttttcatttggttgttgagaagtttcaaaaatcagttttcaagctgtggtctttcaaacacatctgcacataagtcacacatttcaataaagcattttcaagactgttgaccacttgaatttctttggtgttagtggattaacctaaccattactctgagattttatatctctaatccagtattttttttctttttatgctaaacatgggagatcctggttttgtgtgaatgcattattttggatgtgagaaataaatgccaattatatgtactttcccttttctgcacaaattctgggaaaatgtaaaagccttcattttttaacatggttttagggaacaactgtaagtccattcagagcagtttaatttagatgatcacttttaacactgcagaagacctaaggagtcataagattccatctcatgtagaatactgtatattaattattttttaccagatattttacaaatacctcacctcatcctgtatgtaatcaataatgtattattttagggtagaacgacacagaatatcaatataaaaatatattcaagcccttgaaattcttgtgtcctttttctttagtttctgaatgaaaatcttatta

SEQ ID NO: 95093 - DNA, 5790 bp, Homo sapiens
cgcggccagtatgtgcgtccgaggctttcccgcagggggcagtgccgcccgcccgcgcgccgatacggtgggagggggtgggaacctgcgcggagttctggaggttctttgggagaaagttaggggatgcggaggggtgggcgcaagacttccaggactccagggaggccgtggggagggccgccgagggtgcagtgtgaggcgcaggagggggttgggggcggtgcacgttgcagggagacgcagcccctggaagatgcgagtgtgaacgtgtgagtgtgagtgcgtgtgtatgtgtgtgtgtgcgcgcgcaccgcagctctccgggttccgcgaggcgcgcgggtgtcagcttgcagccggggctcctccctccggcccccctgcccagcccggcggtccctcctccctccctccccgctcgcccctccccggcgggccaggggctgggacgccccggcggagcaggcggcggcggtggcgagttggggagccctaggctcggcgctgccggaggggcccgagccgagccgcctgcgccccggccgggcagcgccgggcccgcttcccgcggggccacgccctgtcaaactttgttgcggcggctagcgcagcgggcccgcaagcgggcgggaggggcgccgggccgggccgggcagggcgcgggcggctaggggctccgagagcggcggccccggcccgcggccccaccatgccccagctcggcggcgggggcggcggcggcggcggcggcagcgggggaggcggcggctccagcgccggggcggccggcggaggggacgacctcggggcgaacgacgagctgatccccttccaggacgaggggggcgaggagcaggagccgagcagcgatagcgcctcggcgcagcgggacctagacgaggtcaagtcgtccctggtcaacgagtcggagaaccagagcagcagctcggactcggaggtaaggaagcaccgcggccacccccgggggatcccggccctgcgtccgctcacccgctcttgcctttgtgtctcctccgcaggcggagaggcgcccgcagcccgtccgggacactttccagaagccgcgggactatttcgccgaaggtatgtgcccgctgggacagccccccactctcgattcccgctgcgctccgctgctcagcccgggcggcccaccgtcccccttgcttgggtggacgcacccttgccctccgcctttattggcggcagcccccgtggggcgcgcgtggggggcgctggggtccccagctcccgcctcgagccccctgccgcggcgctgtcagtcccgggggcctgggcctcacctcgccttggtcttgttcgcagtgagaaggcctcaggacagcgcgttctttaaaggacccccgtaccctgggtaccccttcctgatgatcccggacctgagcagcccgtacctctccaacggacccctgtctcccggaggagcgcgcaccgtgagtgcccgtcgggcgcgccggggagggtgggaggccgcggcccgcaggatgcgcccccgggcttggccatggagtgggggatggggccttctgcgccgatcccaagcagaacttgtttgcggagttgaactactctctggcggccgagcgcgaggctgcgctggccagtgcctggatgaaagtaaagttactttaacttttcccctcttgcgggttgaggttttggagtccacctctgggatcttccttggcctccagaattcttcgcctgcaccgaaggaaacttggatttgtgcccgctttgggggggtctcgctttccttcttggaaatcggtcagctttctctggcagtggggcaaggggcctagggagctgggttggcgacgttgtcctccgactccgggttcactgggcggctgcaggctggttcctaagaaacccagttttcgtggcgggttattcacagcccccgttcccacccccagccctcgcaccggggcctcagcttttctgcggagctagctccgaattttaaactcgcgtagatgatttcgaggcgacccaaggcattcttcaagttgaggaacttggctttttcccccttttgtcgcctgcttttctcatttaaagcgagcgctgcgacactttaaacctgttaatgggcgcgtattgtgtgctgcccgctggcatttagagcggtgattaagcaaattgaccgggccccagacgacgtgcaaatgagggcggattccttcgccccctctctctggctctaaactcccgccccccgcgttgcgaggggcgcagctgggggctggcgaggcctttgtgtcccccaagccgccactccacccctaggctccctgcccaggtgctgggtccgatgacagatgttgggtgaacgcctacctactgtgtgccaggttcccgcgtgctgctgcttgggcgcgatgtgaatcgtagtagttctttgcttcccgcccagattcccattgcctgccacttcgctgtcgacggtgggtaagggggcagggagtgttagcctcttaggagcagggtcccagcaacacactttatgctaagactgccctaaaataacgacgataattaaagggtgctagagaaaggctaggtgctgaatggccattcctgctgtcattgtacagcggtcggtggagagccaagtcctccacatttggttcagcgggggcgctaccatcaccagatgggttggagggggattgacggggggcggtggaagagactctgactgagagagaggggaatggggagtgggactacacagacctcacagttttgccccgagagggagggaggtcttgcagctttggccctgctggcctggagcaccccaggaagtcctgaatgtaagtgtcagttttgcagtgaaaactggatgtgggtctatggctgttgctttttctcattaaaagaaaagaggtgcgtgccaatcaaagggggggggggatcaacgagctgctgcggtcttatttaggttttcagtgattcccaccagtgcccacacatgtagcttagttctgcaagttttgttgggattcgtgtaactttgcgtatgggggagagttaatgccgctaaagtctcaggtttccatttactattaggatatctagagagaggggtctgggaggcactagcatctgtgcatcagccctcagccaagtcctgatgcagttaaagtcaccagaaatgactatttcaccatcaaatatgactatggctccctcaaggctatttctccatgcacccatttctctttagggcattttgattcatccaggctctgctgtctgctctctctgacagtccaagtgagacagatttttgttagtgtcccctccttccttccttctatcacattatgtgttctttcgcctaagaacttccaaaggctgattcttgctgatcctggagattcctgattactaaatccaggcccgtgtgggattttggagcccctccttgaggcagccaacctttcgtctctgcatgcctctctgactgtccttgttcatctctgcagttgttccctgccctggcccaggcaccagcctcctttcaagcctcctaggacatgtactttcttggggacttagtatgtcccatcccacccccatacctacatcttgtctccctggtgacttgcccttacagaagttagttcagttcccagtgtttctgtgtctctgtgtgcctttcgctgtgttagttcacggatatactggggaagtgtcctgcccttaggtcagcacagttaaacctaatttgaccctgttcgtttgctgccagtaagtaaagcaagtgaggaaacacttaagcacttggttgtctggactatagggtggagatgatggttttctgctgaacgattctattaatataattaagataattgtcactgtaggcaaatggtaggtacagacaaagtggccctctgttggtttcccagcctggtaaaatgaatgtggatagatacgagtggggagggaggagggaggaaagtgcctgggatatatgatccgatctctctgacatcttaggtcttttttattgtttggcctctaaactgcaccactttaggctttgctgctctaaggcctagaggtagtataaaattaggtgaccccagttatctgctgctctaacacttcctctggaaataccaagccagatgcagaagtgggaattgtctggattgttttcagggtgttaatgaaccctaggaatagcaggcaggaggcttcagcagcctcacccactggcataattcctgctgagaccactgggggctggcccatcctacagtctggccatctctccccatgagccatcacccttgccctccactctggtttggctgggatgctgggaagtggctttttcctgaggctctttagagaagaggtcccctcagcatgggatgtgggccaagtctctgtgagctgcaattgcttcttgtctggaggccctgggaccctgtgaagagaggaataactgccacaaaccatttttcaaataatcacctcaaaattatacattcatttctgaaaaggcttcacggtttactaaactactttggggctgttgcctagaattttgttaggaaaatgtaagttggctgggtgcggtggcttaggcctgtaatcccagcactttgggaggccaaggcgggcggatcacctgaggtcgggagttcgagaccagcctggccaacatggtgaaaccccatctgtactaaaaatacaaaaattagccaggcgtgctggcgagcacctgcaattccagctacattggagactgaggcatgagaatctcttaaacccgggaggcagaggttgcaatgagctgagattgtgccacttcactccagtctgggcaacagagtgagactctgcctcaaaaaaaaaaaaaaaaagaaagaaagaaaatgtaagtcaacacattagaaagtgaatgccaaaaatggtttaagacaaagaagagccaaaaagaaaatgttgaatgtggttcagcaagccagctacaatgtgatagaaagtaatttgactgtgaccatgaagtgagggctgatgacattttggaaagaaacacttctaggtagtattgctgagggagtctgtggtttttgtgtccatcttataaattacagaacctctttcgttcagcacaagcacacgaaaggctttgctttattatttctcagaccatctcatctcaggcttgtgtatgaaattgtcctggtcctcaaacgcgtgctcatttttaagtcctttatatcccactgcttcccatgggcagtcttgctcatatcctgggagctcctgttctttcagacccaaaggaacccaagcagaaatctttgtatgtatatgtatgaagaagttgtctgtttttaggagttgtatgtaaaagctaaggaaaccttttcttttggaagatcagtataaacatgctgcttttggtaaaattcttttgagccatttcatctaaatataacttctgtttcatttttttttctaaatataactcagagtttaatgagggcttttcacatggaacaagcttttgagagggcctgtgttgctgaagttttcgcccttggattgctggggtgatattggtgacaaactctgtagggaaggactgggaacctgtcaatcttttttctttggttgggtggattgggcagggaatagctgacttgatttgttataagtttggaaggttatagtttggtcacattcttcattgatcacacttttagggat

SEQ ID NO: 95094 - DNA, 2018 bp, Homo sapiens
attccagcctttacagtgatgtgcagtgttactaaaataattgggaaataaaaaagagtataaatgattaactcgctggaaaatcttttaaatcttctataataggaaggccctacttacattctaatttagagacaccttttacatgccaacctagggaaatttagatttacacttttctttttttttttcttttctttctttttttagacagggtctcactctgtcgcccaggctggagtgtagtggtgtgatcttggctcactgcaacctccacctcctgggttcaagtgattctcctgcctcagcctcctgagtagctgggattacaggtgcgtgccaccacgcccagccaatttttgtatttttagtagagacagggtttcaccatgttggccaggctggtctcgaactcctgacctcgtgatccacctgtctcggcctcccaaagtgctgggattacaggcgtgagccactgcgcccagcctagatttgcactcttaaaactaattcctaactcttaaacttcttcaactgaagtctattggatacctatcatgggcaatggctaagggaccatgggaaacaagataagacccaggctttgccctaaaggatttaaaaattaagtaggaaagaagtcatggtagcactgtaataagaagttaagaggtagtaaagtctggagaagcattttcataatagaaattgagaaaaattacttcctgggtgatccaagaaggcaggtcgaagaagtaggtttaaactggtccttaaaactcagtcattctttaatccaggtaattcttgttaatttagaagaatgtaaatagtaagaggaggcatttagagtgaaaaagtggaagtcttccttcactctcatcttgaggtgggagccaggaccaggagagtgaagacatggaggaaggaaaagttcagggcgatttgggggtaatgcagcttatttcagttccatttgcctggaaggagaaggggccaggacatgggctaggggacctagaatgccatggaaggaatctgatcttatttaagaggcagcagagaaccatcagaagttaggctgggaagtgatgtgacttgtacacatggctagaaagataatggtggattggaggacgaggacctggaaggggatagagcaattagactcacaggagtcaggggtgaggtgaaaagggcttcagagtagcagagtggaaaggaaaggtgggatgggaggaaataggattcttgtctgtacctctttggggaggggaggtaccagatccagaaagtggctgatgtcacagttaattcctggtgtccaagctcaggcacctggagactgacttctgtgggtggggaggcctccccagtctctacctccccagtggtggacagatgcttactgaatattttggcgatgacagagcccacacagtctatgagaggctctcattgggaggaaccctcggtttcattggagacacgttaggtgtgaggggatgttgaggggatgattgaaactggctgatgtaagagaggtatagaagtaggagaagggatgcttagagcagggacagaagtcgttggaggaggatggaagggagcattgggtaaggtaggagaagcacttagggactcccctccccctttcttttcctccatggtggaagctggagggaaagaaagtgggaggccaggtgcagtggctcatgtctgtaatcccagctctttgggaggtcaaggcgggtggatcacctgaggtcaggagttcgagatcagcctggcaaacacagtggaaaccctgtctctactaaaaatacagaaatcagctgggcgtggtggcaggtgcctgtaatcccgggtactcaggaggctgaggtaggagaatcacttgaacccaggaggcggcacctgtatcccagctacttgggaggctgaggcaggagaattgctttaacctgggaggcagaggttgcagtgagctgagatcgcaccattgcactccaacctgg

SEQ ID NO: 95095 - DNA, 1098 bp, Homo sapiens
cagatgctgtggcttgtgcctgtaatcccagctactcaggaggctgtggcagaaggatattttgaggccagaagttcaagaccagcctgtacaacattgcaagacccaatctctaacaaaattttaaaacttgtccgggcatggtggtagctcaggagttcaaggctacagtgaactatgattgtgccactgcaccccagcttgggtgacagacagtgagaccctgtctctaagaaataaataaaaataaaaaataagaggagcttttggaattcagctattaggaagttactggtgcccatggagggaagtgttccaggcaagtggtggtgttaaaggtagagagaagagacattagctcagtgcttcccaaataggatagccaaggcgccaagctgcagactgatctcaggtgtggcccagtgcctccccctcagctggaaccccagaccagactcctgcagtttcaagcagcctcctccttctatcccggtgtaccttccatatctcagtaccaccacggggaacctcaaagactcgacaacccatttcaaaagcctggctatggaaagaagaggaaagggaggagccgcaagtttgggagaaagtgtatttgggatgctggagtgggagcctgtttgtaggagccatagggcaggcttgaagatgaatgggaaagaagatgagaggaagaggaggtgagactgagagcttcaaaagcaggtaggcttcttacttcatccgtggagggtgctgtatagtaggtgtccccccagctttaaagacgagcccaagacttgaagatgaggttgtaggggaatgcagaggtgagttggcagaaatggatagtgtgcattggaggaccagatggcttcttggtattctcaggaaaaccaagggcaagttggctagagtgggggccttggaattttgttggcagtagggagactgcaggaacttcctctccatcctctcataaagcccaaaatgttgggaaccttttagctacatgttagataatgaaatgtttgtgtattgattgaaaggaagacatggcacacctgggaaattttccctccttttattatctggagctgg

SEQ ID NO: 95096 - DNA, 1081 bp, Homo sapiens
ccaaggcgggcagattgcttgagctcacgagttcgagagcagcctgggcaatatggcgaaaccccattgctacaaaacatacacaaacttagctgggcatggtggtgggcaccagcttcttggaaggctgaggtgggaggatcacttgagcctgggcatggaggttgtagtgagccatgatcacgccactgcactccagcctgaatgacagagtgagaccctgtttccaaaaaaaaaaaaaatgtgtgtgtgtgtgtgtgtgtgtgtgtgtgtgttgtgtgtatatatataatatatatatatatatacacacacacacaacacagacacaatttgtgtgtagctaggggcagatattgagatattgaagtgataagtaactggggatggggaagtactggtcacttaagagcatatagaaaaccgtcccagattgtcttttctaatctatttttggaggaggtttttatatatcccatgttttatattatttctcccaaaccggattagatatagtgaacaataaaataaatgcagtttccaaaaccttggtgttcagaaatgaagggaaccatgaggggagtgaaggggacttgccctttgctctgtgctgtatgcactgcccagggaacagccccaggacacttctatagtttctttctgagactcacaaggtgttagcaatgctctgagctcactcaattgacagatacgtttaaggttctcaaataaatttcaaacttctaaatttttccttttcattgtgtgcataatgtacagattaggaaaatgatcttctaattgagaagtatacttcaaagtttggaaataaaatcataaaaatgttttcctaaacatagcctttttcaggagtttttgtggatatggtcaaaggcaatagctctaattatctggggtcctcaggacaggaaatgagctcacactcatgctctcaaactgtgtcacagcatttttggaaatattttcatttctattcaagaggaggaacaaggccccaagtgttcaccctaattgtagaaaataaacataaacatgaaattcacaaaagaacaactataaa

SEQ ID NO: 95097 - DNA, 1324 bp, Homo sapiens
aagcacttggcaatggctgctaagactttagtgtttttcatagcttctaacctgctaagaagtagatacttgttcccattttgctgctgtgcaaacagacttgtagaggtcaagtatctcgtacaaggttacattgatggtgattgatggcgccaagatttgaacttggttgtgagtccaaagtctaggtctcccattctacccatgtgattttacacacatgcctgatataattagctcctcctcctctccagagaagggcagctgacctttgtttcccagttcagaaatcctggtgtgagttatcagctggggttgagggtggatagatttgttccaactttacacattggacctgagaatgtactttcctgaataaacagttgtagaagcgagtgacagttgtggttgaagttgttcccccagtgcagtgccccagaggggttaatgacctttcgtgggctgtcccaggaacttcatccgaggaaaaggtgcttacctgctaacatttgacctgtttggaaattggggattgtttttcctcattgaaattggtgagggttggaagaatacgcaaacgaatgtttggtgtggaagaacgctggaggagtaaacttactatactcacaatttggattacaacatagtttggttaacccagctctggtgaaccaaatgtacaagtattatttccttatggttcatcttataaaatattttataaattggttgctttctttaagctctccacaaatgaaaaatcagtcccaaaaatctataaaagactatttcagcgttaattgaccattaaggaaatacatactaggctgcatgtggtagctcacgcctgtaatccccacactttgggaggctgaggcagacagatagcctgagctcaggagttcgagaccagcctgggtaacttggcaaaaccctgtctctacaaaaaaaaaaaaaaaaacaaaaaccaaaaaaaacattagccaggagtggtaacgtgtgcctgtaatcgcagctactcaggaagctgaggtgggaggattgcttgagcccaggctgttgaggctgcagtaagccaagattaccccactgtactccagcctgggtgacagagtaagaccctgtctcaaaaaaaaaattttttttgaacaataaagaaatacatactaaacatttacacagttattttgggaattgcagaggggatatttgtcttctttcccatccccctttctctctctctctctgtgtgtgtgtgtgtgtgtgtgtgtgtgtgtatgtgtgtgtgtgtgtatgtatgtttaagatggttagaaatcatgaa

SEQ ID NO: 95098 - DNA, 1225 bp, Homo sapiens
cattcccttgtctatcagttataatatttttaaaaagagaaactacccctcaccaactctttagttacctcagatcagaggtcagcaaactagagtctacaggctgagaccagtttgccacttactttgataaataaagttttattagaacacagctatattcatgcatttgcatattgtttagggcagctttggggcactacaaggtgcccagttaattagctgtgattgaagccatatgtggcccaccgagctggaaagattttctgtcaggccctttgcagtaaaaatttgctgacccttgttttagatcatatggggaaagcaatttaaatgcctcattctttccctttatataccagtttcctcctggtttcatggcaccctgtaaaggtgaccaatgaagcttaaaatattatgaaatagatttaaacctacttaatgtctttcaatccatttgcaattattatccttattgatacccaaactgtcccatctttagccagggggagcctcttcaggctggcttctgagtccttgtgacacaatcctggtggtcttggatgcttctctgcttactggtctggcaggatactccagcacaccttgtacatttcttgtcccaggccaggagctggccatttctagaagaagctctgtcttcttttagtggagaatgttacttacagaccactgtctgaaccctagggttgcatatatagctactaaaggttattgtgtttaatgttatgagtgcactaagcagttctgtagcgactagaggtagaatataatatgcctattgtaattttaaaacaataagcatttatttgctctaaaaggatataccattctctctctctctttttttttttttttgagacagagtctcactctgtcaccgaggctggagtgcaggggcgcgatcttggctcactgcaaccccagcctcccaagttcaagcaattctcctgcctcagcctcccaagtagctgagattacaggcacgtgccaccatgcccggctaattttcgtagttttagtagagacagggtttcaccatgttggccaggctggtcttaaactctagacctcgggttatctgcccatctcggcctcccaaagtgctgggattacaggtgtgagccaccacgtccagcctagtctctttttttaaatgtactcttaatattggtgattctgttcatcaatccccctacttaat

SEQ ID NO: 95099 - DNA, 1753 bp, Homo sapiens
gtgcctggcacacacagcaagggttttgttaagataaactcattatctgttttagtggtcctgggtttcatgatcttgctagcctttataaatttttttttttttttttttgagatggagtcttgctctgtcacccaggctggagtacagtggcacgatcttggctcattgcaagctccgcctcccgggttcacgccattctcctgcctcagcctcccaagtagctgggactataggtgcccaccaccacgcccggctaattttttgtatttttagtaaagatgggatttcaccgtgttagccaggttggtctcgatctcctgaccttgtgatccacccacctcggcctcccaaagtcctgggattacaggcgtgagccactgcacccggctagcctctataaaatttaatctctacactgcactattcctaggacactaacttatgtttaattttggattgctagttttctagaatacatattcttaagtatgttggctgtcatatttctcttttgatgatcattgtcgctaacaccattctttgcacacaaagtctgccttctttctgcatatgtgtgaatatctgttactgttgatttacatttccctcttttttatgcacagtatgtaataaaataaacagcaaaagctgtcttcctcttagacattttaggttaacaagggaaatcattgttcacttcgggtatctttccatgtgtaatttttgataagttgattactggtggttgttcatttttattttgctttttatggaagttttctcaattcgtcccagaattgaggctgtacatcctttaaaaataaataaagccgaggtctgtgctagagttagaacattgaatctggctcgctggtttgtgctatggactttccttcatctgtgttactgggagtatgtgagcagttgtagaggccatatcgttttataggcctgtgccaaggaaaatacttgagaattacattagcaactccaaggtattttggctgctctgagaggacacatgatagttttccagttatatgaacaagagcttttgttttatactgaagtttcttataggctatgagaacaatagtgcctctttaagtacttcccagagtaacatccttgggatgttattaggtagaacgtgctgggcttcatttctgcaggacttctcaggcctttaacatgccagtgaatctcacagaagggagtgtattatgcaggattccttgggtttgtttgaccaaggctttccttgtgtttggaatactacccctccacctactccccgtcaccccatgcgtaagtctcacctcatacttccctgcctcccagccttagatgtggtttccctgctgtaagttctcagctctctgtacttgagcacatttcactgtcggtaaatatgtggcctaataatgatctgatcctctggatcttaaactcactgaagaaggcaggcagtggatttgttttgttccttccctcctgtgttctcagcaccagatataaggaaggccgtcaaacaagtatttgccgtccaagtgagtgaggcacccatagaactttttttttttttgagacagttttgttctgttgcttaggccagagtgcggtagcacaatttcagctcactgcaacctctgcctcccgggttcaagcaactctcctgcctcagccttctgagtagctgggactacaggtgcgtgccaccatgcctggctaatttttgtatttttagtaa

SEQ ID NO: 95100 - DNA, 2291 bp, Homo sapiens
tggggcagggactggcttggaaaccagattcacccagcccctgccatgtggcaccacctcccccagggccatgctgacagcttgtgtaagcctgagggacaaggcagtgaagatgctgaactggggacccatggggttccttccaatagttgcattctgaaactccagtttggaaatggttaataatgcctgaaccttgtccctaagaggccctgagctattgaacccatggggttttcgggtctgcagccattgcttaggaggcctctgggtgaagagcaagaatgatggtggccaatctacctgcaaggaccaggggagctgggtaggggcaggatggaggggccctgactggctctcctgccttcccctcccctcctctccctccttccctccttaagggaggtctcggggttaatgcgaggtgaggggcagttagtggtaattgttcatcatttgtgcagatgggggcatggcttttagaggtgccttctgggatggagagagcctgggaactcagaatgctacatggcggacagaggaaagcaggcatttccagggaaggaggaaggactggagttgctcctgggaaggtcagctttacagactcctggccatagtggtgtaaggtgctagctgagtgggcagaaggcggggcaggggctaggagagctgacagcaagtgtggtgcatggccctcaacgtccaccccagtctagtccaggactcctgctctggcttctgcagccaaacccaaacggactggtaaatgacttcatttaacttcccgtgcccaccagcatggcactttagaacataggagacccagtcccctctgggagtcctctctctcccctctccttttgggtctggtgtccaggagaccatgcacatgactccgtgtgaagctgaagccagtccagaactccgaggcccaaacccctgcaggctgtcttagtgcttattcaatgtattttgtcttggggtgatatgagcctgtttaaaaataatgtctgcccaaactcttgcctgagagaggttgggggcagaaagaaagctcacatttgagtcctaagaaaagtcattgtgtctctattgccaaaatcatgatagctcaggtcaggttagtttcggaggtgtgataaagtttttatctcttttggaaaaaaactcccgggattttctatcgtggacatatctttcatctacatgtccagctttaagaaaatgtgattatgcctctctgtaagtggataattgagcagaacagcatgctaatttctctctgtcaggccttggttgaaggccggccctttggaggtggtccaggccctgtggccacagctcacctactgaagggcctcctggtactgccacaagctgggacccagccacactttctgtttgtcctcggaaggtttgctccaccctaaggtagatctctgttactgaagaatgtgtctttaaatctacctgcatttccatgtctggttacaaattgtcttaaccccaggcaagttgctgtctcagagttggctgcgaggatgttgaagcataacccggctttgtggtagaggagggctttgtagcaccgtggacagtgcggttcagccttcgatcaataaatagaagcaggctccagcttcaggaaaaggggagtcttggaccgagagagattggcgtttgagacaggaaacacttcctggtgttcctgcagtgtctgcggcttcttcccagccttttaggcctttcctagggtttacagaccacccctcgagcctgtgttctcctcctgatggtgcccaggcgcccggggctccctgggcagaccattcacttcgggaacctggtctcctgctcagcctgcagcttctgtaggtttagctgtctgttggttgctctgggctactcagggaccagttgtgcaggcactgtcctcttttggcctttcttccggccttaccaagttgtggtggttgtctgcatgcccagtgaaaccttctgcagaaaggaccaggaagggcacacattggctgcctgcacttgggaagatctgagggaatgtgaaaggaaacaggttggcagttcctggtgccttccagaccagtgcctgccctctcctttgcttgtggtactggccctttgacctactggagatgggagaagccccagagaaattcaagatcgccttcaggcttccttgacccaaggcctgtgggaaggcttgcgccctgggatgcttagggtgaagtgtaacatctggccttctccaagtccctctcacagcaggc

SEQ ID NO: 95101 - DNA, 1065 bp, Homo sapiens
caccacaatcagatacagagctgttttatggaacttattttaaaacttgatcgggaggcaaatggcagtgagtttgcatcagttctgttaaattgtcctttagcctcaggtcacagtggtggttgtaacatctgcctcctgagtcacctgtctggtcagccttggggctggaggtagagatttgactgtagggctgagccccagagtatttggagtccagtgctaggtgggctattatttacagggctcagcctggatctggagcactgcagcaggagtcttgggtgccagtggcctcttgcttcacaggcacaagcactctggggctagaccttgggagcagagtatgtttctctgggctggagagcaggaataatgtgagtgaggggcagggcacaagggcaccagctgagtcctcaggggttcagagaagagctccaggcctcataggcaatgaggggacaggtcaggaataaatagagatgccctgactagacctgggtggcgtggtaagggttgtagggtaaggtcttagcctggtgggcatgggggtacccaggagccctgccctatccttcccatgcacactggaactgactgtgctgagtacagtcagatcggacatcactgctgggcatggcttcctacagcctataatgtgagatccgattaccacagtagatgggaaggcatttgatacaaatcccagagcacactcaaaaactaaggtggtggttttgtcccaaagctggtcatgggttgattgtctctttagcacctctcagttgaccaggacatctgattaagtggaaagctacattctccaaccacaaaagataataatgttcatactgtgtctgggttttatggttttagatatctggcaatgctggtgcgtgtatttttttcttttttcagacggagtcttgctctgtcgcccaggctggagtgcactgacgtgatctcggctcactgcaagctctgcctcctgggttcacgccattctcccgcctcagcctcccgagtagctgggactacaggcgccggccaccacacccggctaat

SEQ ID NO: 95102 - DNA, 2081 bp, Homo sapiens
gaatatcattcagctttttaaaagaaggagccaggcatggtggttcatgcctgtattccccagcactttgggaggttgaggcaggaagatcacttgagcccagaagttcgagaccagcctggccaacacagtgagaccccgtgtctaagaaaaatacaaaaataagctgagcatggtggcacatgcccgtagtttcggctactcgggagactgaggtgggaggatcgcttgagcccaggaggtcgaggctgcagtgagccaagatcccaccactgtactccagcttgggcaacagaacaagaccctatttcaaaaaaataaacaaggagaaggaaatcctgccgtttgtgacaacaaatggatggacctggaggacatcatgctaagtgaaataagctagtcacaggacaaatattgtatgattctgcctgtatgtgggatcgaaaatagtcaaacttaaagaacgctggttgccagggaatgggggaagagggaaatgtgttgttcggtgggtgtaaagttacagatatgagatgagtaagctctgcagctccgctgtacaacatagtgcccatggtttagagttgggcacttacaactttattaagagggtcaatctcatgttaagtgttcttaccaaacacacacacacacacacacacacacacacaaagggacacaaggaagcttttggaggtgatgatgtgtttattaccctgaccatggtgatggtattatggatgtatgcacgtgttcaaactcatgaaattatctatattaaatatgtgcagttttttggtatatcaatcatacctcaacaaaattgtaaaaaacaaaaaaagagtaagtgtgggaacagtgaagatggagaaggaggggtaggggtggtttaaccaggcaggccctacactgtccctgagggggacacctcaggtggtgtgggggtgtcggggagtcatggagctgggtgctgccgagtctgagcaccatccacccaccgcctggtagagctgcgtggactgaacctgggacaggctatcagaggagggccacaggtccatctgtaaatacgactttttttttttttgagacagagcctcactctgtcacccaggctggagtgcagtggtgcaatcttggctcactgcaacctccgcctcccggaatcaagtgattctcatgcctcagccttctgcgtagctgggactacaggcacccgctaccacacccggctaatttttgtattttagtagagatggagtttcaccatattggccaggctggtctcaaactcctgacctcatgtgatccacccacctcggcctcccaaagtgctgggattacaggtgtgaaacaccgcacccagtctaaatatgatttttgaaactaaacttgtggcaggaggacagggttgctgcaatcccaggacagaataaatctgagaacctcctgcctctatttcctccattcaacttcccttgcccattagtgtcagtttcatcttccaaaaaacaccatcatttcataacttcatttctaggaaagccacaattgctccttttcacttcacacaccaagtctaaacttccctgtgtaactctcaaggctttccccatctgacctcactcggtcaggtcagccttccttctcatcagtccttcattcagcagtctctgaaccttccccactgaacacacctagtgcgcttctacctccttccagactctaccccctagcatgctggcctaacaacattggctttgatgacctgaactccagattcgcctgctgtccacagtttctttctttctttttttttttttaatgagatggagtttcgctctgttgcccaggctggagtacagtggtgcagtcatagctcactgcaacctcgaactcctgggctcaagtgatcctcccacctcagcctcccaaagtgcacattttctcatatgtacctcacaatcaaacacaattgcctttttataggatgtattatcttataacttctacctgtcatttatctatgtgtgattggtgaacaagacaaagcatattgtgttgttccctaattgtttcag

SEQ ID NO: 95103 - DNA, 1055 bp, Homo sapiens
acagtgtcagcacaccggaggtgcccaagaaacgtttctaaaagaacgaataaatgagtggcagcagtattttaaaagatcgaaatttcccgcctttgcccacacacaccttatttcctgagaaaagttaaacttgccaaataaatattcctttcaaaaggaaaatgaagataacaagcttgtcttctccccatcttttcctgctctgtctgagcagaggggcctcaccgggtgactgattgaaactattcattctgagcattggcacaagcacagacctgcccttgcacagttgagctgcaggggtgtggaggagcaggggagtgggtacggagggggtggggggctccaaacagcaggtaggtgttggcccacagcctgacagggagcactggagacaggcaggaggcagaaaaacagaaacagcaccatggggggatatatagaagcactctgcggggaggaggggcgcatgattttgattacagcacagggtacctattgattgaattattaataaagattaaattgaatcacacatatcctatatatgaaggcaggggaatcgcaaatacatttatgccagtttttgtttttcaagagacagggatatcgaagtctcctaaactcaaggggtcctctggcctcagcctcctgagcagttggaactataggcacatactacggtgcctggtttaagccagtttttaaacaacagctttactgagatttgcattccatagaattcattctttttttttctgagacggagtctgtctctgttgcctaggctggagtgcaatggcgcgatctcggctcactgcaacctctgcctcttgggtttaagcgattctcctgcctcggcctcctgagtagctaggattacagacccgcaccaccacgcctggctaatttttgtatttttagtagagacaaggtttcaccatgttggtcaggctggtctcgaactcctgaccttgtgatccgcccgcctcagcctcacaaagtgctgggattacatgcgtgagccaccgcgcccggccagaattcattct

SEQ ID NO: 95104 - DNA, 2751 bp, Homo sapiens
attcacaggattgtgcaaccatcaccactatctaaatttagaatattttcatcactgcattagcagtcactttgttctcctctcccccaacctttggcagccaccggccttctttttctatgttctggacctgtcatataaagggaatcgtacagtgtgtggtctttgtgattggtgtctttcacttagcctggtgttttcaaggttcctctgtgtcatggtgtgtatcagcacttcctccgtttttgttgccaaatactgtactgcattatatggatatactacattttgtatatccattcatcatttgggttcgttctacttcatggctaccactgagtcatttggaaatgtgatgcaaggctcaaggctaatggggtttcctcgcttccaaaaaagaggtgatgttgcccacctggcaggtgggtatgaggctcagcaatggtacatgcatctcatttaactggtcactgtcaactccaaaaatgggccttcccccatttctgtggctgttctgtgctggtgtgcagtgtgtaagatggtcagtgttcctgtgttttgactggtgagtcaagtctgaactcactagcctagcacctgagagcctcctcatgggatagcatccccctgactccgcctgacaaccatcatttctcttcagttttcactcctgcccaactggtttcttcgcagtctatgcccagggcctccagctttctcacacttgggccctgctggggcatccagcctctgctcctacatccttgggtcactgcaggtccctgcccgaccctacctttcttcctccggacctcatattagaccagctcctcaggcctttttggacatgaccgtctcaaagtgttactatgtttaagtgtgtggttttttgtttatgtgtgtggttttgtgtctttgatatcgttgatttgccttatggcctcaaccaaaccctcactgtaacatggcacaggcagcgccatgtgacatccttgtccctggcccgcccggcgcagctcacagtgggctctctgtgaatgctggctggctgagtgtctgggagttgtgagccctttgccatgtaactggagagggtggaagtgtgaatggagacacctgctcagttgtacaatgctctttggacaggggatcaggtttaaatcagtttgaagcctgctttaccaccccctgcccccacaattgttatttcctgaaagcatatggttggctgagctagctgaaaaattacccgaattttgataaaaatttgaaccatggatttcctttctgaccatgcctagctgtgtaaattccacaggatagtaacaggtgcctggccaccatccagcaagacccctgataacgtccatgcagtggggagccacgggggcaagtgcttcccctccctcctggtcataggcttgagcatgggtagccaggatggggggtgggtgcaacttgagataagcaaatcgacaacaatgaggtacaccctgttctttgtcctcttgtcaacttgtgatttcccgatggatcaggtaatccccagtagcagataactcagttgaattttttcactgtcgctgttatctgtattcattgtctgcctaaatagtagtgaacagagaaaaaaagaacattaaaataggaagctgggaatgacaggaagagggactgtaggcctggtaaacaaaagttggctgtaacatgagccaggatatggaagcgtgaccaatactttggactctctcaatgctggccctctgcggttcatggctctcctccctttctcgctgtcaccagccacgtttaggtcagtctttgtttttggctgttgttcctgaagacgcatttatcaggtggatctcttaaaatcagggttagggattggaagtctagctgggacaattcctgtgaagacagacttccttctgatgaaatatttactagcttttgtaggaagccatctcctcctctttgctgtgataagaggtactccccacctttctgtctcatggcaagggtggaaactgatgatatttgtagggcatactggggtgagccaacaggctggaggcagccaaccctgggcatgcaaagaagcaccgtttggaagctctggtgtagctctcgtgcagcagcagtccaggccctgggacatctgagtttgaggcttcagtcctccgctgactgaccatatgtttacactgcagcctgttgtggtatgaaatgagatctggaagcacctgagctccccagtgtctgcaggtagatgattatttaataccctcttcccatacatcttcatggtcaggagactggaccttggcaattctgttattagacagctccactcgtagggaatttctcccttatatttagctgttgttttctcctccattccactgtctggagtccccatggcaagttcgcatcctctttcatgtccctggctccaaaggctttggtgtctccaggtaagtagttctcacatgggctatgacccctcatccttcattatcctagaaaaataatgcttttctgaaaattgtatattccatgggaaaatcagtagattttggaagcctgacatcttagtccgttctggctgctataacaaagtgctggccaggcacagtggttcacgcctgtaatcccaggacttcaggaggctgaagcaggtggatcagttgaagtcaggagttcaggaccagcctggccaacatggtgaaaccttgtctctactaaaaa

SEQ ID NO: 95105 - DNA, 2043 bp, Homo sapiens
gctgcacaccattctgtggaacggatatagagtcatttgttaaccagtgatactgacagagagcaagcagatcagtgaagacaggagcagggcccccgagccctgagaaaaagcagggaccttgccaggtgaggaaaaaaatggtatgaggtagggctacactacgctcccagagacgtctccatggacagtgagctctttagaggggaaaggagtaagcttttgaaccatttgaattatttagaagaaaaaaacacagtgcctttcttacacacttttcagaatttcctgtgttttcacctgccattagctggttactgtttgggcttcctttcatggtggtaaacacagtttgttttgtttagccatttccttccccctcaaataccaacacagatcaattcagtctttgcctgagtcatacatggttcatgtgtctctttccttccatctatctccccttaattcacactatttactgaactcctcctgtgcacccaagtctccagaaggagctggagaaggagcagggtggcaggggtgggaaggggacagctgtgtggaaggcagcggggctggaatcctggcatctaggccctttcacgctcccactcagagggctctctcttcaggccagaaatgctgatatttaatgagcacttactagatggttatttgtccattttatagacagggaaattgaggcctgccagtgttaattgacctttctacggcctagaatctgaagttggtgcagcctcactgaagccctggctcagccatggttgccacccatcctgtctgagctttgagaaccacagagacaagacaggcggcagggctgtgattttagacactcttgtcttaggtgtctcaaggtgggggtcactttggagcctcagccaaccccactgtgattggatctcctgcctacagcctgtttcaaagggaagtggagtttagggagacagtcaagaggatggatggaagaaaggggctggttaacctgagaggagagaaagtaactacccacccgtcagagcctggggctgataagggagggctcctggaagacagagctggtgcttctctccacctctgagctgctttccctccagggccactggcttctgcaggcgttgttgtcttttgctcctaaacagcaaaaagagactaattgcctttattgccatgttaaaatcaatagagccactcaccctgagttcaaaatgatacgacctagggaatgaaattgggaccacctgtggtttgtttcctattagccaggcacagaacagtttcttgtttcccttggaatgaaacacaacctgagtcctggaggaatagttctcaaatgcatccggatctcctggagagcctgttaacacacaagctgagctccattcccagagtgtttgattcggggattctggggtggggccctgagaatttgtatttctaagttctcaggtgatgcagatgctgctggtcccagatgggactctgagaacctctatactaggtcatctctcagacttgggcctttgttctcatcttccccctccaaaacctaacataatccactacatgtggtagagagccatcaaaaagagagtttcagtcaaggggctctggctaagtcctggagctgagctgccccctcccttgctctgctcacacctttcacccctcagactgaaaccctccgttacctgctgctatgcagggattaggattagaacagggctgagtgggctggtacggggagggccctgctgtggtgttggtttagctccttttagcacaaggaatttgatgagctaagcattttccacggcaagtgcataaaaaagatttcttaccattttttgaaagaaagaaatatatcctttctcttgagtcatcactattgttagttgctgaatgaaaaaaaaagacttaaagctctgttctttgaacacttttctctgggtgcctttctgtagctgtagaagatctcttgggttaaattttaataattgttaatggcttcacacatagggg

SEQ ID NO: 95106 - DNA, 2451 bp, Homo sapiens
agctgcaaggactgttggagaaaggggcagggggcactggctggggagagggccgagaagatctcctttgagagatggggagggagatgtgaggctgagaatctagtattgagtttctaaacttctgatctgcaaagtggtttttttttttgtttttgtttttgtttttttttttggtagagacagggtcttgctatgttgtatgttacccaggctggtcttgagctcctggcctcaagtgattgtcccgccttggcctcccataatgttgggattacagatgtgagctacggtgccccaaagtgctctttttgttgaacagtgtgtgagcccagctacctggagggtgtgtctacctgcctgaccctcagccatcgcagcctcatgacggctacaccccgcacattatcatacccctcaaatgtgccttccaaccccacacagatttcttgtggttcccatcctggtgaatcttctcagttatccacattacagacctcagtggaatcttccacaccacctggctcatgatggtctctgctccttgcctttcacgttcttcagaggctagtgacttcctaaagtgaggattgaggaaataacaaccacgataagagttacagctgaccctggagtgtttcctgtgcaccaggagcccgttccaagtatctgtatttattcactcgtgtcatctgtagcagccccaacacataggttaggacctgtcactagtcccatttataggtaaggaagctgaggtgctgggaggttgcatgatgtgccgagcatctcacagccagcaaatagcaagtagctagaccgcttcctccctggcaggtctgaagcacatgattcctagccccagccttcctaagggcccctaacagacggtggccttcccctggcatccagagtggctctgctgactggagcagtcaactgtttctcctctgcagttcctgaaggaaggagaaaagggggaggctggtgggttcaggtttcgtagacctaagaggccagctgccctgtgacccctcctgagttggggcttctttttgggggattagggaggagagttataagagaaagaggtgcggagagcagggagcacctgagagagggctggaagaagtggtaaatagatggacctgcccaatgagagtagccagcgtgtgcatgtgaggggcaggtagcacagagggaatgtattccttgtctaacttggcatatagccaaaagctaggtgtaagttagtaaactacagccttcaaaacagcccctgggaaaggccctgctttggagggtagaaggacatataggaggctcccagaggtacgggtgtgcctccctgctgggcatgggcccgcctgctgggggcagcagcaaaaggaagcaagtagcccggaggaaaaaaagaactatgtgtgtgactgtgtggtggccaggagagagggagagggttcagcacacacagggaaccccaggcagctcccagagcccaggggaagcattcctttttgtagttgaatgatcccaggggagcaaaaggctggctggaggagagggagaggaattctgcttggaggagaaggtctggggccaaactgccccagctaaggtgactggtccgtgtgtctgcatcttaaatctgagaccattggttcctttgcacctgtgtagtatcctcagggagggttcccagggcgctcgtctggtgttgcccctctttgaggcacctcactcattgaccattaagcaagcatcgagtgggtgtcagtttaacaagtgtcttgtgttcagtgccaaggccaggggcaggtacaaggcatgctgaatgcagcccctgccacaggatccatgtttcaatagggagggagacgcagaactttgcgtaaaactgaaaccttatggggcgggccctgtggtgtctaaggccacactgggagtctcagatcctgccaaaggacaggggaaaagggagcagctggtggacatggggaggaggcaggatggacggggcgcctgaaggaattaagtgggatttcggttggagaggaaaagcaaagatggcagggagagacgaggccctcaaaactgagcttgttcgtcagatgggagatggacatccaagcctctccatgaggtctggcacgtgatctggggcacggtctgttctgcagtcatagctgctggcctgcgggacctgcaggcagagtccctgatactcactctctgtgagttaaggccagatgcaggcttcagacacctttaactgagaagcaggtgggtgctggcctggggtgccagggagctgagggtagaaggaatgtattaatgccagcagctgctctctgatcctggccctctgtgacttcctcttcacccattgtagcataccagccagactgtgaaggaatgaatgaagtgggtagagaggttcccggtcaggct

SEQ ID NO: 95107 - DNA, 1454 bp, Homo sapiens
agtcagccaagagtgtcactgactcataggcatacatgcctttcaagaaggcagatcatgaatggaggtcattactaatgtataacttgtcctattgtgctagcaccaaggggagtcacctaggacttgggttcctaggatggatggcccgtggtgtccctagtccaagctttatatcctaggcctagggaagaatgcgtcagacagtagtcagatcatcattggacctgatggactttgcttctgacatttccatgattttgacatgtctttcttggtgtctttgctgcctggtgtctctcagagcccataaccctgctggcttgaataaggcagtaggtgttttatattcagaatcttagccatggtgaataagcatgtcatatatagttcagccctgattttggggaaaatcatcgggcgagtcagcaagtttatgtctgtgccgagcattctggaggatgtaagagaacatgactccaggctgtttggagaggcaaaagcaacccaaataaagtaagtgaggacttagtgcagactgcaagtgtattagccagaggtggcattacagagcccagctcaggatacggaatggctccagcaactctgtactgctcaacccacttctggagcttcaggcttagttctaggagctgcagtttcaccaggacttagacaaacagatgatagcaagggtctgggaggcctctgcctggagaagagggaaagtcaaggggcatttcagccattgaaatctttgtaaagttgggtcgtggttgtgggaagagaggtgatacaaggtgtcattccaggaaggaaagctaggcctaagttctctcctcttctcagtggagtgaggttgttttttgtcttggggtatgtaggcaccagaactgttcacacagtttggcagatttcatgttaaggaaatgactttgggaagaaaaggaggtgtccatgtgggttagaaatctggaagggcattttccatggagcgagcctttagccaagctctaaaggccaggtaggatttgggtgagcaggaggagaggacgctgcagtcagcagatgggcagtgaggcggggaagaaaggcggaaccaggcctggtatcagagctggggctggcaggggagaggcagtgttcgggaaagtggagtccgcctgaagattgtgggaccttccgtggggaaggtaacccggaagcagtttcagattgggtattggaggagaatgagcggacaaggagcaaatttaagagccagctttcaggaaataggtctatagtccttggtggttctggtgtctagatgatgctggtgattatgaagtctctttgcagccccagcccttggagcatgcaggtggaaggccagattcctcacctggagagctccgcagaagatgatctcatcaacctacccttttcttggcccatcttcatggtgtgtaagg

SEQ ID NO: 95108 - DNA, 1054 bp, Homo sapiens
cctctgcaaaaggaggcttcatctgatttcataacattttatttgtttagaaaaacctggtcttgaagcaaacataacaaaatgttaacatttgtgaatttaggatgatggattttatttgttgtgtttttccctgtcctttattatgtgtttgaatcattccattatttaaaaaataaaataaatgtaaacaaaagcaataattatgccagggtatgtatctccctggtatcttggtccactcacaaaagtggtctgaatgtttaatatttccttagtaaaactgctacttggtcacaggcttctctccatgaattactaactccgggttgggaagcctaagaacataatccatcttttttattatgacaagctaatttaattttaattgctccttatagtattgcattatgaggaggaactatctttaattatctttttgggggggtgtttctaaagtaatgtgatctcagaagcagagcatcgtcccttccaaagtagccacctgactgtgaacttaaaatatttgtgtgcaacagtgtaaatagacttctctgctcctccaactggtggaggctgcccttccccccgaagcaattaaaagaattccagatgggtgattctccccttcctggtcctatttaaaaatacaagtgtcgcttcggggattttttttttcctggaatataccaagtgagtgacacaagaattgggactctccattcctgatttaaatattggccgtgtcctttcgagatcatttttcttggtgacatgttagacaatctcaggtcagtctgtgtccttaaagatcactgtgggtgtcaggaatgctgcttacagatgtacatgatgggcacatggaggcgcccttcagggcctttggctcagatccccatcctgctcttaaagaaaagggcattctgttatttatttgttggattttaatttctgcctctagccctctaaggcttctccatgtagtgccatcctctgctgctgttaccaccatcaggggtgggggtaggggtgctgtacagttggcggccagagg

SEQ ID NO: 95109 - DNA, 1038 bp, Homo sapiens
ggggcttaggctcttagcaactgaggcgagggctgctgccagcattaatgactctggtgcagtgaactgagttatctttataatttctccttcaattttaagtgttaagaaagaaggaagaaaaggaaaaatacctctactagtctttaagagccttataacttatttggagaaacgcagcacacaatatagaaacacttgccaagctgccagtgccgagtggtggtatcagtgctgaggacagatagggaaaagctttcctacttgtcacataccctggggaggtgatcacaaacccactgcatggccttcctcccaaggaaggagttaggttgccccatggctaagggagggatgtagaaccacttaacatgacattggtttcaaaccctctggtcccgccagcttcttctgttaggcacaggtgctatgtgacatctcacagaccctgatctggtgccagcccaggccagatcaccaaaccctgcctggcctcagctccctgcactatgcaatggtatagaagtgggatggcacctctcatagggttagttagtatttgcatgctgtgtgctctgtactactctgtttagtgcatttagaagttgatttccttggcacgtgactcatgcctgtaatcccagcactttcggaggctgaggagggcagatcacgaggtcaggagttcgagaccagcctgatcaacgtggtgaaactctgtctctactaaaaatacaaagattaggtgggtgtggtggcaggtgcctgtaatcccagctactcggaaggctgaggcaggagaatcgcttgcagctggaaggcagaggttgcagtgagctgagattttgtcactgcactccagcctgggcaacaagagtgaaactccatctcaaaaaaaaaaaaaaaagaagtttattttatttcctcattggatgtgaccaacttcctacaaagggaagaaacttcatcttcaagtccctaggataaagcttttcatagggaggggacaaaaatttaactccaggtcaccaagagaag

SEQ ID NO: 95110 - DNA, 1071 bp, Homo sapiens
gcagcaaaacacctttgttcttcttacagattcatctgatttttgtgttggagatttgagattttgctcgttactgaaaatgtttcctctgctgagagtttgagcagcctcctggttgtgcagagtggccagggttgggctcagctggccaggtggcaggtgcaaagcagggttctagaagagagtctgcctgtggcctcataggggtaacttacttcagtgagcagtgttgggtgcctgagtgaggaagtagaggtggcagaggaggggtccagtgggctgtctgggccatgtgaggctgtctgcaggactcctcagaaaggttcaggactcacgttcagtgcaagggaagacaaagacctttattgctacaaagttgggtgggagactgaagtcctcagatggtctacaagcttgaaaaccaaatcaagttgaccaacaaccttcagttacagtcatgtggtattgctgcgacttctgaatttcccatttggggttttattagcttttagtaaaaggcgacattgtgaagaaacccagattagaattcagtttataaaacagctgagtgagaaagtgggataggggagccagggaactacatagaaaatcattgagcaattactcaacacaattagagcccaaacaccaccatctcatgtgcactccttgagctggcaagtagggaagggggtgcagagccggagctcagggagaggtgtccgtggctccctcacttctggtctcagaggcctggagtgtcctctgttctgagcattttccacaggcaggggctggtttcaggcccagacagactcccaaagctaaacaaatgagcagccctcgctggccatgactttgccatttagaagtggctttggggctccagaatgaatggggagcctaatgcagacccaactgaccaacttcggcagctttggggaaagtaataaaaatgagcccaggggtttgagacaagcctgggcaacaaagtgagatcccgtctctacaaaaaattagctgggtgtggtggcacacgcctgtggtcctagctactctggaggctgtggc

SEQ ID NO: 95111 - DNA, 1052 bp, Homo sapiens
tataagcagagacccgaaggaagtgaagggatgaaccgtatccagttcatggctaaattctcaccattccatgttttcagagtgaattctatctgtgtgtctatcttgtctcatggtgcagttttagtttttgccacacatctaaagctaaatacaccaggtttagtggaagagggcctctggaaggatggaaatgggagctgcctctttttgtggaagggacaattccagggtgggaaaaagatatttatgggccacattttttatatcttcaatttactttttattatcttgaggaagtaatagatcattgaaaatgtgaatttttttacttctcctgttgagagacaatatgaagttaataagaacaagattactttacaaaacattctgggcttggcaggttcagcctcatttgtatgtcattgatttctttacatttttctctgcatctgttgtaggattttacaggagtcatagaataacggggtcaaatatttctcttaatctgaaaggcgccacattaaaacagggtggtctggttgtaagcgtttcctccgagtgggacagacgaatgttacatatccagttcaggtagcaggcaagctgtttccgattgccaggaaggcccttagaaccagctggccttcgttaagttaggctagagagcgaataaggcagtatatctctaagcagtagcccaaagaggaaagtgattgctgtctccaatggagggatcacaaaggtgtggaggcctgagtgacctgttcaccttcctttgcctgcaactgtggacacagttatatgtgaggtggtggcacttgtcctattcgggtacatgcatgagatggaaaggcttagctgaccattctgcagccctttccaaactaggtgtttcagtggcagtgccagtacttgctgggaatcctgctgcttttcctgtggtctgcccgttgcttatgctctgaaaaggcactgtttgaaacctcaatgccctaaggagcatcttgggtgagaagagagattgggaaactacacagaggatgctcagg

SEQ ID NO: 95112 - DNA, 1336 bp, Homo sapiens
ctaaggtgggcagtactgcgcttttgggtgaggtcaaaactctggagggaaggccaagaaaagaaaattctgcccatgcccctcctcccagcacccaggagtgtgttttctcttctcagaatctctgtctgatgtgctagcctttttgtgtcatttcgactgaaacgtctcacagctccaacccactgcccccatatcttgcatagctttctgtccagatttctgaattaaaggctggatccagagggtgtcccactgtgcatggatggggggcttcctcccaccccagtgggatgctcctgctgccattctcaccccggaacgcccctgactcagccacctccggggcggtgagaggtgtgagggatgatcggggagtgccatgctcagcagcctgaaccgtgtcagggaacccaggcattccagcctgtgtcatcctccccctcccgtgaagagccacagccacatcctccatgccctgctgcacttcctgaggagtgaaagatggtggctgtcagcgtgtcaaggatgacgggtggcaagaggggtaaacacagcttgttactaccagattcgattaccgggtgatgctcgaagacaaatggcctggggcctttctgccccttgagggcaggggcagtcttagtcaccaggagcagggtcctatgaggaggagttagggatgttgtggaattgtctcccaaagccagtgccagccgataggactagttgtgttatctcgagttttcgttgttggtagttttgaattgggagccttgatttgaccctgagaataaccaaaactgtacaaaagacatgtgtattcaaaacaagacacaataaggctcaaaaacaaaactgtctatggtgataaaggttagagtaggagttaccttgggggcagaggaatgttggctgggacaggatatgcaagaacctctagaatggttctggaatgttctgtatcttgatctggtggtggtgacacaagtttatacagatgtattaattgagctgtacatttaagatgtggggaatcgctctgaacctattctggtaacaggggctccccgagttttaaaaaagatgtgtacattttactgtatatatgctatatctcagtgaataagtaacaataaagaaaaatatgcataaaggtggactgtgaacagaaacaccttggcaacatttgaataacctagcttttaccatatttggagtttgctgtcccctggtcctaggtgctaaaaacctgatttggttcagtccagacatttaaaacaccagccagctatggagagtaaaataatggcaagtctcttcctagtttgaccat

SEQ ID NO: 95113 - DNA, 1047 bp, Homo sapiens
gttcccacacaacgcaacttttcctacagttgggtgggctccagggtgcagaggccccccgccttgcttggcaggttggcttggctggagcctttgctggttctcagagcgggaacatggtcgagttggccaacagtgtacccacgttgaagcagctgtgccgaacatctggctctgattatctggctgggaatggccgggggtgggagcactgtgatttatagattgctcctttggctgtaaatcccatctgtaattgtgacttctctgtccctaattgtttgcagagaagagaggagctcaatggcttacaatccctggcagagcccaaggctgctggggtgggggtgggggggggtgaggggggtggtgaggtttgttgctaggacacggctgtctttgttttggtccctgctcagcagtgtttttaaggccctgtatacatttctctgtattgttaatgtaatttgttcaggcagtgaacagccaagttcagccgaaggaatccgatactcataacagaaacaccagaggccaggtttttgtggtcaaattagggttttgaggcctctgaagagaatgaaatgttggcgctgggcgggggacaatctccctttctcctcttgtggtgatgctggcctgggttcagcttccttgaggagcttggctttggggcaccaagtccactgcattcagggctgtgttaggtggggagcccggctgcccttctccgagaaagggaatgcagattttattcaaaagggaagaaaaggcactaacaaagtatgagcaagtttgggccctgcctgcccagcctttccttccccgtggctccgggcagcttttttccccccatcccccaccctgcattacttgactggtgaggaaataatagttgggctctgctgagaaggtatgtgactgtgcaaaatgcaatttgcccgtttccgctgcccatgaagacccgacagcccacttgccatctgggaacctcgcgccctgctgtgcttggagttttcggaaacgatggattccaaacaacttcca

SEQ ID NO: 95114 - DNA, 1084 bp, Homo sapiens
gcccctacttcagatagtgctcaagaggattgagttaatgttagcgaaggacttcggatggtgcctggtatgctgtaagatgggtgtcatttctcattgtcacaccgttgagagtccagatcttcatcatgtttcctctgcatctgactggtgagcctcccagatcagcagcccacaaggcgatcgggtcagggctgagtagctgccagcagaggctggagacttgaggctgtcgtgcaatccattctcgcctttgtctgctttctgtcttttgttttctgctctgtgtgtgtttgtttttgtgattgttattttaagtctctctcaggaatgcttcgtgatgctcagcccggtcaagcgatctgtatacatcctccattatttcttctccatttctttttaatcatatttcctcctctgaacttctaccctcagatttattcattatctaacaaatactgatggtgcagctccatggcccaaagctgttctgggggccacagcagtgatatgagtgtcctggggaagctgacattccacggacacaagcagccattcgtctgtctcattccgccaagacctctgtgaggtcttgttgacccctttgcatgatgatcttaagtttgttcaccactgttcagcatatgggcattaaaccctatttttgcattctccttcccactattttctcctactgattaagcggtatctcctccactgttatttttcttccagtgacatattcaggaagagcaagatctcaaaaaatataaatgttgatgttccccatccaatcccggttgtcattagaatgtttatacttatccacgcagtgcttcagttctggaatatattcatctttaccttaccctggttagcaataacagcaacaggaattaaaaccagtgggctactgttacagcttggcaggtgtaacttcagagaacaaaggggattcttttttgttttttgtttgtgattttgtttattcatttatttatttttttgagacagggtctccctctgtcacccaggctagagtgcagcgaaatcacagctcactgcagcctcgacctcctgggct

SEQ ID NO: 95115 - DNA, 1044 bp, Homo sapiens
tctttgctttgagatgacctgggtcaccatggttgtcctggactccaggagacatcacaggcaaaatcaggtccatacttcccccgtttgtctgcagagaggcctctggtgtgggtcagatccaggggctttccttctatgtttgcagctggaggcctctggatgcaattgtgtgaaccccctggtgtgtccctggagccccagaatgtaagaatgaattttcaagagaaaggtgagagacaggtgctgggcttgtcagatttctggctgggaggcatcccataaggtaagtcaggtaatttcttggaaagagagccttgccggggatcagttatatgtatctacccatgtatcatgctctgggggctgtgttgggggcaggggcaacataagaggtaaacagagtcccaagtctgagctcctgggagaaagtcagaatgcaaagtaacaatttcattttagaggagcgtcaaaagtctcatggctttctaggaattgccgagtaataggaaccaggaggagagaaggagggactgcagggtcatttgcagtgactgagatttccaaatgctttgttccctaaacctgtctaccaccacggggcgagggcatcagctctttgcatccctcagaccccaggtcactgtcgtaagctcttttcttggaactctgatctcagataacctgcattagtctgaaataggatgctgagataccaccataggctcaggagaggtgctttttagacctttctggttgggttttcccatctgccctgaagtatggtccaggaggtggtgatcatttggagcacgtcttaggactggagaggcccaaaataccttcaagccttttgttatagttctaaggtatttgttagaactcctggacagtttgtctagtggtttgttgtgttttttaaaatttccagcaacttgcccacacacttggccaagctttggactgagaaggatgcagtggtgcaatcacagctcacagttataacaaggatccttcactggatccttgttataactgtggccc

SEQ ID NO: 95116 - DNA, 1101 bp, Homo sapiens
aaggggtcaagggtagaaaatcagagacaagttgttgggccagtggggcctggatggtggcagtagaaatggggaaagttctcagattctggacccattttgaaggaggagtgacaggatttgctgatggaacaaatgtggggagcaagaggaagaagagttaggaatgtctcctgggcagtgggaaagaagaaagtgtcattgacagaaatggagaagactgtgggaggggcaggtttgggaggaaataattaggagctctgtttgggacatgttgtattggagatactttttggacatccagtggggagagtgataggtggggtaattgggtctagaagtcagggatgaggtctaggttagagacagagactttagtcatcagcatgttgatggtacttcaagccatgagactggaggagatccctgagactgaagctgagaaaaaaagaggtcaagggctgagccgtgggcactacagcttttgcacactggagagaagagcaagaactggcaaaggagactgagaaggagcagccagagaggtaggaggagacctggtgggcgccgcattcctgcagccaaggaggggagtgtacgaaggaagaggggctgctgctgaaggtcgagtgagatgagggctgagaaacaaccattaggtttagcaaatgcaggtctttgctgtcctcaaaatatagacttggcactctgcccgctagcaggacagattccagaatagaatctggtatcaagacagataccagggagaggaggctcttcaaaatcccaggcacgtctggccccctaggagactcaggaaaaagtctccagacttggaacctaagctggactgccttatctgagaagattggtgtaatcaatggtttggtgtcaggctcccatagagaatggggtgaagctgactatggctcagcacttgcttaggatagtgggccatagggggttcccttcttggatggagggccgaaggcaagcctcttcactgggcatcagtcaccagtccctcttccctctaagatggggtaggttggctgacaaggcttcccactggcacagtgcaaccagaagtcccagatgggg

SEQ ID NO: 95117 - DNA, 1752 bp, Homo sapiens
cttagagaaactggtgaagtgaacacagcttaccaggatacaatatccaaattagcacactaccttttattgttattaatatcaccatgaccgctattattaacctctccctcttatacaaacacattcactcatatgcatcctatttcagaaggtttatcttcttaaagactgatataattttcacattttactttaaacagtaaatacaagtgtaggaggccagaaagcaacagctaagttagaccctagtccgtaaattccaatcccttataagaaggaatctcttccaatgagaccttttgtttttcctgccccaaggtgaatgttttgagaacctttgcatcaaatcaattcagatacttgtctttaacttgcaaaacttaaacaaatggacttttttctgctagcactattttaggattcacagaaaatccagtctccttaagcagttgaattgaggtttttgccaaaattgtgagggtttgaaaatcggctttaaatttagagcatgcccatggtaaggttgcgcgggtgtcctatggctctgtagaattaagcattaacgttgcagctggattccatttctttgtgaacatgcaaattaacatcttcagtggcttcctctgcctgcatacttatataccagcctccaaatgtgttatttgttattaaaatcaccgtatttatgtgtgggggtttgcggtgactttcccagatgcagtgatcctaattgtaaccatacaggttattcaaacatagcttggatatttaaaacagaagcgaatctaggccagcatgcagttagttgagtgtaatgtagatgtgaaaagactccttgtggccggtagtgttcggttctgttagctccaagaatatatcttcctatggtgattgaataatgtgcaactgacctgggtccttccaggtacctacttttaaaccaggagttataatagatttataaatctttaggctttactggtatttgctttctgtgaacaggaaatctagggagctaactgcccccctgcaatatgaaaggcacatgttccccaaatgtgactttgggggctctctggggtttaataacaaacacttgcttggtttttgggactggcgtttcttcaactcacccatgcatgggaaccgtctgaagagattgtgtaaacgcagattctacttcagtagggctgtcgtggggcctggaactctgcatttctaacacaattccacatagtgctgatggtactggtccagggaacacacttggagtagcaggatctgcagccaaataaatacaacccagtctccaaactagagcggacaggcccccaggaggctgtttccatgggccctgggttttgctagccttcccgtcccacttatacacacttacatttgcagaggagaaatggtgaacacctgacaacatttgtttaatttttatcgttgtggggccttttgggagggaggaagaagagtatctcagccaaccaccaactcccaccccctaaaccatcaagattgctagcgttgtgcttgtagttttccaaaaatgtacatgaacatagctgatccacccactttggtggataaccttgccaataacagaggcagctcagccaggagtgagtgattggtccagaataaacccacccaggtggcagtcagttcttcactgccctgtttagacctggcctgaggattgacatttcctttaactgtctcaaatgagagctatcctgggct

SEQ ID NO: 95118 - DNA, 1007 bp, Homo sapiens
gagacagagtctcgctctgtcgcccaggctggagtgcagtggtgctatctcggctcactgcaacctccacctcccgggttcaagcgattctcgtgcctcagcctcctgagtagctgggattacaggcgccggccaccacgcctggctgatttttgtatttttagtagagacagggtttcgccatgttggccaggctggtctcgaactcctggcctcaaatgatcacccacctcagcctcccaaagtggtaggattacaggcgtgatccaccatgcccagccgaaaaatgagatttttaataagcctggctagctttgtattacactattttgtgtttcgtgtatgttaaaagctcccaagttgtgccgtcccctgcaaagaaagccctgaatgcacagaattaggcacatcttgaggacagataacctttgagagacctttcagagccactaaagaaaggcaaaggagaaactgtagtctcggagaatgcttagtgttcagactgagcagcaaaaaggtgttaaataagtaattaacagctggattctaaatagcagctaagagttagaggcctgagaacatggcctgaggccaccagaaggtgggagagagataaaccagcctatatttaggagttaaacagatggcaggatcagggccctactttgtatttaggaggtttgtgtggtttgtttacttgggttttgttttttgctgtaactaatttaacaatttaggagtggaaagaaaaattaaccaatttatcttgctgtctgaataatgttttgcaataaccaagaataggtcagtggaccaagtgggtaggtcactgccctgcttaatgacccatatccggatattattatgtctaaatgataatcagcactcatttctatgcacacaaagagaagcttgtgaggaagaaataaaaagcctttgcctttattgtgtacagtatatagtgtaaacagtaggggtctaatacatgtttgtttccataaaggctt

SEQ ID NO: 95119 - DNA, 1028 bp, Homo sapiens
cctaaaaacttgatctctattgctttactttaggaaattttaggccctttctcagacggcctaaaattagaccttcgccactcccaaccaaagcatgtcatgacatggaagaaggtggtccctggcctaatgacccatttctgtaaaaatgaggtaggatgtgtaaacagtgcaataagactatggaacaacagaccgtgagccagtgtcaccttaaatgtaaacgttagagatctaggcttctgaagaaatgttggaaagcctattaaaccacataggtttgggatttttcattgtgtagcagacatatggcttagtgtttgatttaaaaaataggaagttggtggccattttcatgaatagtttgacagccagtcagaagtgtgattgtcgttttacctaaacgcaactgctgttgttcgtaaggtcagaaacctgctcacaggggcgggggcggggaggtctggtctgttggctgtttgacccatttggttacgacctccatgctttgtcctgagtaggctggttcatgctggcaagtcaatgcagaaatattgatcaggttcctactaattgcaaggattgggttgaacgttgcagtaggtaagtaaaagatgagtggggccatgaccttatataggaactgtctgtttcctggtccaccagagcaacaacacaagtagtggaactgatctcaaggcagggaaaggttagtgtcacaacagaagaacagtgagctttggagcctcaaagaaagaggggccatctccctgtccttaaaagaaatcttcctcctttttactaccatcgtaagagtttacctactccaggccctgtgcatgctaagcgttcactcagttaaaccaccacacaatcttaggaactggattatactaataccttttcaacatgtgggagctgaggctcagaaagattaactttagatcaaggtaacaactggtaaggggtacagtcaggattcagtcctagctcagccagaccccactgtcatgtgtgaccttgcagtg

SEQ ID NO: 95120 - DNA, 1003 bp, Homo sapiens
tgtcactgttggatgtcttaatatgaggaaggactcaaacagagctgtccgcagctgcaactggctgtcttgagaggtggtgacctttctcgagaagggtggaaactgtagccagacaactacttggtgaagcagcatacagagagatcgcccttctgatgatgcgcccagtctgaggcctcactgagatggcctcaagagtgtgtcttgagctggttagaaacttaccatcctgggccccacgacacacctcttgacccagactgcatcttaacaggatcctcagctaatgcatgcgattgttcacttccagggcctctggttcaggaccagggtgcatgagcatcacctggaggagatttttaatacaaatgcaggggctgagctgctggcctaggacatagaaggaccattcccatacctcacagtccagctgtctccccattccctcccccctacatgctgttgtgtttccaagttcatgcctgtgtgcacacctgcacacaagggaataggaaaatggctttgatgtatggaatcatgtctacaagctgcttcagtcaggggcccttcttgctgagagaccaggcagctttcccagggagccccagggcaggggcctgaggcacctgcttcctgttctgtcccctgagagctccgctttgccgggagaaaggagaagcctaaacagggtgggctgggtctgcgaggcctgcctaaggctgccctctgccttcccagcccttcagtccctgatcctttcgggcccctcctaggccagaatgtcccagattagatggggtggggaggatgtcttctggttgctgtaggcctgcattaggggagtatcctctctggtcccacgtggggcaggtgcccagagccaggaatgagccgcctgtggtgattcctgtgtgtctggagtccaggagtcccttgcactgttggccagtggtcactgtgcggtgattgactgggctcagtgtctgtagcttttgtctga

SEQ ID NO: 95121 - DNA, 1045 bp, Homo sapiens
gacacattgtcattctgtcccccacagcaccacacacagtggctgcgcatggtggatgcacagtgagtatttgtggaatgagcggccgagccgctgcagactgatgagtgttctggggcctgtgtttgttttctaaaactgctctgtcagtaagcgccccgccaatccccgtgtaaacatattcagatcctaaagaagatcaggcagccaccctttaaaaagcccgataaacccaaccttcatttgtattatctttgggcagggtttgcttgggaattcgtatctgtaggaaatcttagtgctcgctgctgggaggcaaattgttcgcattcatttgttctttcagtggtttggccctataaagcagagggctggcctgagggaaaattgtgaaagaatctgagtttgtctttggggtagaaattaaacagcttctctaggccttgccctcaaacttcagccctgtttactattgaagattgtgtgtctcaaggggtaaagagagccgtgggataatggagactgaaaaaatgttgcgatttagccattttgttttcttttttccttggagaataatcttttgggaaaaacttggatagagaccctttgagccatacaattttttaaagttgaattcaagcctctagtcatggcttgattcatttttttctgaacaatgaacaaagaaatgctggtagagagccttgaaatgcggggatgttgaatgaggaaaggaaaaaggagggccgtgagtgttcctgagcactggctggaccctgcagaagcttccgatcattctggaggtctccagaacttggtggctgggacaccagatactgtgcatatgtgaggggagggcctctgagaactcccaagaggcccccagcagcctcccccacaactgacctttcacagttggcactaaactgcaggcttatctcctttctccatttccaggactgcaaattgcagcacctggaactaagacatccctggagggcaggccttccaaactcgcccccattgattaaggcaaacactgctt

SEQ ID NO: 95122 - DNA, 1143 bp, Homo sapiens
cactccccattacacaggtggaaatacatgtttcgtatcttgctttttcacttaacagtgtaaacacctttctgtttctgtaaataaccacctactacataaattcagatatcataattgcagcataaggcatttaatatctttcagctattataaacagctcttcagtgaacatccttgcagctatattttgcttgcatccttaattatttccttaggatgcattcctagagacagtaagccttcagaagacttgatacatacttccaaattgcacaagacaggatttactaatttactttcccaccaccagggtattaaaaagtgcctgtggtaattaaagggggaaaaggccactgccaacatgagagactaaaagtagttaactcattactgagttcataacttctttatctcaaattctgcaaacaaatgggagtggaacccagagattttccttgacggcttgatgcccagcccaggaggatctttgttgtctggcccaccaggtcaccggctcctggggttttcagtgcagcaggtatccttgtccagggcctttgtttcccgctggtcattggtccagcatgcttccggtggggacttgggaaccaccagggggcagtgtggagctgttgagcatgctctgcatgccttacggcttatccatattgaaactttcaataatacaagtattcttttgttgtgttttatgacttctcagattggtatttataatattgatttgcttacattagtatttcatccccttccaattatttttatgtttatgtgttgtaaaaaaaataacctgatccatcatagctgttctgtagctggcggccaggacacctgggttgttctgatcccagctctgccagtgtcctccgtgaccttggtgggacagctcaccccatgggcctgactgcccttatctgaggagtgccaggatgggctgcaggagtggtatgttttcttctcttccagcactagcataatgaaaggattgagagttggccttggccaggtgtggtggctcatgcctgtaatcccaccactttgggaggccgaggcgggcggatcacttgaggtcaggagttcaagaccagcctggctaacgtggtgaaaccctgtctctacaaa

SEQ ID NO: 95123 - DNA, 1045 bp, Homo sapiens
cctttatcaggagcaatggccctgtatagaggtggctggtgtgacccttattctcctgtgttcttgttcacctgtggggtcggagagctctcctggaactgcccgtctatggagaggcctcctcagacatttcccatctcccggtgcccaggagttgttgactttggccagctgctgggcctgcaggagccgcggggaagggttctaagagacccttgaagctctgtggctggaaggcagctccaggctgcctggctgttcttttgtgttgagtatttcactggccccagataagcgcttcctgttcctcactgattatacacagatcctgcttcctttctcctcaatacctgggatgctttccagcttctcctcccataggggaaagtccgtaaactttagaattctcaggcctgcttttggtcaatggactttctgcaaattatgactgtttttgccatctagtcacattcttggtgaagccttcacctctgtctaggagctgagttccgctttgtgccagccaggagagatgcttctatgacctggtttctgcccctccttctcaccagacagaacatctgtatctacctcctggcgtaaatcagagagaataaatagattgcaccttacaggtcagttttaatcaactgttagtagctgcctcagtgttgaggattctgaggtcttacccacctttagcaagaaagagtgccatggtctactagcagtgtctgccacaagcacggagggatgggactgctcctgtgccccatatttgctatcccaagattccgagatcagttggaagtttctttattttttatttagagacagagtctcactctgtcacccaggctggagtgcagtggcgcaatcacagctcactgcagcctcgagctcgagggctgagtcgatcctcccagctcagcctctcgggtagctgggactacaagcgtgcgccaccacacctggctaattttttttgtatttttgtagagacggggtctcatctaactttgtttcccaggctggtcttgaactc

SEQ ID NO: 95124 - DNA, 1060 bp, Homo sapiens
cgagatccacgttgagcagaaacagcccgcctggccaagtgctcgccccaaggagggctctaaggaggggcccaaaacattgagaaagagaggagcagagcccctctgaataataaagccacaaggacactgatggcaacactcgataaagatgtcacccaaagaaaagaaaactttgttcacctttacttaggaatgtaaaagtcaaaaatttaaaacatgactagcattccacaatacagcgtaagaaggaacaaaccaccatgaccaaatagggcttacctgggaaatgcaaaaatgccttcatgtaagaaaatctattgctatatatacatctcataaatgagtcaaataagagaaaccacatgaccattttggtaaatgccgagagaaaaatgcaacaactgctccaatgaaaacaatgtaaaaataggattagaatcatccttccttaatgaggtaaagacatgttttaaaccacagcctcagtctacttaactgtgaaccacagtagcagaaccccagtccccagaaaagtgtttctcagattcagtgagattggaaaactgtgtatctgtcctgtcttagatagtcacaacatatgtaaatcgaagacagtagtacctgccgtttgggtttggtgttttcctttctatttttgagcatccaaaagcgggtatttaacccatagaaagcaccccagaagtgggagcgatcgctattgccaggccatcagttgcattgatgccattcatcaccatttcaatgtgttacattccggtgggcatcccccaggagggaggtggctggaccagcccgtgtacacatcttcgctgtgggctgaagcccagccacgacacactggtcaggagctgggccttgcagagccagttaaatgtagcctagactgggcatggagaaaccagcagttttaacctgcccacataccattaccatgcaaagaatctaagcacagtcagccatcacttacttccccaaggacatgctcccacccatgagtgattgccctcagggtgatcgtggggttggccttacagct

SEQ ID NO: 95125 - DNA, 2796 bp, Homo sapiens
gaccctgtcgtgaacaaaaaaacaaaactaacacgtgtactctgagtttcccattcttccttttgcacagagcaatcctctgagaaatgaaagaaaaaccctgtgttcagccttcctgttcctgtgagcaccgtcctgtttcttttttattgtttaccgcctgacttcccacacctctgtcacctcctttattctgccactccactgcagcccggcttagcgcttcagtcaccatcgaataactaactccactcattttcctgcttttttgcaacacagccgacagccaaggcctgactactctctgcttcctgtaaatcttatcattgactccaagatactgtattaatacacataatcagttgtttgtctttttgaagcttccattttctttctagacttttattcaaataaatcaactcttcatcatcacttattcctctcaatgtttgtgacagaaaaaatatataaaatcccatcaagagagctgtagaactctcaagaaagttctacacccgtagttccaactgccaaacaaacatctaaccattgcagatgtgtgctctgcaaataataactcagcattgtggtggagcaggggtcccttattttgtctaagggcagagaagcatgaaccgttgccacacatggcattatagatagcaacatggatagttttctagtaaattttatattaccgtagtctatattataatatagcaaagcagacacaggcctcaaaaacttaaggaacatttatgggagaaaatcttaactgggaattcaacagatggggagaagaccatcattctcagtttttgaggcagagcatctcattccaacgagaggtgtgtacgtgcaggagcaaaacctgagacacccggggaggagggtatatgagtgggaggctgtataatacacttggttgcaatcccagatccacctctttctatttatgcagctccaagcaaattacctcatctctctttgccttggtttcctcatctattaaatggggattagaagagactgacttcatagagtcgttgtgcgaaaatgagccagtgtattgtaatgagtctagaattgtgcctctaccacaaaataagtcctcaataactattagcttactactcccagcgtcaccaccaccactaccgctacctctactattattaaatgagagggaaagaacaacgaaaatactgtttaattagcaaaactaagaggtaatgagggcctgaattaggtgccagaacaaatggacagattgcagaggtaacagagataatgagcctatagaatttagcatctaatcccccaaggatatgatttaattggtctggggtgcggctggtatcttagtttttaagctccccaggagattccaaggggcagccagagtcgaggatcattgttgtaattgcaaatcacaaaccagaggcggagtggaaggaggacctagagacatcccagtttactccatgcggctctccaggctagacgtgtgagcagaacttgaaggtttttcggagggagtcacagaggtttggacaccggcttttttgttaaaatacttgagattatgaaatgtattttagagtcaggagtaaaatatttaaggtgaggtttgccctgggagtagagcaagcgaaggaaacagcctgcatacttgcagagatttagtgagtcatgtagaagctgcctaacaaggaagtatgtctaagcaagtcacaactgggcccgggtgcgggatgaagttaagtgcttaataatttggactttacaccttcaaaacaagctctaaagactaacagtaacattgtataagcaactatttgtaagatccgatcagtgtaatttcatcacttgcagattattatccagacccctcaccatggccccacatgccaggtgcctgtcttccctccagtgtcccccaggagcactgtgtccagccacgcaaaacacatatatgcccctctagaatataagcaacacgaagacaggaatcgcatctgagcgcctgttgtaatgctcgggagcatttgttgaatgaatggaagaatgaatggtctggtaaaaagttaataccccttctctacccacatttacccaagatccaaccccttttttcattcagaactgttttttaattttaaaaaatctttttttgaaaccgtaaaagtaatgcatgcactgtgtagaactcttgggaaaatgccagaaagcacagaaaaagatctataatcccacaacccacaaacattttgttaaatagtatttcagtctggagtgtgtgtgtgtgtgtgtgtgtgtgtgtgtgtatacttataacttgctctctgatgaccaaaatgcttcctgtccaggtagatgcctaataaattctgctgagttacaggcaaatggggccagagacccagagaccaggagacaaataatccagataacttggaaatggttgcagttctccaaaactttagagtgacttaatccagctttttggaaaatggtcagatattcaggggttttttaatgcaaattttagctgttaggctgagcatccagaatcagaaaagggacctagagagtaaggagttgagggatagaggaaggtgtagagaaaaatctagatgaggttagtgcaaaggcagaaatatctaccacctttgaaactttgccacctctctcttcctggttgccttttatttaaacattttaaaaatagatagacatagatggtttccagttgtttgtttgttttgagacagtctcactgttgcccaggctgga

SEQ ID NO: 95126 - DNA, 1285 bp, Homo sapiens
gcactaaagttgcatcctcgttacctcatttcaggaggtagccctacagtctgcctttgtcccagtattagtgatgttagcatcaactgtttggattaggtggtatctgacaaacgtttccaccctagggtaacaatttttccctttgtaattaataagtgttttgtagggagaggctccaaggctatgccaatgccctatttctcatcaatttttcacccactagttttagcaggcagtgatggttttccacctgcatcgttccttctgttcatttctgctgttgagcttcagcgtctttgaaattcttactcatgtctcccagcccattcgtctttgtatagactggagttgacattgtggcaagtcacatttgtgccatttgtaactgtgatgagaaagtcgctgatagatacagagaaaaaaaattaaaaaccattctacaaatagtgtttctaaagaagagaccaaactgaaggaaaagaggcaattaagaaagttaaaatgggctctaaaaacaaaaacttgaatttatggattgaaagagctcctttgaattctataaaactcaatgaaaattgacattcacctagacatatcctaaaaacagttcaaattgcaagggtttagaaatgttttccttcaagcacccatgcagaagagaaaaaaaggcaaatgccaaaggaacaaaaataaaggtaaccttagggctgtcttttgccacccttaatgccagcaaacagtgggaaaagaagagtttgggtaaggaaaggcttatcccaagaatgacaaatcctgtcctacttgcaaagacctcagaaacataccattgctcagaaggacctgaaagcacattccaggtcccagagtcttttctctctcctattgccctgcagagactcttgacttaccttcacatttttcgtagcctgcagcacaccactttcaggagctcagaaagtatttgttgacccatccgtacagaccctcattctcctctctgctgcagcccactggcctgccgtgggtcctcacacgtgctatgccaggcatactacactagtgtttctttggccaaaatgtccttccccacaatcaacgtgtccagctccccacttctttcaaaatgtgaaagtcatgctctcaggccaggcgcagtgcctcacacctgtaatcccagcattttgtggggcccagacaggcagattgcttagtccaggagctcaagaccagcctgggtaacatggcaaacccccatctctacaaaaaatacaaaagttagccc

SEQ ID NO: 95127 - DNA, 1028 bp, Homo sapiens
ctcagcctcctcctctcacagagctatagctgctcactctttcttgtattttccccctaggtgccctggcctccaagagcaagaagccatgtgttcagtacctgccccccgagaagccctgtgacagccctgcctcctcccacgggagcatgctggactccccggccactccctctgcagctttggcctcaccagctgcccctgctgccacccattcggagcaagcccagcccctctccctcaccaccaaaccagaaacccgggcccagctggctctccactctgccgccttcctgtcggctaaggctgcagcctcctcctctgggcagatgggcagccagcctcccctcctgtcccggcccctcccccttgggtccatgcccacagctctgctggcctctcccccgtccttccccgccacgctccatgcccaccaggccctcccggtgctacaggcccagcctctttccctggtcaccaagtctgcccactaagctccccccgacccctgcaggctgtcacatgactcattgagtagtaatgattcagaagaaaaagaaaaaggagactttattggtcaatatttgaccactctggactgttctgtaaagtggctggtaacaacagcactttacagtttgtagatgtaaccagtagctgatcttaaggcttttttaaaaaacaaaacaaaacaacaaaaaaaaatctttataagaaagagaactgaaaagtagcgtgctattcgtcctgtaggtgctgtggtggatggacctgggcagagggcacttctctctcttacctctcttgcactttctgtctcctgtctcttctcgcccctgccgcctgccccagcttccccgactccatctgcagctctgccattgtgacatttcctgttacccagcccaagttttcatcgtctgctcaataccgtgggttcttcttcgtcctctgtcctctgcccagtgtgaggccatcaccatgtgagaagacatcttggcctgatttgctgccaccagcgtcccctc

SEQ ID NO: 95128 - DNA, 3756 bp, Homo sapiens
taccatctctactaaaaatacaaaaattagctgggcatggtaatcccagctactactgaggaagccgaggtgggagaatcgcttgaacttcggaggcagaggttgcagtgagccaagatcatgccactgcactccagcctgggcaacagagcaagactccgtctcaaaaaagaagaaaaccaccaccaacaaaaaacacatgtaaataattcacaacagtacagaacagtatgaagcagaagccaggattcctctctctccatcaagtgtatatctttctagtgttaggtttcatttcaaactttaaaaatcattttgtgtgctattttaattaattgctgtttctgtggtggtgggtcagtatgtcttaattctgaatgttttccctgcacctcctaaaagatcttttttcccctaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatcttttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgacttttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgatcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtca

SEQ ID NO: 95129 - DNA, 1065 bp, Homo sapiens
ccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggtggttccagagcagccttcccggaaagaccattccaagcccatctccaacccttctgataacaaggagctccccaaggctgacacaaaccagcttgctgacaaagggaagctttctcctcatgctttcaaaaccgaatctggggaggaaactgacctcatttctcccccgcaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaagggacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaaggtaagtcgacagcggccttccggaggggagtggggtttccagcaccctggaagcttgggtgtgggtgggtatcccgtcactagatgcccgtgagcactggggactttaaaacaaacttcagttttttcctcaggccctattaggcctctttactcttgttttgttaatcgtgttttcatcctgtcacctgtttactctgagtgtcctctgctactgcattaggagccaagttaggacattattaggatctgacctgacttggaatctcctcccataactttgcacttaggtc

SEQ ID NO: 95130 - DNA, 1030 bp, Homo sapiens
gcaggtgatcggatggatttattcccacatgggagagaccagagcacagcacgtttgtgtacggccaggagggaaccacgaaaaaagcagaggatagaaacgcaagcacacgatggtggtggccaagaggagcctgcccctagtgacctcacttccgcggccagtgcgagaggcgagggagctccagctctgcctgtaaggtctcggaagtacgaggcggaggggacgaaaaacggggggccagactgttgtggctgtggtggagacgagaaaccaggaagaagaggctcgcctcccactcggcgacagtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggtaagaccctccatcccgcatcccactcttgcccccagatcccccattctcacctgggcaggtcacctctaggctcgcttcttccctacccgacccacctctccgctcgccatcgtctcccgccccaccccccaatccccattcccccgctgctcccgatctcttccagttctgaggagttccttcttcccgcctgcccttctccggtgctaactcgtttttctatttcaggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaa

SEQ ID NO: 95131 - DNA, 1024 bp, Homo sapiens
ttttgtggggccaggcatgatggctcacacttgtaatcccagcatttagggaggtctgcaggtaggaggattgcttgagcccaggagtttgagatcagcctgggaaacatagcaagaccccatctctacacacacacgaggttttgccatgttggccaggctggcctcgaactcctgacctcagatgattggccgcctcggcctcccaaaatgctgagattacaggcatgagccaccactcctgcttcacaaactccattttgcctttggcagaggacgtgttttctttcttcatgccctctggatatgatagaggtccccaagcttttcctggctaccacttgctctgaccttatacatgttgggttttgctcttaaagaggacagcaggaagaaaggttggtttcagaaaccaagagggttggcagtggatgtgtagattttgtcacggagtccgcagagctcagcttttgaacctctgagaagtttcatttcttgtgcagaaagagtacacttgaattcaagtttgcctttagaattgcactgaataaaatactgcacactaaaggaaagcttattttctgcatggttgtcttttcaaagacaatattcgaagcatgtttcctagagattgtgtggatgagggtgagctggctgaggcatcactcaagctaggggtggtgtgtaagaagcacgaggagccacaagaggcacctcctatagtcagctaagggcttccctttctgcgcccagcttttggttgaagggtgaatttttttttttttttttttttttttttgagacggagtttcgctcttgcccaggctggagcacaacggcacgatctcagctcaccacaacctccctggttcaagcaattctccagcctcagcctcccgagtagctgggactacaggcatgcaccaccacgcctggctaattttgcatttttagtagagacggggtttctccatgttggtcaggctggtcttgaactcccgacttcaggtggtctgcctgcccc

SEQ ID NO: 95132 - DNA, 1011 bp, Homo sapiens
ttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcaggtgagatctttacgccttttataacatgccatccctactaataggatattgacttggatagcttgatgtctcatgacgagcggcgctctgcatccctcacccatgcctcctaactcagtgatcaaagcgaatattccatctgtggatagaacccctggcagtgttgtcagctcaacctggtgggttcagttctgtcctgaggcttctgctctcattcatttagtgctacgctgcacagttctacactgtcaagggaaaagggagactaatgaggcttaactcaaaacctgggcgtggttttggttgccattccataggtttggagagctctagatctcttttgtgctgggttcagtggctcttcaggggacaggaaatgcctgtgtctggccagtgtggttctggagctttggggtaacagcaggatccatcagttagtagggtgcatgtcagatgatcatatccaattcatatggaagtcccgggtctgtcttccttatcatcggggtggcagctggttctcaatgtgccagcagggactcagtacctgagcctcaatcaagccttatccaccaaatacacagggaagggtgatgcagggaagggtgacatcaggagtcagggcatggactggtaagatgaatactttgctgggctgaagcaggctgcagggcattccagccaagggcacagcaggggacagtgcagggaggtgtggggtaagggagggaagtcacatcagaaaagggaaagccacggaatgtgtgtgaagcccagaa

SEQ ID NO: 95133 - DNA, 1234 bp, Homo sapiens
acattgagaaccagctgccaccccgatgataaggaagacagacccgggacttccatatgaattggatatgatcatctgacatgcaccctactaactgatggatcctgctgttaccccaaagctccagaaccacactggccagacacaggcatttcctgtcccctgaagagccactgaacccagcacaaaagagatctagagctctccaaacctatggaatggcaaccaaaaccacgcccaggttttgagttaagcctcattagtctcccttttcccttgacagtgtagaactgtgcagcgtagcactaaatgaatgagagcagaagcctcaggacagaactgaacccaccaggttgagctgacaacactgccaggggttctatccacagatggaatattcgctttgatcactgagttaggaggcatgggtgagggatgcagagcgccgctcgtcatgagacatcaagctatccaagtcaatatcctattagtagggatggcatgttataaaaggcgtaaagatctcacctgccccagctggaagcagtgattccattgccccagattcggaattgtgatttaaactaggcctctcttcaggcatcagaaccaaattagagtgctttatacgtgcaaggaactaatgcagaaagacattatgggtaagtcaagggagatgccccagccattgggcaaattcctctgactcctccctgatggaactaattctttttcttctgtgcccggatcctagaatcaagattcttaaggtctgagtacaagttccgcttcaggatggcgctgctgcacagcagggcaccttgcagggccccgaccagtccacaggtgaagatatcctggcctaggaggcaagagcagaggcccctgagcgtgcacccaggcaggcccaggggagggtggggccttggtgctcttccctccacatgagggccacccagagctggctccaatcagacaggggccacagcctgcccaggcagccctgctcaggggatgggaggctgcaggggacagcagggcctgagggcaggaacagaggacgttgggcgacaggggcccagggtctcaggtcctgacaacatggggcagtgagtatacctgtcagatagaggttggggatggggctctgggccctcaaggaggccatcacacaagggtgcaggcggcccaggtcatggtcagccccgtagcaggcacctcggggagcagccag

SEQ ID NO: 95134 - DNA, 1885 bp, Homo sapiens
ttgcagtaagcggagattgcgccactgcactccagcctgggtgacagagtgagactccgtcttaaaaaataattaaacacataaaaataaaaataaaaataaaatggcccggcatggtggcatgcacctgtagtcccagctactcgggaaccagaggcaggaggattgcttgaggccaggagttcaaggctgcagtgagctgtgatcacatcactgcacttcatcctgggccatagtgagaccttgtctcaaaaaacaaataagcaaaaccccaaatctgcctggctggttctgagtattcccaggtaaaatgtttgaaacatgttagtcaagagttctgtgccaaaccactctagaggtttcttgcactgtacaagctagagaagtcttctttggtttccctatctttgctatttccctgcccctgcctgagaaacccaccctttggcccttctgctgtagctttttcagccaaccaagtgccggagaagctggatgtggtggtaattggcagtggctttgggggcctggctgcagctgcaattctagctaaagctggcaagcgagtcctggtgctggaacaacataccaaggcagggggctgctgtcatacctttggaaagaatggccttgaatttgacacaggtaaggcttgtgtggaaaagggttgggagcatggctgtatgttgaagaggcttggagcagcccttgtggggtgatactgagcatttctgttgttttggaagtgccatcttctctctgggtactttttttctttgtttgtttcagacagagtctcacttcatcacccaggctggagcgcagtggtgtgatcccagcttactgtaacctctgcctcctgagttcgtgattctcatgcctcagtctcccgagtggctgggattacactcagtaatcccaccaagtgggccaccacaccccgctaatttttttgtattttagtagagatggggtttctccatgttgtccaggctggtctcgaactcctgacctcaagtgatccacctccctctgcctcccaaagtgttgggattatgggtgtgagccaccgtgcccagcctctgggcagttttcttatgtgacagcatagctactgggagttgaatcgggcagcgatctggcggtttctgctgtgacacctccctacagacagagtgagcagctcactctgggcgtgaacttggccaggccagataaactcttccacctcacttcctcagccacctttccagggctcaatccccatatccctttactaccttgtttttccatctcccaacaggaatccattacattgggcgtatggaagagggcagcattggccgttttatcttggaccagatcactgaagggcagctggactgggctcccctgtcctctccttttgacatcatggtactggaagggcccaatggccgaaaggagtaccccatgtacagtggagagaaagcctacattcagggcctcaaggagaagtttccacaggaggaagctatcattgacaagtatataaagctggttaaggtaacatggacatgctgaggacccagagtttgttctcgataaggctgggtttctttattattagtggaggcactgggggtggagagtgcagtgcgggaggcaggaagggaggaagagtcacatctgttcttagctcagcctccacccaagtccatccagttctctgtctctctctctctggagccttggctccacggctgctgctgtcaccctggcctctggggatgccctgctctcctccctgactaggctggcttccatgacatcagatcactactcctttttactgcatccgagaccagattgggatttttgaaaaggaatttgagcaggaaaatta

SEQ ID NO: 95135 - DNA, 1034 bp, Homo sapiens
gctcgcatgggagggtaggtgaaaaagttaaggtcctggaaccaagtggaggaatgagtcacggggattatcagttccacgagccacggggattacaagtggcagggcgggtgccaacaccttgcaaaccaaggacaatgaccacacccttgggactactattcccggggcctactagggcaaaggctatcgacagtgttgcacactaaagcggggctcctccacgtgcaaggaagccctcctagtactttacatatggggaaactaaggcccacgtctggtagcggctgccttggcaaaatgagaacccaaatctgtgagaaagcctcgagtgcagccccggaccccagggtccctcctgctaccttgtttgagaaccttcttcctggcctccttgtcagttaccaggggcgctgggggccgtttgacatcttcggagaaaggattcggggagctgccagagaatagtcccaagtaaactttgcagaggacggccagcagcagcacagccaggagcagcaccagcggaagccacatcacgccggcgtcgggtcgggtaaatgggacagctccgactgcgctcagcctctaggactgtggctccgcccgggctagttcgctctccagtcaggaggcggaggcagctttgagcactgattaaccagccagccagcgaagagccaactctcaggtgatgattgaccctcccggctctccgtacttcttttgggtttccattgcctactgggaaatgtagttctcggggccaggggagccggcacggaagcggctgtgcgcatgagcagatgaggcctagccgaggcggcgggacccccaagtttggaaagctcttttaacggtgagaacgcgttaacacttgccaaggggagtggttggtgcctgtgcggagctagcagccggcctgaggagggagggagaatgtgatccggtggaaattatcactatggggcgagacaaggccgagagttgtaagactgaaagagaatcccgactgggagacaggagtcctgagt

SEQ ID NO: 95136 - DNA, 1076 bp, Homo sapiens
gttcctggggtgccaggactaagggggcattgccctgtcccccggattacagtgagccacatgtcaagcccaagagccaggaggtattcttcctctcagtgttaataatcaaagcatcctgacaccagcagccagtttttatggcatcctggagggctgacctcatagagaggctaccctccttccttagtcacccaaagttgtgaactatgattgtcagttgtgtgtgggccatctgcccacttaggatgcaatttttgatgtgacagacattccggatgtccaattcccctgtgatgaggtatgagccttgtccagcccttttcctgagggaagcaatgtcagatgaaagacttagaattgcccaaactggctagccagctgccacatgcacagtattgctgataactgagaaaggttagaacatcgtgttgcattttgaatttctaccattgttggaaccaggtctagtattataagcccctgacccagcctgtgtgtgaggcctaaacaaagcctgagcacttcagctaagaccacccaccaaggtgacacctttagcctcacgcctttgataagctggcccaggtcccagtaactccattgtcagaaacagaccccatcccttctagtggtgctgctgccttttggacacagaatccagctcacagtcccctgtgtggtccccttttggccatcctgtggcttgggtagtaagaggtaagcatttggctgaggcaagttgttcattcagaataaattcacagctgcttaaattttgtcaacaggccgagcgtgttggctcatgcctgtaatcccagcactttggaaggccgaggcaggcggatcacgaggtcaggagttcaagaccagcctaaccaacatagtgaaaccccatctctactaaaaatacaaaaattagcagggtgtggtggcgcacgcctgtaattccagctactcgggagactgggacaggagaatcgcttgaacccgggaggcggaggttgcagtgagccgagatcgcacggctgcactccagcctgggcaacagggcaagactccaactcaaaaaaaaa

SEQ ID NO: 95137 - DNA, 1050 bp, Homo sapiens
gctgggtgtggtgatgcacacctgtagtctcagctacttgggaggctgaagtaggaggatcacttgagcccaggaggtggaggttgcagtgagccaagatcaggccactgcactcccgcctgggcaacagagtgagactccgtctcaaaaaataaataaataaaaagtaaaagaaaataaaactgacttcagtcaacccatcagggcacactaggtccttttggcctccagtgtcaaggacattcagtacagtgggtgggaagcgtttgtgtatatgggggtatgtggattctatcctcaagctaaaggtcagctgcctctacagatctcagagttgaagaaccatggcattctccaggctctgaccacagaagcttatgaatgggagccacgtggtaaggttcccttcagggcccttggagtctgggtgggacccaagtcagaccttcccatgcatctgctgttcatcatttgaatttctctcactccttgtctttcagaattttgtagatgtatcagtccttggggaaaaatagaatcaacactgaattaggaatcaaaagaccagagttctgatcttcctctgctagtggtttactgtgtgcctctgggcaagccatatgatctctaatattagtacctcccttatcctcaaagggatgttatgaaaatgagacacaatataggaaaagcctttgaaaagttattctacttcatctgctttgcaaggcgcttccccatactatatttaaagttcactctacttgccaagtgattatggagaaaggtacactccagcctggccaacatggtgaaaccccattgtattagtccgttttcatgctgttgataaaggcatacccaagactgggaagaaaaagaggtttaatggacttacatttccacatacctgggtaggcctcacaaacatggtggaaggcaaggaggagcaagtcacatctcacatggatggtggcaggcaaagagagagcttgtgcagggaaactcctgtttttaaaaccatcagatcttgtgagacttattcactat

SEQ ID NO: 95138 - DNA, 2929 bp, Homo sapiens
cttgtcccaggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggtcagagcccacctctaggcacccccaccctgcagcttccctcagagccagccctgcttctggctggttctcaccctgcagaagacccgggtgcctttggagccgggtccccacctttctgcccgtcttccagtgggatggggtgcagagggctctgggtctcctgtcagtccactcagatgggccgtctgggctgcaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccaggtgggtaggctggccagactgagcactccgtattggcaccatcctttataaggacggaggggcaggaggccaggaaagagggagagaagctgagaagccgtaaacccattccaagtgagatcactctgaccattggagaatgtccctatatttgtaaggactgatgccagcctccttctgccatctagacattgcctctgatgctctggagctttttccctcctcttggaagcctctgagttcactgcctgccagaccattcattaattcagtcatttatctcttcgttcagtgaatctatgatgctctctctgagccagcacagggaccataaaagctcgctctggggaggcagccaagatgggccagtcacttgccataacctgaggcaggatgtgatgagggctttaagggggacagctgccatgtgctgggggggtcttggggcagggaggggccctctagcctgagccgaagccagttgtcccaggaaggtgacattggactagacctataggaggggagatgccactccaggcaaagggagaaggtgagctgagccaccaaggtggggaagggtgcagacatgcacacaccaggggtctagtgagactgggacccgggctgggggacaggagcagggggagggaaattcctaagcaaggtggaaggtgagccctaggtcatgaggagattggctggctgaggagtatgggctgcgtcttgtggcgctgaagatttggggcagggagatcaatccaggagctcttggtgaggactacacgtgctgagacaaggaaggggacaggtgaacagacctcgccattaccagaaaaggagaggtgacaggggctctgcctggcagggcggtgggtagaagtgtgagatgctgcgctcaaggagccattcagccattcacccatccagtccttcactcagtcagtcaatatttattttgcgcctaaatccatgccgggctctgttttagcagtgggcccacagtggtgagcaaagccaaacaaaaccttcatgtcctaatgaagctcactttctagtaggtggagataggtggttaagagacgtttaaacataggagatatgtgatgggaagaaaaataaagaggtgctgggcgtggctgctcacgcctgtaatcccagcactttgggaggccgaggtgggcagatcacctgaggtcgggagttcgagaccagcctgaccaacatggagaaaccccatctctactaaaaatataaaattagccgggcctggtggcacatgcctgtaatcccagctactcggcaggctgatgcaggaggatctcttgaacccaggaggtggaggttgcggtgagctgagattgtaccattgcactccagcctgggcaacaagagcgaaactccatctcaaaaaaaaaaaaaaaaaagaaaaagaaagaggcttgagcccagcggtttgtaaccagcctgggcaacatagtgggaccccatttctacaaaaaattaagaaattagccaggcatggtggcaagtgcttatagtctcagctgcttagaagctaaggtgcaacgattgcttgagcccatgacgtcaaggctgcagtgagccatgatcacgtctttgcactccagcctggatgacagagtgagaccctgtctcgaaaaaaagaaaggaagacagatggcaggtgggcagagaaacagttgcagtgggtggtcgtgggcattttcagagagccctctgtgctgtgctctgccttcctggttgtcctgcctcagggacagttcagagaggagagagggagagctgtgcgcccttctctgagctggggagcaggacacaggcatctggctctgacccggactttcctgcttccttgcagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggttgggggacattggagtgggtggctgggagcctctgcttgaaagtggccaagagaggtggtgatgagctgagggctgagagtggccggtggagggtggcaggggccatctggtgtactgcctagggctgtggccagctcacagggtgcccctctgggtagatgctcgtcctcgaggctgagcagcctggctggtggggtgggctggactcagccctcactcacctcacctctgctgggtgccctagtgcagggcgcagtttgccccaccagaagcagtggccctgggcatgatgggctgggaagttccagggcaggggtccctataaacctggcctgccctggcccctgcaggtcctgggccccaagcct

SEQ ID NO: 95139 - DNA, 2076 bp, Homo sapiens
gctgagtgtgaggaacagtgattcccattgatccttgttccctccgtgggtcacagagtccagaacttaagagccacccaaggtatgcgctgttgtgaccaaaatctatgaagctttccagcgctggggctggggatggaaataggagagtgctctgtggtttaactttctttcctcctgtggagaaaccgggagctaggggagtggccaggcacatttctacctcaggtgctgatggcacattgcaaactaaagggaagagaaagaagtctgggtttatcgagcatgtattatttgctcattaatcataggatctcatttcatcttcacatttaactgtatgcacgtgttacagattggggcacagggaggctccaggaggttaagtcacttgcacagctagtaaggagccaaattgtctagctcttatcactctaccaggttaaccgcccagcctgtggttttgtggggactaggccctactgggattctcacccagactatccttttttttcttttttaaacttttaagttcaggggtacatgtgcatgtttgttatataggtaaactcgtgtcatggggctttgttgtacagattattttgtctccccggtattaagcctagtacccattagttattttcctgaatctctccctcctcccaccctccaccaaactaccctattattattgttattattattattttttgagactgagtcttgcccagtcacccaggctggagtgcaatggcgcaatctcggctcactgcaacctctgcctcccgggttcaagcgattctcctgcctcagcctcctgaatagctgagattacaggcatgcgccaccacccccggctaattttttgtgtctttagtagagatggcggtttaaccatgctggccaggctggtctcgaactcctgacctcatgatccacccgccttggcctcccaaagtgctgggattacaggcgtgagccaccgcgcccggcccatattaccctatttttaagcctggcagtttggccatggagacacttggatgctagctacaggccatgttctttggggagaagatttaacttcccgtcttgctctagtgaaattttatcaatttcgtttcaatgagaaacattcatccagtattgctttttttttttttgagatggagtcttgctttgtctcccaggctggagtgcagtggcgccatctcggctctctgcagcctccgcctcctgggttcaagtgattcttctgcctcagtcgctccagtagctaggattacaggcacccatgaccatgcccggctaatttttgtatttttagtagagacagggtttcaccatgttggccaggctggtcttgaactcctgacctcaggtaatctgcctgcctcagtctcccaaagtgctgggattaccggagacagccaccatgcccagcctatccagtactgtattttctccagacttttcccacgcagtcaaataatgaggttttgtttgaaggtctgctaattaggaagatttgttccagattttgctccagggtccccaggccttgaccctgaacctggagccttgtctcaagccagcctgctgaccaatacctttccaggacaggccggctaggttctgggcagaggaactacgcttgtgtggctgcataactgggtgctcactttctcctggagcctcatactgagtccgctcatccttcccccagggattcagaagggaatgggagcctcccttgcaggggcttccactccctgtgtgtttgtgggcagtctcttgtgctctcaggacctcggtgtcctccagaaagccagcgagttggaggagacaagctctagggtctagtgactgtgatgtaggcaggatagttgccctgggtcaacccaggatgggctgtctctcagagggcccagggcccagaagtcatgatgataaacatctggtgaatgagaagcagaccaaagggtagagacctgagaggcatcagcatggcatgcggaagatggtgaagaatgttttatggcctcagccattccctgagaactgagcttagccagg

SEQ ID NO: 95140 - DNA, 1079 bp, Homo sapiens
aggcagcgccaaggtccggctggctgcggccggccggtggtggggcccgcgcgggtcgtcctcgtccgccgggtgatggaagagcggcgaccgcgcgctttcctcgtggcgccgccagggcctggcgcgtggccgccgctcctcttccccctcccctctccacccttcccttcccccctcccttttcattcggtcgcgcgcctaggcatgcggaaggttccagaaaacgtgaagggcgggggctgtggtcgctagtgagttctggccgggaagggagggcactgttaacccctcccggccctgccgtctgacaaacctggagtgggcgacccgccccgcgtgctcgcgtccggccctcgggagcgcgcgccccgcattgcagcggcgaccacgtgtttgccgcatgtggtatctgggcgagggggagccgtgagcctccccggctgtcctggccctcagtttgaggggtggggggcctatgccttgggacgtcgtctggctccactgcctcagtggttaggtcttgactacacactggagaatacgcacatgcccttcggcggatatggccttgcctccaaggtgacggcctctgactaaatatagctcatgtccaagaaggcagtccttatttggaccccttgtgaaaaggatgggaagcatgaattaggagctgccattgctttgggttcgcatttaaagtcttcggtgcagggttttacttgaggctttgtccgctcaaccgccattatggggatcaattggcacgtgaaggaggagtaaagctatatttccaggaactgaaaatctcagcctgagcatatcggctagtaaagatgattatttggctcttttggctgtttctgcccttaggatgaccgcagtagttatctatctggtggctttagggtctggtcagtttactgtgcccatgatgaaatcccacaagtaacttagtggtatgagaggacaaacccaggatcttgatgagtgctgaaggttagctgttacaccagttagtagtagaccgaagttcagagcctgcagtctggcttccacattatgtttggattctgttt

SEQ ID NO: 95141 - DNA, 4995 bp, Homo sapiens
aattggtgttccttaagattagggaaactggcctacctgtggcctcagttctaccagactcccaggtgcagaggggtttggtacagttgtggaagtgaatatgatatagggcaaattctgttctttaaaggatataggactaacagttcacctttctggtgattagatttataatgcaaactttgaattttaggaggaaagtgcaaacacaatgaattaagatgtattaagcatgttttttaaaatctccaaagattttacagatagtaacagggagggagcttgcatacatacatacatactttgtttaaagttaaagaaactgagccaggaatttctcttttccagataagatttgtgaccaaatcagtgatgctgtccttgatgcccaccttcagcaggatcctgatgccaaagtagcttgtggtaggttcagaatgtgcttatcaactggtggaaagatagcataaaaattatttttatagaagtgatgtttgagttgaatgtctctttttattagaaactgttgctaaaactggaatgatccttcttgctggggaaattacatccagagctgctgttgactaccagaaagtggttcgtgaagctgttaaacacattggatatgatgattcttccaaaggtgtgttttaatgattttgctcatttttttctaggtaacagctgtgaggtttgaagaaactcctagaatgttcctgctaatcctaaactccagttgtatcttactatacactaagccctattctgttcattctctaaaaggtccgatggtttaggtatatttgatttcttcagcagtgtttagaattccagataattgctgtaaacagcaggtatttctaggacgtaaacaagatgttgtgttttttgcttataggttttgactacaagacttgtaacgtgctggtagccttggagcaacagtcaccagatattgctcaaggtgttcatcttgacagaaatgaagaagacattggtgctggagaccaggtatcttggtgtagaggctgttttaatctcttctaacattaaattctggagcttgatcacattggtgacttttctttctttagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagtaagtgatgatcataaagcttggttgtctcatttattacatcagcacagaagatccataattttgataatagctaactggaaaaaatagcatttgttttcctatattgtaacttcaggtagagaaacaaatacaaagttattgtttggtgtgatgttctgatgacctgtgttgccttcaaggttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcaggtaatgtcattttgttgcatttttctggatttttgatggttacttaaaattttggctactacatttttttcaggctttctgaaacctacatgtgaatcatcggaggatatttgctgaatgaattcagaataggcaacctaatccacttggaaagcactaggcgtaaagtaacttaaatcctgtaatttcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtatatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcaggtaaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctaccttaactgtgtctgttactcatttgttaaagtgctttggggccataggtacgtgcctataatcccaacactttgaaaggctgaggtaggaggatcactttaacatagaagttggaggctgtagcgaaccattatcaagccactgcactccagcctgggtgactgagactttggctcttaaaaaatgctatcatatgaataacctgagaatactatatgtgtatctttaaccttgaattgtaatccataattagccataattcaggaaaataacctcaatccctagacccagtgggtgggcattttttaaaagcctaagcaagatttagtcctcctagtccacttaagccaaaattcatgtgtccttattgcagcagccattcaatgccatttttaagttttcaactaaggttgagggcttcaaaccattgaaggcataaaaaccgctaaaagta

SEQ ID NO: 95142 - DNA, 1763 bp, Homo sapiens
ataataccttgaatgaattagagattttccaccaaactccatttggcctcctcagtggtgggggagggtggcaatctgcttgacaactaacatgtcggccctgtcctggtctatccctaactagatgctaatacaaaggttgaaaatacagatataggtagtaatgaaaacagatttggctgggcacggtggctcacacctgtaatcccagccctttgggaggccaaggcaggtggatacttaaggtcatgagtttgagaccagcctggccaatgtgggaaaccatgtctctactaaaaatacaaaaattagttgggcgtggtggtgggcacctgtagtcccagctacatgggaggctgaagtggaagaatcgtttaaacccaggaggtggtggctgcagtaagccaagattgtgccactgaactccagcctgggtgatagagtgaaaccctgtctttaaaaaaaaatagattcaagaggtatccaggaggtaaaattgatgggacttggcaattttaagaaatgcaaggaaaaaggaagagtcaaggctgatgacctagagataacagcttggctaaggtacagagctgccattcaataataaagaataaggaagtctgagttggggatgaatgtaagttctgtttaggatgaactgagcttgatagccctgtgggatatccaggtggaacttagacctatacgtctagggcacaggaaagaaacctagcatcgttggaaatcctggagtagacacaatcatctgaagtatgtatactgaaaaagcagttgcttaggaaagaacccccggaacactgtccaaggaggagtgggggagagtatgggaagagaagcctgcaaagagatgcaatcatttacagaagttactgagactgccaatttactaccggtctctgctacaagtccatgagctcccaaagcagggatcctttttcataaccctgcattctcgcttcctagctcagtgccaaccctttgaattttcactgaactgaggagcttcctgagttacccttgtataccccaacctacaaaatgtctaagcattccctaatcccttactaaatttagttaattcttactttacctccccttctgctcaccaaaggctagaataataccaaatactaagcttatttttagagaaaatctagcaatcatctagatttccttatttaactttgatgctgctattctgactgctctcataactgctagtgaaacactgggtgtatatagataataggaacaaagaaggaaccaaaattgcaatgaagataaattactttgtgtgcatttacaacctgaccaccatccaattatacttttaattaagaaaacatgttttaagctgcattatttcagattatcagtgattctgaaaattacaagtggcagggtgcaggaccttaagtcaaatagacgttaagttcaaaccatcagtccattcgtcactagctgtatgtcttcgggcaaattattttacctctcagcctaatgtaataatgcaggtaacactgctcacgcggtgtgttgcacatagcaaacacttgggaacagttagctattcatcgtggtacattaaattgcttttccccaagagccactttatttatttattttgagacgaagtcttgctctgttgcccaggagtgcagtggctcgatctcggctcactgcaacctccacctcctgggcccaagcgattctcatgcctcagcctcctgggtagttggattaca

SEQ ID NO: 95143 - DNA, 1061 bp, Homo sapiens
agagagtgatccatctcagtgattcctcttttttctgtcttccgggcagaaacagggcctctacccccagagctgcagcctctgttggaaggggaagtaaaagggggccctgagccaacacctctggttcagacctttcttagacgccaacaaaggctccaggagattgaacgccggcgaaatactcctttccatgagcgattcttccgcttcttgttgcgaaagctctatgtctttcgccgcaggtaagttcacaacaatatttgtcattgccatcatatgttggcaagcttggtaactttcccctggggagagtaactctagagactgtcatacaggaaaggacagtttagctctaggtatcttttcctgccattcttcttgatttactggaagaataagtggcctatatctgatggcctgctttcttgttctgcctcagcttatctccagcctctctgtgggctgttcctaccctatcctggaatcctctaccagactgtataaagagtggtgtacccttccagctgggagatggagggtcacttggggggagattcccatatatgcctgtgtgggaggagtgaggaccaggtgccttctaagggctttagctgaaattcttctggtgaaacaggagtttgaacttggtcggctttttcctgtttttcagcttcctgatgacttgtatctcacttcgaaatctgatattaggccgtccttccctggagcagctggcccaggaggtgacttatgcaaacttgagaccctttgaggcagttggagaactgaatccctcaaacacggattcttcacattctaatcctcctgagtcaaatcctgatcctgtccactcagagttctgaagggggccagatgttgggtgcagatgtagaagcagccagtcacagacccattctatgcaatggacatttatttgaaaaaaattctcaaaagttttttttttttttttgggggggcggggttctaaagctgtttttaactccgagattacaacttagaggaaccaaggaaataaagcaaataagatttaacaaccc

SEQ ID NO: 95144 - DNA, 1070 bp, Homo sapiens
gattctctcgctttagcttcccaaaatgttggtattataggtatgaactactgagcctggcctgttcacattttaaagataaagaagctaagtattattgacgagtgaagaatttgcctaaggtcagctagcagttaagaaacagaagtgagtccaggtgttcatgactgcagagtccagtgctcttgaccacagtgtaagctgcccctttcccagcttctacttcttgaaaacttgctttgcttctgcttccccagagtacatctggtgttagtagcctgggtctaatcagttctcttccagaatacaagctgttagcaggaaccctcttatactggatcctggcacccaggtctatgaaatgttagtttatgttgtgtgttactctgctgttgagggttttcatttttttttaaagataatacaccgcatatttatttacacatacatagcttttcaaacactccatcaaattcctcccctttttcagtaattttctagtattgtagtccttttttcctgatttgatccattagaacaaactcaactgggagctaacaagaaatactgaactttttgctgttataacttagtagcaatatttcttctatgacttgtataatcatgttagaatttgctcatataattctaaaaggtctcagaataaccagggaggatatgggagatgtgcccaggatagataggattatcgtgtataaaaggaaggatggagatgtagctgcattaagcagctcccccctcaatgtttacctccctcggtgtaggtctgtggacggtctgctgaatgcccataggaggaatgcccacgtgcccctttggaactatgcagtgctccgtggccaggtacagcattttaggacagagggaggagctccttgacagccatgtggtcagcatggccatcccactgccagactacactctccgctgcctccctggatcttctgtttttagtttttaccctttgctggaaagctaggctggcttctcattttttccaatcccttaatctctgaattatcttatttgtcaaggaaagactagagctt

SEQ ID NO: 95145 - DNA, 1121 bp, Homo sapiens
ttaggcaaagctgccccccaggctgggaaatccaagagttagtctcatctctgtaagttggaccccagtgaggaccccagctgagtggaaggctggaggccaaaaaccggtaccactgaggttcccagacggagagggaagttggagcagtgatatagggagcaggatcaggccaggaggcagaactggcctgaccagtcagaggcccaaagaggaagatctgagcttctcagtttggggatagaggggttaggcagagactatgatgtgtgctgcttcaaaattacctttctagcctgtagggtaggtctcctccctgtgtgttccagccaggtagcttggttacccattctttgctgccttcttaggccagtgggaaaccttagggcagctgtgcattgattgggtagacgccattctggagcaggtgagaaaagaatcagctttgtgggagggtggggtcctgggaagatcccaccttgggacagcttagaggaagctgaggtgctggaagccgggacttacctaggtcctaggccctgccttgacgtgcaaggggaggagcctgtgagacttaaggtgtgccgcactcaccccgaaggccagaccttcactccgcacacatcatacccttacacgaaggatgctgttactctcatgctgtacccacctacagggggagaaggaggcttctagatctcaggggcagatgagggccaggtgggggcctcatgcagccctgacctcgggcttggtgtccaggcaggaatagagttggagcggtgccagcagcaggcgaacgaggtgacggaaattatgcgtaacaacttcggcaaggtcctggagcgtggtgtgaagctggccgaactgcagcagcgttcagaccaactcctggatatggtgtgaggcctgggggagcatggaggggaggggagaggattgggaaagtctctcttgggctgtattcaggatctccagttccttggtggggttgaggccttcttgagggccagtgtggggcctctgggtttcctcaggcacccatagcctagacatgcaacagatagaccccacaagataagaaggccttggtttgaagctgtggaccttcttaaaggtag

SEQ ID NO: 95146 - DNA, 2081 bp, Homo sapiens
gtccggcggggatccggacagcgcatccggaagcgccatgggccaacgctcgcaggaacctgaacccctgggccagcgccgcctttgctcgcagaggcctctagcatctgtactgtcgaagccctctgagcttcagggcagactgaagagccttacacaccagacacttggacgcgatcgcgccagaaatccccgggaattcagtcttggctccgactccaaaacaaatgattcctcaccagccagatctccatcattggcgttagtctctggtcacctgacttgttcaagccaatgagagggggccgaattagtacttccgctttccgtgctgtttaacgagccactatgcccgtccctcggatactctgattggccagcctctctcagctcgtcagtttattggccagcgccgctaggccgctatcgagcagggtccgagggctgtgtcagaaggctgggcagccatggcgtcctatttcgatgaacacgactgcgagccgtcggaccctgagcaggagacgcgaaccaacatgctgctggagctcgcaaggtgggtgcgcggggcttggggatagggtccaaccagcaggtttctgggctggggctggctggagaaggcggattaccaggggcagcggattctggggaggacagatgagtaatctggagtgttagtacgggcggcgagactgaggggtgtggggatgagcatctcgataatttgggccgtccgttgggccggcctggggcaaggggattgcgggaaagattggagctggagagtggtgggcgtgggggcggaaggacagcaggctctgggaggtctcagagaaggtgaggcatgggggcggggttggggccgtgtgctgtgagtgggtatattcatcagtaacagcaggcactgctgttactggacctggaatctggcttggtcttggaatctgggctctaccaggttattcagcgtagcctgagtaacttctctgaatctgttgcctcatgtgtaaaatgggaataaacactttacgtgctggggcggtctgatagcagttgtaaactatttcccatcgtgctttttatctagtgagcatctactaactactaagggtagctattattcctactagctgggcagcgtgtttattaatgtccagtggattatggggacaaagaaaaagcatagttttcctttgttctgactttacatccccttccccaggtcacttttcaataggatggactttgaagacttggggttggtagtagattgggaccaccacctgcctccaccagctgccaagactgtggttgagaacctccccaggacagtcatcagaggctctcaggctggtgaggacactgattctttctgctatttgggccagacccaccccttccccaagccagactgtggtctggtccttcagttttccaggtcaggtgggggcaagtgtccttcaggagtgggagcttgggaggcagagcctgtagcagctctcctgatcagcactccttcctaaagagctcaagtgccccgtgtgtcttttggaatttgaggaggaggagactgccattgagatgccttgccatcaccttttccattccagctgcattctgccctggctaagcaaggtactgcttctcttcttctagctctcaccgtgccctgggcccagtactcaagcttctttctgttcatggactgctgggggatggaagaagagtggcagttgggagcaggggagggtggttatcagcttatgaagatcagaccaaggctagaacactactctacttttctcagacaaattcctgtcccttgtgccgctatgagctgcccactgatgacgacacttatgaggagcacagacgagataaggtaggggctgatgcttaagtggaggggtcgtaatgggctccctgagtcctgtccccgctgccatcacttcccacctcagcaggactgggtaggcctcagaatccctggctctggctgtcttcttagtgactttgatttgtggtgagagcctcagcaatgcagacgccagaggcctgaaaacagagccagccccataata

SEQ ID NO: 95147 - DNA, 1048 bp, Homo sapiens
tgaggcaggagaattgcttgaacctgggaggcagaagttgcagtgagctgagatcatgccattgcactctagcctgggcaacaagagcaaaactccgtctcaaaaaaaaaaaaaaaaaaagctgataaactagcctgcaccctcctcccactgcaatgtctagttaactttgtaatcccacaggttttctttttgctccattgagaaagccacttttaatattttaaagttgctctctgtaccacccccaccttccccccatgcctcctaaggaatcaaagttcaaaccagactctgagtgggggatgggtgagattatcagaccaagttagttctttagattgcttagaggcccagaagggtttcaagccctttgaaggggtatttgggtggcacctggcatcctttgtttctggcaacagagtgcactcagcactcctggggggcaagggcttcctcccatccttggcttatggaaagccatcccagatcaggccccccaactctccagaacaggctacaaacatgcaaattagaattcttttaatataaaaaaaagtactaaaatacccacgtggttctgctgtgttatttgccctaaaggaagtgaggggcagagtgaagaatcccagtgcagctcagtgggcccagaaatgggcctttccgtaggctaaggcgtgcccactccacctccaccagacttctatcccctctgctgttcccagcccccaattcctgcagcaggaaaccccagtggtctggctttggcactgggagtagaaggcacctgaagggctggctgggtgagtgaggacaggtgacctttaaaaacaaaacgacaccgtggggtggggaagcaggtcatgcagctgtggcagctggcagggcccactcctccatggcacaggtgggcatgggatggccacttctccagaagtgaggaagcccagatcccaacagaatactttctcaaaattgtttttggtacgaaataaatggaaagaagatatggggtggggtgctgtggaggccgggccagccaccctcc

SEQ ID NO: 95148 - DNA, 1457 bp, Homo sapiens
agggagagaggagattcattgaaggaggggtggagaggtggggccatggccacatcaccaactggcccttctctgggcccaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtatcctttcaggacggggcagccaggaactcatcctctagctcaacctttctccctcccaagaggatggggggtggaggcctaacactgccatgtgggggagaggactaacacctctccctttggagaggtgaggcctgagactgcagaaggggtgttgccaggtttccgtatgtcctactgaacatttccttagcctcgttttaggtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtattttagtacttttttttatattaaaagaattctaatttgcatgtttgtagcctgttctggagagttggggggcctgatctgggatggctttccataagccaaggatgggaggaagcccttgccccccaggagtgctgagtgcactctgttgccagaaacaaaggatgccaggtgccacccaaataccccttcaaagggcttgaaacccttctgggcctctaagcaatctaaagaactaacttggtctgataatctcaccc

SEQ ID NO: 95149 - DNA, 1670 bp, Homo sapiens
ttaacagctttatagcccatcctcattgcttactgccacccctcagctggggtccaaggcagtactattcagtttattcaccagacctgcctccagacatctacttctttcaaaaattagtgttttccatcaaggagcatgttccagagcatttcccagagatgtcccaaagaacactgtccggtgctgtggcgtacagtggcaacagcattagactaagtggaacatcccagcaggctgctttagaatccgctcatttgactagatacgatgtaattggctgtctttaaaaaacgcgcacacacacacaatctgataggcatatctcatgcccattcaatatggaatgttcttcgcttgctgaatttaagcctgtattttaaggttttgtggttcctcggccacaatgggtgatgtcactgatagaacgaagctgagtttccaagggtttggggctgtgcaagagtaaacactagagcttgagttgttatccagctggcaagcacggaagtctttgaagaatgtaatgtaaaaagggaaaagaatgtaaagctttttgtaccaaatgagagttggagcccagccaacaaatgcttttccctgtgtaaaagtctctctggaagggacattccatctccatggtgcactctgaggggcactgtcaactagagattggccccatccaggtgggaggaacccctttgggatggtgagtatccaatctgctgtgcatttgacaggatctctgaatggctaggtaatggatcccaagcaggctcacaaatttaaatgagggctttgtgtgcagaaagaggaataagtacagattattttcctaccactagatttttggggagagtcaccatggaatgttgacaattacttaaaatattttaagctcccttgctgaattcctgtcctgtccctgaggaatcagatggtcatacagccataggcacccacccgaaatttccctaggagttggagtaatgctagaattgaagaccttctgagtaaagggcttctctgccttctcagaggcaggagaatttgcactggttgtgttaaatgtataaaaagctatatgttcaccagtttactcatttccaatgtgtagatgaataaaatgtagtgtacaaattatttgaaaatcccagaaggaaggtacttttcaaatacagtattttttttaacaaataaacttacgatttttacagcactgtttttgccaagagttgtgaaataacttgtgtacttggggaagtggaggttaaatacctgccctaaagtcattccaccaccgagtcagcactggaaatctcatctcttgctttgccacactattttaagagctgtccctgttggaacataacaactagacagactcatgtagcattagagttggaaggtctttttaaagacatctggtcctacttcttacatgatacacaattccccctaccaactacctatgaagagcccttctgtcatacggagctccatcctgggataattctattttaggaactattagattgtcatactaagccaaaagctgcctcatgtcccggatctggactactatgccttgcccccacatcatgttagaacttgagtagtcctctcaggccttcatcttgattggatagggactcaaacccagctcaaga

SEQ ID NO: 95150 - DNA, 1482 bp, Homo sapiens
caaatgaggtaaaaacagctgggcacagtggtttacacacctaatcctagcattttgggaggccgaggaggaggattgtttaaagtcaagagttcaagacccacctggctaacatagcaagaccctgtctcaaaaaaagagataaaaactgtattctttgctctcgtaaggagcttataaggagtcaaggttgacatgtaaaacaaccagtgagttctgttagatcataaagattactgctggactgtggcacggagtaaaaataagtgcaataggagttgaatgtgcaaaaatcaatgttagctggagtgtttatgttgagttcatggaagagctgaggtgggacttgaattggcaggacatagaatttgaatggttaagggagagagattctagaaaggagtagcaacatgaaaaaagttacatagataaagcattgtcctgaatatgggcatttggaaatccaggactgagtgatgatggactgtcataggatatgtatgtatttatgtttatgtgtatttatgcacacatatatgcatagatatttctagtttcatgtatataggaaactatgtatgaatatatagttatatgtattatatatagatatatatataggttatatatattttacatatatattaaaaaatagtgaaatttgtttccctaatcaatgtcttaggccatttagagaatgaagtaactaatgtgctagtctttcttgctaatttttttatgagagaacttcatgtggaggattcattttatgaatggcataatatttgttttttgcggatattaacatgttccggtagaaaataatgaaaggaaaagcaaacctgatctgtgtgttctagtatctgcccttctattacagcttttcacccttccctacaggccggggtttgaagtctcacgcctacattcacagtgtccagtttagccaccatgttttcctcaacctccacaccctcaagttttactgccttccagacaactatgagatcatcgattcctcattggaggatatcacggtgtgtgtctaagagggttggtttggggtccattctttaatgagccatcccagggctcccaggggactgccccacctgaggacagggaagaatctcagtccctttaggcatcgagaggctgctttctcttttgggaagaactggggaaactgagtaaggtcagaattcataattgcagcctgtagtctgtaacttaactgtcatttctacttgtaacattgagggctaggactgaagaaatatgggtgtattctgatggggtttaaagtgtttttgtgaaattattcttctacactgtgaagtagggatatgaattggtcctggtgtaggacagtatttaccaagctgcacaccggctcctggctgcttttaacatacgccgtggccagagcatccagccacagatatcttatctgtgggctctagtttgtgacctgtgccaaga

SEQ ID NO: 95151 - DNA, 2183 bp, Homo sapiens
atgagaccccgtttctactagaaatacaaaattagccgggcatgatggcacatgcctgtaatcccagctacttgggaggctgaggcaggagagttgcttgaatctgggagggggaggttgcagtgagccaagatcatgccatggcactctagtctaggcaacaagagcaaaactccatctaaaaaaaaaaaaaaaagttatggtcagtatttatagagggaaaaactgggctaaattcagtgtttcaaagtgagtttgcgatgatctctgtccagtctgtgacataatgactgtggtaactctgtgcctgggaagagtctgatcctgctcttccagtaccagggactcatggagatcctcattcccacccagagtggaggaaactctcctgctccaaagctaggtccatgtgctgctcccaggaggttctatctgagacttagactgcctttaggaacttgagtattgtatggtttctggcagtcagttttcatgagttgaccagacctgaggtcggcgaaaagacctgggattcagtgattttgggatagacacagagatccccttgtagattagccatgggagaggatctactccgtgttacttcaatctttacacctactggttcggactatttttctgtgtgtggtgggatgttcatggccaagtgttttttgtttttgtagaaattactgttacagacatttcttgtgaactcagctcttaaacaacttagcattttcttttgctttgcagtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggtaagatcaagacgggaacattgaggaagagaaggacacccagaaggctgagcacagtggctcacccctgtaatcccagcactttgggaggccaaggcaggcggattgcctgaggtcaagagtttgagccagcctggccaacatggagaaaccctgtctctactaaaaatacaaaaattagctagatatggtggtggaagcctgtagtcccagctatttggcaggctgaggtgggagaatcgcttgaatccgggaggcagaggttatagtgacccgagatcgcgccactgcactccagcctggggaacagtgagactctgtttcaagaaaaaaaaaagagagggacaggaaatagtatgtgtactggccaagaaattactgccttcggccaggcgcagtggctcatacctgtaatcccagcactttgggaggccaaggcgggaggatcacctgaggtcaggagttcgagactagcttggccaacatggagaaaccccatctctactaaaaatacaaaattagccgggcttggtggtgcatgcctgtaatctcagctattcgggaggctgaggcaggagaatcacttgaacccaggaggcggaggttgcagtgagctgagatcacgtcactgcactccagcctgggcaagaagagcgaaactcctccgtctcaaaaaaagaaattactgccttcttgtagagtatagtcagatgatcctcagacaccaagtcttgctaaggactctacttgagtaattgttctgcaacaggcagagcattcctttgctcactgggctgctgtcaaatggtgaggctttttctagcctctggctcatggcatctggaacttcagggaatgagggaccgaatctgtgttgccttgcagtatcaagtaagaaacatgccagatgcatttttttaaaaaaatggtgtagatatttgttgtgctggctgatcaatgactttttcctgcccatgtgctcataaccctgaaattggaaaggcagaaaaccaaagctgtcctattttctttttttttttttttgagacggagtctcagtctgttgcccaggctggagtgtagtggcgcaatctcagctcactgcaacctctgcctcccaggttcaagcgattctcctgcttcagcctcccgagtagctgggattacaggcgcctgccactgtgcctggctaagttttgtagagacagggttgtagtagagttttagtagttttagttttagagacagggtttcaccattttggccaggctggt

SEQ ID NO: 95152 - DNA, 1063 bp, Homo sapiens
ttagtggtgatttctgagattttggtcacccatcacccaagcagtgtatactgtacccagtgtgtagtcttttatccctcaccaccccccacactctttcccccaagtccccaaagatcattgtattgttcttacacctttgcgtcctcacagctccctatatttacttttatgtacaattatatggttttagtatgggaaaacatcacattttaagataattttcatattattttagtgtggagttgagagatgggagaactgtgtttcctaggtagttatttttgcttcaaccaaaatggatgatgaaggaaagagtatttggattatagccttctgccttatgaatttaagtattgtcacagcataattagagtaacaaaaggaaattgttgaataagttgatagagatttgaatacctgtgttttgttttgttttgttttaaccttctttgtggtatccacatcagcaaagttgtctgcagaactgtagttcgtatgaaactcaacgttaatgatatttctgtgatgtgagcctgggtaggattctccaagggtccatttacttttggctctttaaggccatcacaggcacatcacaaattctattaggagaactttaattggaagagcttggctcaaggggtcctacaaaggggctttgggttaatcggagtgtttgatttttaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggtaagaacaagtcattcatgtttcaggacaacaaaactagtttgatgaacaaatttatttccacttggcagtgaatttttttttttgagatggagtctcactctgtcacccaggctggagtacaatggcatggtctcagctcactgc

SEQ ID NO: 95153 - DNA, 1031 bp, Homo sapiens
ctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaactctcgtagtctggttaatttgggtgcttatgtctatgaatctacccaaaacctccttcttggatgctgctgctaggcggagacctctctgtggatgccagtagtgagggacaga

SEQ ID NO: 95154 - DNA, 1035 bp, Homo sapiens
cctggccctcttccagtggttcttgcacatgggcaggttggagaattcctggtagagacagtggtgagggtgtttataatttaaactgaacaaatactaggagctagtgggagatttgttgggtgcggtctcagcaccggcacttcctcagtgcttttgatttcatgggtgaaatttcacactcctgagagacaaatgagaccctgccccccagttgaaatcggaaagtaccatacagtgggagtatttttccttttggtggcgggaatggagtgagatggttataaagaggccctgctgcagttgtgtcaatccaggagtgggtgctttcctcctatgtctgtgtacagctgtacactctgcatggatgggccagacctaattaagagtcgcatgaaaatggtgatcattgcttaatgggaatatccagattgtgaccaaaattgctgttactgaggttgttcacccaccttgttctccagacatgaacttgcatagcttttggctagttccagaaattagacttacttagatggatataagcctttttgagggtattcaaaagcatataaaaatcaaggaatactctaaagagctccaaaaatgctttggtcagtggttcccttgttggaataaattcatggcattccagaagggcagctatggaggagatggccctcacttggtcatattccttttgtctttattggtcacattactttatagtctcacccattatattcaaatacatttcagaggtcagctgtcgaggagtgtatgcacatgtatagacatatgcacaaactagctgtctgtgaaactaatgggacgtattcaacttttcacgtaaactccatgtgatgacaaatttgtatttccaaagctgattctatatcagtcatcatggtcttctggattttctattgggcagaagttctagttggaagatgaagcatatatgaaacgacttcatgggactaggaaatagagtaagtgagagaggatgcgaggtgagggcagtttcagcacttaata

SEQ ID NO: 95155 - DNA, 1031 bp, Homo sapiens
aatctgacatggatacagtcaagatgtagaacatctccatcctcacaagagtccttcgtgttgcccttttatagccatatctacctatctacctccccttccacaacccctgacactcactagtctgttctccctttctataattttgtcattttaagaatgttaaaaatcagccgggtgcagtggctcatgcatgtaatcccagcactttgggaggccgaggcaggtgaatcacgaggtcaggagttcgacaccagcctgactaacagggtgaaaccctgtctctactaaaaatacaaaaattagcctggcatggtggcatgcgcctgtaatcccagccactcaggaggctaaggcaggacagtcactcgaacccaggaggcagaggttgcagtgagctgagatcacgccactgcactccagcctgggcaacagagcaagactccgtctcagaaaaaaaaaaaaaagaatgttgagaatcatacagtatgtaacattttggtatcagctcagcatagttccctctagattcacccactttgttgcatgtaacaacagttcattcttctttattgccagttactattccatggtatggatgcaacatataaaggctctttgaaaaccataatccatcctcctaactctctcctctctttttccccactgccctcttcgcctctcttcacagcaatgccaagtgagtacacctatgtgaaactgagaagtgattgctcgaggccttccctgcaatggtacacccgagctcaaagcaagatgagaaggcccagcttgttattaaaagacatcctcaagtaagtaccgcccctgggactgtagatccccctgctttgggtcaactgtgtagaactaggagaaaaattcagtgagagccctcaagatggctaatgttggagaggcatgcttggtcaaaggatgcctcagacattcaaaggcacgtctgagtaaagactgagtgcacagccggagtgagcctgtacagctggctgtatttggtaagtgcacagtgc

SEQ ID NO: 95156 - DNA, 1047 bp, Homo sapiens
gtggcaatgaatgctatgaagtaaagcaggaaagtgagggggtggaagtcgtgttttacagagggtggtcaaggaaggcaacttttgaatgaaaaccagaacggagatggtggggagggagccatccagagaggcagcagaggaagggcaagtcgagcacgaggcccccttggttgacatggagtgaggaggagagtgtgagataggtggaagcggaactgggctctgagagtaactgccctcttgacatctttacctcttcagtaaagtcttggagaaatcccatcgtgcgtgctgggaacattatagttttagagaatgttcatatagtccaagggctcagaattaattgccttaacacttttacatttataaaaagcaggcaattgaatgacagtaatgatgtgttctcaacactagaggaatagtagatttgaagtagattaaaaagcacgagaatcactgaagtgcttgcatcttggttgatggtcaaaattagtacagtattgattgtgcgttcacacagcaacattttaatttttttcattgcagaaggtaggtcctcataactctgctcagtttgtaggagaatctgaaaatatgtaggctaaaaatctgttgttaattacacggctttcctccagctgtgagaaacttgctggtgggcaggatttctcaaagtgctgcacccacataacactggggaacttggttaacatgcacagtcagcatcctcacctggacctaccaccaggggggacattctggggatgaagtgtgggaatctgtatgctttgcagcctcttccagtggttgtttttttgttttgtttttttgttttctcctgatgctccagctaaggtccctcctggggcgtcaggcctggttcttagctgtttgtgggatttaccgacctggcagcccacaggcgtttgggactctgcaaggccaagctgaacttagtgtctccatggcattttctcctcttcatggcctctctctacagagggctcctctttcctccctgtgacctgagtcatcctctcc

SEQ ID NO: 95157 - DNA, 1126 bp, Homo sapiens
tgcaagctggggtcttccttactcagaaggcctggaggccctgccagatgctgccttccggactggctgcccgctgcagtgttttcacgggagccaagccagccccgggcctgtagcctcccatgtgacaaagtttcagacaccacagtcctcagctggaccacagtaaacacttgccttccccaacccatgattcttgcttggaaacatgaacctgatgttccacgtgcgttcagccaatcaaacctcaagaatgtgattgagcagtgaggctgcgttttgggcaagacactgagctctgaaataagacttttcttggaatctcaagccctcaacttacagtgggaccctaagaaatgcacttcagtttccttttatgtaaaatggtggtaaaattaattgtgttcattaaattgcacacaactatacatgtttacctatacactaagtggttctcaacttggggcaatttgccccccaggggacattcagcagtgtctgcggacattttttgttgctactggagggaggtgctactggcatctagggagtggaggctagagatgctgctaaactacagtccacaggacagtctccacagcaaagaattgtccagccccaaatatcaataatgccgaggttgaggaaaccctgccacatacacatagatgcgggttaacattgtttattttacaaagtggaatcatttacattttagccattctgatagatgaagcagtggcatctttttttttttttttttttttttgagacggggtctcactctgttgcccaggctggagtgcagggttgcaatcacggctcacagcagcctcgaagtcccaggaccaagcaaccctcccaccgcagccttccaagtaactgggactacaggcacacaacaccatgcccagctaattttttaatttttttgtagagacggggtttcaccatgttgcccaggctcaaactcctgagctcacacgatctgctgccttcaccttccaaagtgctgggattacaggtgtaagccactatgcccagcctcatttgtacttcagtttgcaattctctattaataaatctaagcatcttttcacatgtttattggttattctgatttgca

SEQ ID NO: 95158 - DNA, 1606 bp, Homo sapiens
agcaggatgcaggggtcagggaaagatgccccagaccacggggaagggttaagtagcgtgagcaggtggcggagctgaaggggagccccagagtctaactcccaagccatgtgctgatgtggaggcagcttggcttgtgtctgctgactgctcccgtggtcactgcttaatccctcctaattttacctcccgtttgacaggcatcgcggtcgaccctcgccatctctccctggttgctgattatatgtgcttcgagggtgtttacaagccactgaatcgctttgggatccggtcaaactcttccccgctacagcagatgacatttgaaaccagcttccagtttctgaagcaagccaccatgctgggttagtgcgtgggcaggagccctggcctcccctctactgacgactctgggcacacgggctcacccatgggcatctttccatggttccttgcacaccagtgggatcttgggatctgaggggagcgggggcggctggagggggctgaacagcagacacgacagctgcctctacgctttgaaggaacaggaagagggccttcccctctcaagtgctagaggggggctgcctcgtgatcccatcagcttcagagactcaggacccacctgagtcccgagacttcagtgttcagccccataatcacctcatgacattcccaacttctacctcaacaccctgacacatgtttttgtgtctctgtcaggatcccacgatgagctgaggtctccttctgcctgccttgtggtcgggaaggtcgtcaggggcgggacaggcctgttcgagctcaagcagcctctgagatagcagctaccccggcaccatctgcccagctccaaggacccttggtgagggcgtggcccagcctgccttctgcatgagaggaccaggagactggaatccagggcagttccaagtgacagtacagagcacagcagcgaccttgggcctgaaagcagtgggcctctgagctgggccagcttcacctggaaagtgacagagttgctcatccttgcccctccctgtctctggatttttatcaaggtttaccaagtcttctgagtccccctgagatggctggggcctcacctgtgctgcaggaggcctctgtggcataacccctaaggagaagtcctgattcacgattcactgagaagaccaaggggaagccatgctttgctgctggggaccccaggcacctccagagtagggaagcggggttcttttgctgtgagtggccagggacaacagacaagattcctgggggctcccgatgagcaggaacgtggagcctgctgcccaaggcctgctccttccggctgctccagcccctgggggcagagtccacaaagagtccccatcaagacttcttccctgagtcaagtacagcgtagcatagtcctccacccacccaacctctctgcctggccagggtcctggccctgccactgtgtggcgaggtgtccttctagaccacatcagccccaaggctgggagcagtcgctccagggccgcagcagttcactcccacacatagaacccaggtcactgctggggcgattgaacaggttgcctggcttttctct

SEQ ID NO: 95159 - DNA, 1028 bp, Homo sapiens
tgcttgggggaggtaacgtctctccttcccaggttgcagacggggtgaaggcatgttcctatatcctccccatgtgtgaagaacaggctttgcttactgctctgaccctaggctcagattcccaccaatgagagataagctgtctctgccaggtgctgagcagagatggatcaggaagcttttaagagagtcattagttccacagcatcctcctgtgcctgaaaaataaaccatttcctgagtttgcctacccgctctgctgaggccactcctaggaggttcaggccactctctggaggtgactgcaggctgtgggccccccagcagatccacaccagtatagctcaccagggtttctttggggtttggcctgtggtctcagctgctatctctgtaaacccttgggtctcgtaacccactcacattgcgcagtcacctaggacctgaacaagtcaagttctctctgtccgtctggttccaggtgttgcagaaaattgacgtccaggagtccttctgtatggaagaaaaacagaacaaattccaggtgtaccagctgcggtttcagttcctgccacatgcatattaccagcaggagaagtgcctgagacccgaggacatcctgcgcttcatggaaacaaggtcagggctcaggctgtgattgtcattgaccttgacccagagaatgcgcttgaactggggcaggaagcacctagccacaaggctcctagagattgagtgcctttgcccaaatgagcccttcaagggaagtgtttaggaagcagagggccttgcagcctgatctggaaacctgaccacagtctggcttgtgggtatgactttcttagccacacgtcactccctgagcccatttcttctcttgggttgacgtcaggattgttgtcttctggggcttgcaggcattaagacatggaaatgtgggtgtggtaaagagaagggagcaccatcaaagcggtgcttctgtggtgtcggagcagcacatgctgttaatgtttgctagggtgttactg

SEQ ID NO: 95160 - DNA, 1208 bp, Homo sapiens
ctaatttttatagcaggaggtttaaactgtctccaaattgtcataattgagaagaaagaatggataaaggaaaaagtgaataatgaacccagaaattctcctgcttagggggcttgtggtaacagtcccagagtggatatgtgacattctgggggcaaacatgaggagtccaagcatgaatgtctagagcttcagccacccagctgggatctgtgctgtgtaatttgaggacatctcagggtcactggtgggaatttgaagattagagggatcttttgcctaggaaaaacgagtccagaaagaggtagaggtttcagttttctggtttcgggcagcattgacagtctgtggtgtctgctcctgacccctgccacaacccccaccctgaccccccaccaccgtctctaggttgaggaccttgctgcagctgaagtggcagcgctcactgtgtgagccgggcgaggctgtgggcctgctggctgcccagagcatcggagagccctccacccagatgaccctcaacaccttccactttgcaggcagaggcgagatgaacgtcaccctgggcattccaaggtgtggggcacaagggagcacagggtggggtctgtcctagcctctcctggagaaggggccatttaatgagagggggtgagtgagtgtgtgtgaatgagagagtgtgtctgtgtgagagagggacagggtctcattaaagtggggatcagggttagaatttccagagcccagctggtttctttggtgcccaggcctggtaggatctccatttattcctctgccaactcctgcatccacgttcctggggatgcctgtgagactgcacactgctgggggaaggactcaggaacgtacattgttaacaagccccacacaaggtgcctggttgcccaactccaggggagccattcacatagaacgtgcccccacgtggccctgggccctggcccttcaggtaaatatatgtgctggacaaggggaatgagtgtggggtcagacccatctgcattcagtccctggccctgcctttttctagcagaaagactctggacaggtacctcactttccaaacctcagggggtccttctgtggaaggccagaggctgggacccactatacatccaggcagtgagggctggctgagctcagcaggagcactgtgggtgctagttgccttccctgcatcgcttgtt

SEQ ID NO: 95161 - DNA, 1060 bp, Homo sapiens
tttccatcctggttcctatccctgagcttggccatcactcttcccctcttcctttcttcccagaaactcccttgtgctcctggaggggctctgagtgtgctgctttctttcctgtgtctccctctgctcccaagaccattggttcccaaatctggtttgcacaaagtgagggccctgattaacaatggatgctcagcctctctgagagtggtgctcggccccatcatgagggctccacaccagccacctgggtcccctgaatttgtgctccatggccctcttgtcacgccctcatctctttgatctcatgtgtgtgatttgtttgtttgtttttttgtttgtttgtttaggtgataatgaaatcacagcatctccatgaagttttatccagagcagatcccaaaaaagctctccaccacttcagagctatcaaaaaatggcaaagcaagcaccccaacaccctgctgagaagaggcgccttcttgagttattcccagaaaattcaggaagctgtgaaagccctgaaacttgagagtgaaaaccgcaatggccgcagccctgggactcaggaggtgatgcagggaggtggtgtccttaatgtccagcacgtccaggcttagtcagtgggtgagggatgaggggctgttttcctaagagaaggtagaatcatgaactccagctttgttcaccgtcagtcagaacagaatggctctcaaatgggaatgtaaggtggggactcttaacaagggtgtaggcagggtttggggggactaactggggcctgtgacttcggggttccccgcgatcccaggtgtgaaggaatggggagcagtcatgagaaacggagaggacgactatgtgctagggccactggacagagccctgggtagagacccactagaggggggttgaggataaataccaggatccccttcctcctgcctttccctctgctgctggtgcctcccatcagccaagcacacctgggagctggaagcaggggatctctttgaagcagtcactttgggacagccttgagggcacagagcgtgtgaaagag

SEQ ID NO: 95162 - DNA, 1014 bp, Homo sapiens
tgaaaaattccccttgcatttagttaactagaacgtgagacaaaagccacaccttggtcaagctgaggtgagcacttggaaagagccgtggtgatactgacgtttgcactgatcacccacctgtccactctgttcccaggtgtgccggcatgtgaagaatggggacattctgctactgaaccgacagcccacactgcacagaccctccatccaggcccaccgtgcccgcatcctgcctgaagagaaagtgctgcggctccactatgccaactgcaaggcctataatgccgactttgatggagacgagatgaatgcccatttcccccagagtgagctgggccgggccgaggcctacgtcctggcctgcactgatcagcagtaccttgttcccaaggtaggtctggccttgaggctgttccgtggtcatcgtcagcatgacttagcacttttaagttgggccctgccagcccctggggtcattgggcagctccaggacaggggcgcctggaatggagggtcctggtttctcccaggtggggcttttagcccatctagtggcttagaggctgggaaatgtttctgttttgctgcgttgtaaaatgtaaatcaggacagaaattgtgatagccatcccagaaagccaaccttaataactgtgtgataggtcttgtgttcagcacttaaatttggattctgcaacttagtagcccccggctagcattagcatcccaacactgtaatggttctcatggtccactgatgactttgatcctttgttctgacaaacatgagttttaagaagcagcctaaccccaagggcccagaagagatcccgcagcagcccgtgaaggcatcttctgtcccctttgaatcctttccttctttctccaagttcactcctcaagggcaaccccttgtggtcacagctgtccagagggacacgagggaaggatagaacttcctcccccgtctccttagcagctgactcttggccaggagtggcaggggcctgag

SEQ ID NO: 95163 - DNA, 1061 bp, Homo sapiens
actgcatgtgagaattggttatctggcaagataacagaacttcataagaaatgtactgatgtgggaaggacttcttagttttctttaggaattgcatattaagggatttcagcaaaaatgccttaagaaagaagcatgcttataaattttgagttcatcttactactagaaagagacaggctggtaaatatataatagtgctgatatgtcttattgacatgtacttacaagattgatttattagcatgtttgtctctgatctgtcaggttcagaggagataaactccagagtgcatagttgtcagatccagggtaagaaagaaaaattaaatcaagccaggccttttggagcttttttccatcatccctgttttcttggtttcatcttccaggaaaaagactctttgattgctattgaccgatcctttttgagtacacttccaggccagtccctcatagacaaactttacaacatttggattcgccttcagagccacgtcaatattgtgtttgatagcgagatggacaaactaatgatggacaagtacccaggcattaggcaggtgagcaaaaaactggattcccattgctagctacagaagataaataataaacattgtgtattgaaacaagaaactaataagcctactggaattcttgttgaatgttttttatgaccttttttctccataaagatcctggagaagaaagaaggcctgttccgaaaacacatgatgggaaagcgagtggactacgctgcgcgctcagtcatctgcccagacatgtacatcaacaccaacgaaattggaattcccatggtgtgtgtgtgtgtgtgtgtgtgtgtgtgtgtgtgtgtgtgtgtgtgcgcgcgcgcgtgcagggctcatttgctccccgtgggtggcagatgagaatgccgcagaggactggggacaggatgtgcagcagattattctggcttgggcggaactagcttctgcctcttcctggacagcccacaaggaggtgactggaagctgcatgatggcattgctgtcactccttgctaggcttacagacac

SEQ ID NO: 95164 - DNA, 1048 bp, Homo sapiens
tttacctataaaaatacttatttatccataattcaacttatatgaacttttctggtaaaaaacaggtagataaagatatttattataatgttacttataatagcaaaatatggaaatcaatccagatgtccaattatgagaatatggttaagtgaattaggaatcatccttaatggaatatcacatagccatgaaaaatggtgatcaggcaaaagctacatagcaacatgcagacatgctgatgagatgatactaaaagggcaaagtagtgtgcaaaataaatccacactgaagattacagttgtgtaaaatacgtgtatagacaaaaaggcctggaaaacaatatataaaagtgataggagttgttaatgtgatgggattatgggtaatgttttcttttactttgcttttttttttttttaggttttatacaatagccatatggtttttattactatagaaatgagattaagggccagagggaatccaggcctgataatatgctacccttgagattgatttttgtggtcaagttgcaggcttggggataaagaattgataaatcccattgcagaaagagtacctgtttctgatttattgcactttgattctcctccttggctccaggaattgaggaagctcagataggaaaacgaggatacttaacacccaccagtgcccgcgaacacctttctgccctgtggaagaatgaaggtgctgtatcaggctaaagaaatagccttgatcttctctaggcttttatttcctggactcattaaccctgccttattacttcttttaagttgtagtgattgtagcttcctcctggaactgatccagaggtttggggcagtcttcagggcacattgacattgagtcatagagcaggagaggtcatacccagcaccaaaaacttgacaattatcgcagctgagcctggttatgaaatgacaactgcaggtgggcctcacttaatacaggttggcatatttttagaaggttcagtgtaacttattttaaatgcccgtaagtaaaatgctttgtcctt

SEQ ID NO: 95165 - DNA, 1152 bp, Homo sapiens
tgtgcctcagcctccctagtagctgggattacaggcacgcaccaccatgcccagctaatttttgtatttttacaaaaattacgggagacaggttcatcatgttggccaggctggtctcaaactcctggcctcaagtaactggcctcaagtgatctgcccaccttggcctcccaaaatgctgggattacgggcatgagccaccgcacctggctgagaagtctcttaattaaatcttggaataaaataaagatatttttctacctcaggttgtacgcccaaagtaaatttcaaatctaaatggattaaaataaaaccttaaaagaaaatagagggtaatatttatctggttcttaagataacaaaggcctttctaagcatgtaggctgaagtagagtttttaaaggaatagactgactacataaagaaacttgtgagtataccgaaaatcaccatggctactgtgtctctttctaatatcctgtttgtttttattccctctcttcagaagctgtacctgctgcttcggggctcttgtttaaactgccacatgctgacttgtccccgggccgtgattcacctcttactctgccagctgagggttctggaagtcggggccctacaagcagtctacgagcttgagagaattctgaacagggtaggtgggtagtggtggtcacagaaatcagaaaaggcaaagtggtgtggggaacaagagatgcttgtatgttgtcctagttaccatgccgatagtcatcagaacgtttgatctttatatcttataactggataccaatagctgagtgtgaaaacaggaagctataagaataataaaagaaatgttcatagaaacaatagtgaaataccatttaatccatttatgagcttttgctgattttctggaccaaggattcaatcaaggtttattcaatcaaaagacattgcttttgattgttacatctctttgatctgtcttaaagtagaacattgtaatgtagaaaattctttttcatgataccaacttttttggagactcaaagccagttgtcttataggatttcttacattttagattgtccgattatttcttgtaattagattcacattttggcaagaatacaacctacatgatacagggtactttgtattgcatca

SEQ ID NO: 95166 - DNA, 1057 bp, Homo sapiens
gagcatgttgggaaagcgtgcctcgaccttcaggaaggtggggcgcagtgggcggggagcagggaacagctccgctattggctgaagcggaagaagacgaaagcaatcataaaatgggaggttgcaagctcatggtttgaaagacttcgtcacggaagctaaaagctctatacacccgatttgcctcggaggaattttcctaaatgattattttgatgtcttatatatctttgattgttttcaaaacaaaagagcgagcagagagtcgtacaactatttgttccccccccatgtagaagtgatctcatccacgtaaatgtcgttcctgcgaccgcttccgcgcgcaagcgcacgttgaatcgcgtggtgactccgggcttgaggttgaattaagaatagtcaggtggtgagtggaacgtctcttggggtgtcggaattcaaaacggacctggaggatgttgatctccaagaacatgccctggcggcggctgcagggcatttccttcgggatgtattcggctgaagagctcaagtaaggagttggtcgggtagcgtgcccagcctggatcttgaggtcggcgccctaaactacgattcccagaagcgcttttgcccagtctatcctcttgagtccaggcttgtctggcgcttgtcctgctgggagccgtagttctgggaacgttcctgggccggcgtggactgcctggataagaggccggtggtgctgggggaaagagtttgcgctgaggtaggggaatataagggtggggagggtcctggtctgcagcgttatcatctgccagtctcctcgttaactaacaagcatttgtggaattaaccatagtgtacctgacatggttaattaggcacgtagtaagtttcctcttgtttgtaaaatgattgtccttcaagtgtcagttcaggcgttaacttctctttgctaggaccctgctatattctcggtctggttgttaaatcaagggaactctctttagtcttcattttgatcaaggtagcatttgacattctccaatgcactctcttgaaactttccttt

SEQ ID NO: 95167 - DNA, 1147 bp, Homo sapiens
agttgaaagttcttcatttcaaaccagattgttcaagtgctattaaaaactttcctccctctctgccatttatgtaatgagattgcttgcttccaaaacttttgtctagccgggcatggtggcatatgcctgtagtcctagttactcaggaggctgaagcaggagggtcacttgagcccaggagttcaagggttcagtgagctataattgcactacttcactaaaggctaggcaatggagcaagaccctgtctctaaaaaaaaaaaaaaaaaagttttgacagtcttgtccatatcttgtatccattccttaatgatattgaacatgtgtacagactgtcttctcagcgttcattgacatgagttatccagtttaatccgtgataattggagaatttgggctcaaagtacacataggtggaggtgagctgggtacttcattaatgactattagatttaaggcttttgtttttttgcagattttattctggtagtgcaaccctctcaaaggttgaaggaactgatgtaacaggtatattttaaaatatattgaattctatttttatatcaacacgttggattccattgtagtactaggaaactgattcatgttttcttttttacattagggattgaagaagtagtaattccaaaaaagaaaacttggtaagtattctatcagtgttcattcagcaaatggttgagtgcttactatgagagaagtgtaagggttaggtaaggagacagtgacaggaagagcaataggagagcattcttgaagagagtagctgagcggggagaagctaggagtttaaaggacaaaaaatggaaaggtggagaatagtgagtgaatgagcaatgagatttacttaaaagaacaattgaaagagattttgaattagtgtgggttactatttacgtggttaataatacatggttatacatgaacatcatcattagaataatttttttcaaggaagttctctcatatgattcaagagcagacagttactgtctttattatctctaatgaggtaaaaataaagtaaatggtgtggacagcaaaatttagcttttttattcactggatatatccttgaacaaattgcctcatctcatttattcaacatttgttgaatatgcaggaa

SEQ ID NO: 95168 - DNA, 1012 bp, Homo sapiens
aactgaatcaagagctaccaattaggatagtaaaggcaacagtagtcccgaaagctgcagtaagaatccataggaaagtgggtagaggaagtaggccagatagttttatgagggcgggatggaaatcactagccctgggttatggcattatgcaccaggccagagaggacaggcaaagagaggaacatgtaccaactaggggaaagaaccagcagttttcttaatttctaatttattctagtgaccttgtgacataaccagcttcagatgagatctgcactatgttattggccagtacactgagagtagaatcacttgttcggtttgtggctatgaagagccctgatgaggattaacttgtggttcttatttttagggataaagtagccgttcttcaggcacttgcatccacagtaaacagggtaagtaggattttgtgtttttttttaacctaaaacttggctaataacacactttttaactcggctaataacacatttaatactcatacctcgtcattactcagaattaaactgttgtgcgtctagaaagtttctttaaaattgtctaggccgggcgcggtggctcacgcctgtaatcccagcactttgggaggccgaggcaggtggatcacaaggtcaggagatcgagaccatcctggctaacacagtgaaaccccgtctctactgaaaatataaaaaattagccaggcgtggtggcaggcacctgtaatcccagctacttgggaggctgaggcaggagaatggcgtgaacccaggaggcagagcttgcagtgaggagagatcgcgccactgcactccagcctgggcgaaagagcgagactctgtctcaaaaaaaaaaaaattgtctaatccagctgagccaggtggctcatgaatgtgatcccaacacttttggaggccaaagtaggaagaccacttgacatcaggagttcaaaaccagcttgggcaatgtagcaagacccccatctgttttttgtttgtttgtttgt

SEQ ID NO: 95169 - DNA, 1990 bp, Homo sapiens
tcaacattggctttccattagtataattcaaataaaaactgaagttcacaacagggctgctaaggtgaggctcaagggaaaggggtttttgaaaggggtagcagaaagctaggtccaaaataaaacactgcctccaggttccaggtatgagcagctttccgttgagagctgcagggaagcttctgtgccccctccctgaggagtccaggtcagtaaaacagcattaaggatataggataagtttttgctttggaataaaggcccaagtaaggcactcagacacagaagagaataaagaaagcaattctggggcatttctcagtggggcccctggtggtattggagagttgattatgctcaggtttagggagcaattttaatgggtaacaggacgtgggagaaggttctgttgttcattcctcagagggcacggtgatatcttccatttggaggagggactcttggtgaagttgagcgtgggtggatagtgaccttgctttggaggaaatcctattctgggattctgctgttaggactagttaattcagatgattcttacctagagtttaaaacagtccccagtggtagcaaacttaaatattaaaatcagccatggggagggaggcttaagccattgcttgccttgcataattaaaggcaagtcttgtagagctgagagtacagtgcaggtgtttgtcttttgtcttttttctctatatatacatgtatatatgcccacacacgtttgcgcatttaggttacatacataattacaacttacggaatttttgtttatcaaaactcacaaggtcctcttaaaaatttagctagaaagacttgtgggctggatacagtggctcacgtctataatcctagccctttgtaaggcagaagtgagagaactgcttgaggccaggagtttgagaccagcttgggtgacacagcaagacaccctctctgcaaaaaattttgtgaaatggccagctgtggtggcacacacctgtagcctaggctacttgggaggctgaggcaggagaatcccttgagtccaggagctaaaagttacagtgagctgtcttcaaaataaatatagaaattgtattatgtcttttccacaggataccacagctgtgccttatgtgtttcaagatgatccttaccttatgccagcatcatctttggaatctgtgagtattttcatataattttctagtgttttatctctctggtttgcgtacaacagtacataaataatttagttgtaataacctgggaaaggtttacaaatgctgagaaattgatagactatgtgaatcctttactactttcttcaaaaagatgtacatatcgtcaatggggaaaggatttttggttttggtttctaatacttagggctttttcacactggagtgacccactcagtttaaatggcttgctttttatatatttcaagctgtgtataagatgctaactgaaattatatcacagtagaaaaggtgggatagtctataatttctaattgggattctgcgtgttgttgcatttgtttttttttgtgaggggggagaaattcttgctgagagtgtaactataatcttgcttgagtttaaattacatgtatttaaatctttttctttatatagcgttcatttttactggcaaagaaatccggggagaatgtggccaagtttattattaattcataccccaaatattttcagaaggacatagctgaacctcatataccggtaaggagaggtagttacattatttacataatactattttaaatgtaaattaaaccaggctttcatggctaatatttcagtagctatttgaataccctcaatatttggatgataagccttttaaagtgtggagttagctttgatcacaagactaactttaaaattctttctgtatttatttgctcttcatcttaatattttccccatttgatttttgtgacaccatgctcttaggtctttaa

SEQ ID NO: 95170 - DNA, 1086 bp, Homo sapiens
tccacattgtatttccagctccctctttgttctgtagttttggagtgaggatttatgcagtgtggtgggtattgtgcttagtgcttgtccatacagtggtgagcaaaacagatgcgcctctgccctcctgagtttgttggtggaagtactaatctcagactcatcatatctaaactgctcccatatccctacatctctctgcttcccaaagctcacagggaaacacacacttcttgttttcatagtagaacttgcacatagatgaggaagccagtgtgattgtgtaagtcaaaatattaaaatcctaaactaagacagtgtctttctccattagattgtgagcaccctgaaggtagagaatgcctttcgtctctgtatccccagtgccaagcttaatgtctggggtaaaatagtaggcattcagaaagtatttgaataagttagtgaatgaggtaaaatcagcataccttgggtagtattaaatgtttagatgatacacagcattagagatgaaaggtttagttcaattccctgtgaagacagtgatgttaaaatgatcagtagtatctggtgcaggaaacatgaattggagcagtgaagttttactttggtatgttggtgataaaagttttgtcctactcagttatccttccctcacctttacctgtttgtagtaactttagtcatcttgttttcctagtgtttaatgcctgagtactttgaacctcagatcaaagacataagtgaagccgccctgaaggaacgaattgagctcagaaaagtcaaagcctctgtggacatgtttgatcagcttttgcaagcaggtgactgagttcgattaaagcccctctaataacatgggctttgaagtgggcccaagttatatgattcatatattttgagtaagagttacaggtcctgctgtacttactctgctttgatggctgcgtgctttatatttttagtagtttatttcatttttagctttagtgttacttaagaattacaggcgaagtagaattgcagctttgttggtttattgtagcactggtagagaaattgtatcacccttctaccttagcttct

SEQ ID NO: 95171 - DNA, 2680 bp, Homo sapiens
tactgctaaattaagaccactgacaacatgtagacatacacagcagtttgaatgaaaggtaataacttaattatattggagaattagctgggtgtctaaaaggaagacacttcatgtgaatgtctggagagggaaagctaccatgattatctaaaattgttattgaagtgatgaatttgataggatgaaagattaaattccttggggtaggctggacgcagtgcctcacacctgtaatcctggtgccgtgggaggccgaggcaggtggatcacttgaggtcaggggtttgagaccagcctggccaacatggtgaaacctcatctctactaaaaatacaacaattagctaggcgtggtggcacgtgcctgtaattccagctactcgagaggtggaggcaggagaatcacttaaacccaggaggtggaggttatggaatgagagaagagttaaaagtacatatgctagaatatgaccagaaggatccaaaagaaaccgttttgcctctgggaagtagtatctgaagattgaagaaaggtgaggaaactttactagggactttgtcatacagttgcttcttgtttttaatagcacagatatttatatacttgtttataaacttttcattttcaattgtaattctgccacttaacctgcgaagccctgacaacacattaagatcgttaagtcttgattttccccattttcaaaatgataataaccataataccctgtaagaattgagataatgtatagaaagtacttggcacattgcctagaacataataaaccgtcagtaaatggtggtagctctcattggtatttcttattgcctgggttcacatttactctcttgtgtctagagcaaaaaacaacgctgagagaatcttttctctaatgccagagaaaaatgaacattcctattgcacaatgatccgaggaatggtgaaggtacatttgttttatttatttttgtctttcatttccaccgatcagggtgtttcagcctcagaactactaacattttgggtcaggtaatttgttgtggggtctgtcctgtgcattgtaggatgttagtagctccctggcttctacccactggatgtgagtagtgtactcctcccccactttcagttgtgacaaataaaaatatgtttaggcattaccagtggatagaaaatcccactgcactagagtatgagcttcatgagaacaggagcctgatctattgagcctgagctatattaccaaactctaggacagaaatgtgcaaggacttcttaagtaaatgaatttgatgatgcttaatttttccttttccagcaccgagcttatgagcaggcattaaacttgtacactgagttactaaacaacagactccatggtgagtttgagaactcccctctgtccctttctccatttccttcttttaattgtctgtgtgaaggctttggatcgtgcctcagtcattggcctacactttaccttttcctgaggcgtagatgattgaagcaagagtagagatccagagaggagagtagttttccagttttgtggacatgtgattagtcaagggacacataggaatgactgctttgccttaaactcagccatttagggattaatcttcaaccccaaattttatcattttattattttacagctgatgtatacacatttaatgcattgattgaagcaacagtatgtgcgataaatgagaaatttgaggaaaaatggagtaaaatactggtaaggaggaatcctcagtttattttttaatagggcttaaatactctttaccagaaatacatgggctggccaggtgtggtggctcaaacctgtaataccagcactttgggaggccgaggcgggcagatcacctgaggccaggagttggagaccagcctggccaacatggtgaaacccgtctctactaaaagtacaaacaattagctgggcgtggtggtgcacgcctgtaatcccagctacttgggaagctgaggcaagagaatctattgaacccgggaggcggaggttgctgtgagcagagatcgcaccactgcactccagcctgggcaacagagcaagactccgtctcaaaaaaaaaaaaaagaaaaagaaacagaagtacatgggctggagacagcatttatgagcatgtgtatggcagtcactgtgtagcagttacctgttcactaccctttccgcagccctgggactcagctgtgtctggcacataagaagaaaaagttgcttgaccgagagtatagagctagaattctggaccattttattcatttatttttcataatagtttttctgttacaaagtaatgcatatttgctgtcaaatcctatcaggtgtaatttcaaaaagttgaaatcactggattgattctcgcctagtaacttaagaatagaaacggctgggcacggtggctcatgcctataatcccagcactttgaggctgaggcgggtggattaccttaggtcaggagtttgtgaccagcctgactaacatggtgaaaccccgtctctactacaaaaatacaaaaattagccgggcatagtggtgctcgcctgtagtcgcagctactcaggaggctgaggcaggagaatcacctcagcccacgaggcagaggttgcagtgagccaagatcgcaccactgcactccagcctgg

SEQ ID NO: 95172 - DNA, 1925 bp, Homo sapiens
aaaagagggatatagttactaacctgctttaaacataagcaagaaagctaaattctttactttgtatgaaacatagattattggacagattacccaggcatgaaagatacttcttgttttttattcacctaggagctgctaagacacatggttgcacagaaggtgaaaccaaatcttcagacttttaataccattctgaaatgtctccgaagatttcatgtgtttgcaagatcgccagccttacaggttttacgtgaaatgaaagccattggaataggtgaggatgcgcccttgagttctctgaggacagagactgtgccagccagaggtttcagggctacataagcaaagagctttaaattattcttgtgcttacataatatgttggaaattttctttccatgtttggcacatttacttacatgtacttattatagtgggagtgcctttatcatcttagtgttcattagtattttaggtactttgtttatggatctgttgaatctgaggagaagtgattgctttgagttagctagttttaaattcatgacattttcccaacataattaggtatttgaacctaagtgtgtgctagtgtattgtatatttttcattaattactttattgaaagttgctttgggaatcaattcacttcaatatattttactgttctcagtgaagaatgtgactaataagtatttggactttcaaaaagtgatacagtctttgtgatagttttttacctttacattaatgagttggaaaataactttgttcaaaggaatagaaatgcatattttgcttaaatattaacaatatgtttttaattcagtgtgtctcagtaaactatgttttggattgctgtgtttttacctcattgtttattttttctgtctacctggtaatttgagaaccctcgcttgcaacatatcaccatattattcgcctgtttgatcaacctggtatgtatggccttaaattgtgttaatttatatagaaaattgaccagctttcttgagtttatgtgattaattgttgtagttatcttctctgcatatgaattaagaagagagaatttgtaaattaacctgtacagcctgagcagaaagttgtggtttttttagatacaggatcttgcccattgcagccttgaactcctgggctcaaacagtcctccctcctcagcctcctgagtagttaggattacagatgcccaccagcatgcctagctgattttttttttttttttttggacagggtcttactacctaaaattattcttgagggtagcaatcttgtttgtggtctaaaacttgagctggaggggagagggttatggattgtactggcagtgatgttgtacaaacaggaattgggtagaatatattttggttgaaattccttttgttctctggagctgtgctatttaacaccatagccactagccacatgtggccagttaattaaaattaagtaaaataataaattattttgtcacattggtgctcagtagccatgtgtctagtggctaccatgtgtcgtgatgcagattcagaacatttccatctttgccaaaagtttgtggacgtttctgctccagaggaaaggtaaacttattgtgaagcgttttgggaggacctcaaggctccatgcgttgtccacttttaggtcagttccagtgggagctctgctctgtagtagatggactttgaagagagacacacctgagctgagatgtccactctaccatttatttaccagctatgtcaaagcgactagatacctacctgaggaatagcagcagggtgtggtagttaaatgagttccacactgtgtctgctactgtgcttggagggcacatatgaggcactcaaaatcttttggttcttgtccattatccccagcctgagaaataacccttgag

SEQ ID NO: 95173 - DNA, 1126 bp, Homo sapiens
gtacagtgagtttggtggtggtaaaggaagtggattaaacacatttgctttcttgttctgcaggagaccctttaaagagatcatccttcatcatttatgatataatgaatgaattaatgggaaagagattttctccaaaggacccggatgatggcatgtatagaaatcacttgtgttttcctcctctaaagacagagggccggtttacctgagtaccagttagaggccttgtgatccctatagcttagaagtatttttttttttttttaaataaatttgagtacatagtaggtgtatatagcttagtaatatttgccatggtctttctgagaaagccaaaattgtggtacattcctgcctctcttaagtttttatgttcttagctttatcttgcatgttaccagttttgttggcaggatttttgttaatgttactgacttgaaaatatattttatccattgtaaccaaagctcttgtgaactttgattttcagataagttttttcagtcagccatgagcatagtaagtatcatttctttattaatttgctatccatttcctaaatttatctgtaactggagggttctccctggttcttttcactttctaactcttctgttcatgtctttgcttctgttttttcttctttctctaaaatctataattttttttttctttgagatggaggttcactgtgtcccccatgctggagtgcagtggctcaccgcaacctctgcctcctgggttcaagcgattctcctgcctcagcctcccgaatagctgggactacaggtgtgcgccaccacacctggctaatttttgtattttttgtggtagagatgtagtttcaccatgttgaccagactggtcttgaactcctgaccacctcccaaagtgctgggattacaggcctgagccaacgcgcctggcctaaaatctgtacttttcaatcacatactatccctaccctttgtttattgtttacattgacatttttcatgcccctgaacagataagcttccataatatttcagatttgcctattagtaagttaaaattgataatggtttttattttagtttatgtaatcatgcttatcataggaaaaatttcaggcagttttagg

SEQ ID NO: 95174 - DNA, 1173 bp, Homo sapiens
tgctttactattagattggtgcaaaagtaattgtggcctttgccattactttccatggcaaaaaccgcaattacaaaagccgctactttcaatagcaaaaaccacaattacttttgcaccaacctagtatttagtatggatcctcacaaggtttttactctgggtactcaagcgtatgtatatccaggcatactttcagggtgttttatttgttggcagcaaccagtatttcatagtaagaaccataacttaactttcctgtgggtagattttggagttatttcatggagatttttactagtccagactctgcagtgcaggtgtcttttgtgcacttgaccaggtgttgttacaggattaatttttaatggtataattgcttaattaaaataatattgtaataaatttcacagaacttgggatttgtctcccccccatttcttataacttacttgctgtcaaccaataatatgttgaatcaacattattttcacaagacactctactgttgttatttatttgtgaaccactggctgacagggtatcagagtgatacttactacttgcatattttcagtgctcatctctcagagatctagaacttgcctaccaagtacatggccttttaaaaaccggagacaactggaaattcattggacctgatcaacatcgtaatttctattagtaagtgtgttggaaacatatccttttgcatgagttaccagattctgcaagtgggaggctgttgatgtcccttcatacctcacctctggtttcaggcaacatgccaatgatctaataggacatgttaattgagcacttaggaattaaagcagtggtaaaactgccagatttgaaagactagtttgtgtcctttaagggtttttttttttttttttttgcaacactgtaaaatccacatatctttttcctctaccccctctcattttacattttcaaattgttatagcagggtgagccctgaagatttcctttcacctcccttgcttttgtattcaaagatgaagatactggaacctagagatactccctaaatgggtttgcttttaggcagataagaacatgaatttaagaaggcagcatgttaacagatgtgtgagaattgttttctgtgtatccaaatccttgtttcacattgaatgtttttaaaat

SEQ ID NO: 95175 - DNA, 2744 bp, Homo sapiens
aatatggtcatactttccgcagtgacctgagagaagagatcctgatgctcatggcaagggacaagcacccaccagaggtaggcctgaaactcaccagccagtatatcctcccatactgaggtcttcttaaggctagcttccctggttttatctgccattttggagagttctgctacccaaacccatatttgagtgatgatacatctaaacatatcttgcccttagcagaaatctgttcttaaagttaccctctttcctgtagtccaaagcaagcaacatgaaattagcttctgtcttcagcttgcttttttaaaaatctccatctacaaaggaaatgcatagctgaatttgaaagttgtggctaatcaaaatacttaggacagggtcctttttttattaaattacttgtgtgctatacacataatatattcaaatggtaaaatgcattgctcagattttaaggatcctgtgttagtctcctgaactgaaattctcataaaatcagttaggcagttctgctgactcctaagcttctcagcttcaggtggcatttgctgactgtgctgctgatatcaaatctgcgtatgaaagccaacccatcagacagactgctcaggattggccagccacctctctcaactgtatagctatcctctttttaagggctgggagaactcaggaagcctggtgagtacagtaccacaagtatacactttagaagcttttgtatttgaatctaaaacattggcccacgctggtagaggttctttcatttggccacataacacgtatttgattcgggaacttgcaaataccaactaaaaagcaaacttttggaagaagacagtatgcatgatgtagttgagataaggcatagttctctcaaaccatacgctgagaattatctttctactttctgtgtctatggacaagtaagtcacttaacctcattattccacttaaatgaactaaagatcaaagaaatatatgatcaaagaaacgtagttttgaaaatggtttggtcatttgggttattgaagtatttttggatgcttctcccatcccactctccagcttaaaatgtgggctgtgtacttagacttctggaagctggcatttacgcacattaactaaacttggccttgaccacaacccgtccttgattggtgccactgtgttctggttatgtttttatcagcacttcattcacatactaatttttagtgtttgtgaatgggaaccttatgcatattcatgtttccaaaaatgagcaaaaggatcttttgtaggggtagtgacaggtggttttcctgtattttgttttgtatataaatgtgtgttctaaaagtcattagtggggggtgcttgtgcatggctccttgtacaagaaagtagctttatttgaacatctgattgctagtcagctatctccaggaaaagatgatgaaggcttgtctttgaggtgtggctcacacgtgtctctctagcaactatgctgctagtgacagagacgtatgacatttgcatttggttgttagcgcaggcagtttggcacacacttgatacaaccaggctgtgatgattggcgcaggggtacggacctcagctgagtcatgggagctgaatgtatgtgtttctcctttgtcctgcatgtggcaggctgatggggagcacttacatgagactgttgcctcaatctgagcctgcacttcataacagaattctaagacagactgaacccctgctgtactttaagagagggaaacagcaggttctgttctatgcctcttttccagctgtgcacaggatggattccctccttagaaggacagtggtgatcctctacaagaggacaaatacagttggagtatcccttttccaaaatgcttaagaccagaagtgtatggggttttagattttggagcatttttggattaggaatattcaacctgtaccagcaaatcttgacattggcagcatatcagatttacctgtgaaaactgcagtgtagattcgtttggggagtttaagcacctgcggtgattctcatgtacacacagggctgggagctagtagagcccacagatgtgtgtctttgggagcttacagtatagttaagaaaagggcatttagtctctgatttcagagagaagacagctatagtgtctgattgccttgtttttctaatagtattcataatctttttcctttcttgagcaggaaaatgttggggcttttcaggaagcataataagattcctaggtaagttgaaatcagccagctctctttgggtacagcctggaagtagccacatttggaatttcttcaccagccttagccaccacatttgggcactcttctgttaggcaagcataccgtcaactccctactatccagggcatcctgaggcaagcagttttttatctgtgttgacggatcatcatacattggggctacattgaatagatcatcatgaagtcatactgaatgaatgttgataatccatttggccctttagactttctaacctcactggaaacaagtaaaaataaatgttagacttcatctttgtctccagaaatactgttgggaattctgttactgaacttacactggatcttgcctataaatgttttactgaaggggctggagaaagttcacactttgcctttcttttacagaagtgagttgctgaatgagcttatggacagtgcaaaagtgtctaacagcccttcccaggccat

SEQ ID NO: 95176 - DNA, 1001 bp, Homo sapiens
taaaggcttagcatttaagtagcaacattgcggttttcagacacatggtgaggtccatggctcttgtcatcaggataagcctgcacacctagagtgtcggtgagctgacctcacgatgctgtcctcgtgcgattgccctctcctgctgctggacttctgcctttgttggcctgatgtgctgctgtgatgctggtccttcatcttaggtgttcatgcagttctaacacagttggggttgggtcaatagtttcccaatttcaggatatttcgatgtcagaaataacgcatcttaggaatgactaaacaagataatggcagtttaggctgcacaactggtaaaatgactgtagataaatgttgtaattagtgtacacgtttgtatttttgttaatatagccgctgccatagttttctaacttgaacagccatgaatgtttcatgtctccctttttttttgtctatagctgttacctattttagtggttgaaatgagagctagtgatgacagaaggatgtggaatgtcttcttgacatcattgtgtattgctggtaatcaagttggtaacgactacttctagcagctcttaccactatgacttaagtggtcctggaaggcagtaagtggaggtttgcagcattcctgccttcatgagggcttctaccactgaccactttgcacgtacctggctcccagatttacttaggtaccccacgagttgtccacataagcagcttcatctttaccttgccagagttgacaattatgggatactctagtctacttatacttgtgttcccatctgtctgccatcctctgaaggccgggacccagtcatacatccttagaaaccaaagtatggtttttgttttctcttggaatgtcaggtcttaaggcatttaattgagggacaaaaaaaaaaaaagccgatatagtagctagctacttaagcatccatgggtattgctccatatcaaagcagatttgcaggacagagagagta

SEQ ID NO: 95177 - DNA, 1004 bp, Homo sapiens
cagagctctgtgatttaagatgctcgaaaagagtgtccaagaggagtaaaggtcatgacagaatttactcccaggacaatctaagttctgccacaagtacccgtggtgtctgttcccacaacaatggccctttcacaagctcttgcctcacaacccctgcagaagtccttcaacaaaactaataatagactagtgaaacctactcctcacatgggtaagagttgcagtgggcaggtgaccctcctccctgcccccatcctttgcttcctcaagctccctgccaacctctggatacatcaatgggaaggaaaccagggaagcatagacctatagtacaacaggggtgtagtgaccactggacctgatgaagcgaatctgcctgaaatttaatacgcctttttatttcccttctgtgttaaatcaaatgatctgttctgcactgagccaagcaagttacttttaaaactggtggcaccactcatttgggacttggagactgcttttatccagaacctgttaagagaacaggggatttaaatacaaaggaatatgaaggtggtgtgccttaaagacagtctaaaattaggttttagtttgttacattattttgaaatattaaacatgaaaatgttaaatcaggatgtgtgagttttaagatgttgaacactgtcctacatcagtgaggagggaggcaataaagtaatttcagagtaaaacagattgaggatgaaaccaagacagaagtgatgatttggctttttatgatttttgctgtggaaatggcagtcgtgtgacttttcacttgcagtttaaatgaaagggtgaagagaagcctacctgccctaatggctcagggctatatccacctcccggataaccctggcccttgggactccatcatctccttgaagtagcactgagaatccaagaagaggctccgctgctttttgcacatgttactgagttacatctcaggaagatttttaagcacgaggaaggaaaat

SEQ ID NO: 95178 - DNA, 2465 bp, Homo sapiens
tacaccagaaataagtggtgggggtggggttgtaagaaagtctctctggcctcatcttgcacatgtgtagatgtagcttgttgaatgtgcatcagttctgtggatgtatgttgtcagatggagagaaaaatgtttggctttgcctttttttctttgtaggccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagagtgaggtttaggaagattttcataaagtcatatttcatgtcaaaggaaatcagcagtgatagatgaagggttcgcagcgagagtcccggacttgtctagaaatgagcaggtttacaagtactgttctaaatgttaacacctgttgcatttatattctttccatttgctatcatgtcagtgaacgccaggagtgctttctttgcaacttgtgtaacattttctgttttttcaggttttactgatgaggcttgtgaggccaatcaaaataatgtttgtgatctctactactgttgattttgccctcggagcaaactgaataaagcaacaagatgaaaactgagtatcttatcccttttcaaaaagtacagttctggccaggtgcagtagctcacgcctgtaatcccagcactttgggaggctgaggcgggtggatcacctgaggttgggagttcgagaccagcctgaccaacatggagaaacccatctctactaaaaatacaaaattaagctgggcgtggtggcgaatgcctgtaatcccagctactcgggaggctgaggcaggagaatcgcttgaacctgggaggtggaggttgcagtgagtcaggatcgcaccatcgcactccagcctgggcaacaagagcaaaactccgtctcaaaaaaaaaaaattctagtttgttgtatgtacagaaaatatccttgagaaacaacaacagcagaagtaggaacttctagctcacagtttccaggctgtgaattgcgtcaccagaagtccacagcctgctttttgcctttgaaggttttggtgaattgattcctgctgctcagactcaaaagagtaatatacaagccaaagtgccacatgtatttataattggggatatatcgttctagtgacttgttaaaatgttggtctctacccacaagttaattcagcagccctctatgggtcacagctgacagttctaaaacactggtaatggagcttagttctttctagtacctgggctgtgaatcccttcaaagtggggggatggggagcctggaatcttaatgaagagattaaatagttttgttgtgtatttgatgtagattgctataaaacccagagaactttctcagttcatctttctaaagattagtacaactgtcatattgcataagcactaacaaattcttttactccatgaagaccaccatctctacataaaaatgtcaactttcttcaaaattacaactgtttgttggggattgtgtgttcacaaagaaattgaggaggcacttttatctgggcaacacatctggaatcacaaaaggggcagcttctgcatctgtaggtgtatggcactggccttgtcctttgattttgggatatattggtccacctttggcttgtgttaatgttgtcaatagtccttatattccctcctaagtggatttacttaattcaacaaaatatatttagtttctgattggaacacatgctttgtgttccttcctgagattaatgcccgtcatctcaaaggcagaggcactctgtgcacctacctagaggatactaagtttttattaggagataataggactgttctaaattcagtcttcctttttcgaatggcacaaaattgcaaaatacattacttgtaaagctaaacttccctatttgtcatattagaaatgcttataatttccattcga

SEQ ID NO: 95179 - DNA, 1019 bp, Homo sapiens
ttccatcagtaaacctgtaaagaattatatacatcggccgggcacggtggctcacgcctgtaatcccagcactttgggaggccgaggtgggcggatcacgaggttaagagatcgagaccatcctggccaacatggtgaaacccatctctactaaaaatacaataattggcatggtgatgcatgcctgtaatcccagctacttgggaggctgaggcaggagaatcacttgaatctgggaggcggaggttgcagtgagccaagattgtgccactgcactccaacctggcaataaagcaagattccatctcaaaaaaaaaaaaaatatattatatacatcaaatatgagtcaggacatttttgaaactttacacaaaatgtaggaatttcgtgacaactctaaggccctctttgcttcagcaagtagttgctggaagattacacagttacatgacatgcattgagtatcacttttttctggaactatttctgttttatttcagaacctgtctgagaaactctctgaacaagaattacaatttcgtcgtctcagtcaagagcaagttgacaactttactctggatataaatactgcctatgccagactcagaggaatcgaacaggctgttcagagtaagcataagctatgtttatcttacagataattttcctcagcataatttatcaaaataattttatagggaaaatggggtacatgtactgacatcaggacataaaaatactaatcactctacttaattgcagtttttgccattaaaagtaatggcaaaatctatataactagaaatttataccttgtatgacaaacacaaaatcaccatttacaaggctatttacccagtatcctttggctatgtcgcatgtgcctgggtggtaagggctaggggtcagtgtggtcccatgcttgccttccacagacttggtgggttatctggaggtggtgatttgccgagtccaactaccaaatggacagtatttatgctgaggcctccatgtgccac

SEQ ID NO: 95180 - DNA, 1060 bp, Homo sapiens
gagaagataaatcatttccccaaggtcacacagatggttgtagtaaagctacgcttgattccaagtatatagttactttttttcatatcctggatttagttatttctcagaggagcatgtgattcaggaaatggcagtgttttatatgagaggcagcctggtgatgtggaaaaaccacaagtttgggggtgagagagacctttgtttgaaatctggtttttgccacagctgtgtgatcttgtttgaatcaccttccagggtttagttttccgtttcacatgagaagtagaagtgtacacatgcctggcacattagaggcgttcaggatatggaagctgctgttgtcatggttgatagtggtctttctgttttcctaaaagtatatgtggagaattgaaaactaataactactatgtttggtttcacagatagaagaagtcagagatgccatggaaaatgaaatgagaacccagcttcgccgacaggcagctgcccacactgatcacttgcgagatgtccttagggtacaagaacaggaattgaagtctgaatttgagcaggtgaggacctggactcccttcagccacacccctcttcctgacaggattaagagactctcctttccttttaatgtactctgaggatgtcgaagatttggaaatctccttgtatgtctacaaaactgcttctttttacataatggtgtacctgtgtgttcatgatcagatgtgtttttaaaatatatattctagtcatttggaatcttcagagctttaaggagagttggtaaaggggatttcaggaatgcagacagtaatatttgacatgtgtatcttcctcctatagatggcatggtactgcttagatttttataactgaggtaatttcccagagaagttttgaaatcccagtaaattatcaggatgcctgtaatcatagtttctattcaagaaatcatttacagtaatattaacttgttactttgtcttgcaagaagatattgaggttttctaagtaaaatcttccagagaatcgcgatgtatgtcagtatgaaaaggta

SEQ ID NO: 95181 - DNA, 1055 bp, Homo sapiens
tcttaaccagtacccaaaaggcttcttgatcactgcatgccatgagccatttcactgctccaggcaccctggtattttttgtctgtaccttgactatatcttttgtcttgggacctttatgttttctctgcctagtacattgttctatcctctctgtttaaaccttgagctctaagcttaagttttaagcctagatgtcactttgttagcaagactgagatttcctatcccttcagtccaaagtagagtctctgtattactttctgttatgttgccctgtttattttaaatgtaaggtgggggaaaaggaggttgaaggggtgttgatgcttcacaacaggtccttgcctgctcagtcatatgtagaaatatgtatcacaatctcagatgtcttttttgtttactgtctgctgcctccattgagatatacactgtgagagcaagaagttcgtctgccctaagcaccattggatccgtacagatagtaggcactgcctggcacacagggctagtagcacttcataaatacttatgcactgactgaatggattcattgatttattatattgtttctgagaaaaaataagttctggatttcaggtaatcagtgttaagtaatttgtaaagtgacctatggctatttgttaggcaaggtatattttttggttttttttggcccatgttgaatttaaattcatttaaaaataagcagttttctttgtttagaagtctatgtcaagtctatgtcaataactaccagatacttactaattttcttttcttttttctttttgagatggagtcttgctctgtcgcccaggctggagtgcagcagcgcaatcttggctcacggcaagctctgcctcctcggttcacgccattctcctgcctcagcctcccgagtagctgggactacaggcacccgccaccacacccggctaattttttttttgtatttttagtagagatggggtttcaccattttagtcaggatagtctcaatctcctgacctcatgagccacctgcctcagcctcccaaagtgctgggattaca

SEQ ID NO: 95182 - DNA, 1113 bp, Homo sapiens
catacacctctagtccaagttacttgggaggctgaggtgggaggattgcttgagcccagcaggtggaggttgtggtgacctgagattgtaccactgcactccaggctaggcaacagaggaaggctctgtctcaaaacaaaaaaacaaaaaatttaagttgattactgtgaaacagagataagtcctttgaaaccaaaaccacaattaatatcaatgattcttttattttctaaaatgttatttaccttgatttgtcttgttttacagtttaaattttagaaaatagccgtatcatttcattttccagtattaaaatagcttttcctggtactagtctccgattccttcttgtttccttttagatatttctgtttaatgatcaataactaaagtatgtgcattcttttttttcaaactgttctattttttcctttgtaggtgtttcagacttaggtgagtgttatgtatatttcatgtttaaagtcttttgttttgggtattaagagactaaagtctttttgttgtgcctatgattcttacacaaagccatctaaatagatataaagtagaattatgtcacatgataaatctgaattggatatttttggcatccgaatgctctcaggaatgaaaatgtttcatcaagtgattggaatcctatagatgtgaagtgtgtgtgtgtgtgtgtgtgtgtgtgtgtgtgtgtgtaatatggattgtaactgattactttggagaatttcaaacattaaaaagtaagaagaaaactaaagaacttccaggacccatcactcagttttgtagccatcagcacatgaccagttttgtctcatctattcccactcctcctcagcttatatagaaagcagactcaaatatcacattctttcacttgtaaatactttcagtatgtttcaaaaacatcaccatactattatcacacctaaaacttagtaacaattccctagtcaccaaatgtccattcagtgttaaaatatcccctattatttcatagaatgagtctttacagtttttatttgaatcgataacccatagacgttccacatgttgagtttagtcaataaatctcttgcccctttttgttttttgctt

SEQ ID NO: 95183 - DNA, 1051 bp, Homo sapiens
tactacttctgtttcttggaatgtttatggtattttttgttcaatttaatcacataccctgtgtatttgctcaggtccaagcagctcagtctgaggctaaggttgtatctcagtatcatgagctggtggtccaagctcgggatgactttaaacgagagctggacagtattactccagaagtccttcctgggtggaaaggaatgagtgagtacaactgaagtaatgttttttttttgatgttttaaccactaatcaatgaatctaaacttgcttcatctccattgtagtccacatccctctggcatgcatgcatatctctttttgttacagcgttttattttaaccacagtcattacagatgacacagctgcaacactactcttgtagttttagctgtggtgaacatgagttccagctagtgtttaattccataatccgtgattggttctgttctgatatttgctactcaaaaaaaaaaagtttggaatttgagtgaacaaaagtgacattataaccttgacactactgaaatattattgtatatgtataagtattaaaaaaccttattactttaaaagtatttgtagtgaattatttaaagcacactttatgtctgctctgtgacaaaacaacactttgttgagaatttacctagggaccctgcattgagaaaggaaccagctgtctggctatccacttcctcaagctgaaactacagagaactttgatgctgaagtcgttacatggtgtagctatagtcacatttccctgaagttctgtgagagtactaagaatcacagagatcacctgtctcagcaaaattaaaataccgtttatttttatttttattttttttgtcgttgcccaggctggagtgtagtcctccacctcccgggttgaagcgatcctcctgcctcagcttcccaaatagctgggattacaagcatgcgacaccacaccaggctaattttttgtacctttttttttttttctttttttttttttttgagacaaagttttactcttgttgcccaggccggagtgcaatggc

SEQ ID NO: 95184 - DNA, 2114 bp, Homo sapiens
gtattttaccatgttttcttttttttttttgagagagtctcgctctgtcgcccaggctagagtgcagtggcatgatctcggctcactgcaagctccacctcccaggttcaagcgattctcctgcctcagcctcccaggtagctggaactacaggcacccgccaccatgcctggctaatttttgtatttttagtagagacggggtttcaccacattggtcaggttggtctcaaactcctgaccttgtgatacgcccgcctcggcctcccaaagtgctgggattacaggcatgagccactgcgcccggcctttaccatacttttaagtgaaactttgattccctaaatttgagtctcatgtattttgttcctttttaaattttttgggaaatgcaatggaagactagataggagaacagcaaaagtttaaagtcatttatgggggtaggatttgttttttaactgttcttttttttttttaagctctagccaagagcttagaagatgctctgaggcaaactgcaagtgtcactctgcaggctattgcagctcagaatgctgcggtccaggctgtcaatgcacactccaacatattgaaagccgccatggacaattctgaggtgagcccaatgaatgattagaagtgttctggctgtcatgacttggaggacaaaaagaaaaatcgagggtggagagaagtgtaatatttaacagactgctttcttccgtatgatatcggctttctctcactaggggaagatagtctggaataattaatctttttttgttattgttttgagacggagtcttgctctgtcgcccgggctggagtccagtggtgcgatctcggctcattgcaacctccacctcccaggttcaagcgattctcctgcctcagcctcccgagtagctgggattacaggctcccgccaccatacccggctaatttttgtacttttagtagagacagggtttgccattttggccaggctggactggaactcttgacctcaagtgatttgcctgcctcggcctcccaaaatgttgggattacaggcgtgagccactgtgcttggccttagagtaattatgtttaaaaaacaaactgaaaaaagcctttaagttttttagaatgaattttatacattgtgctttactatatcttacaacaccgatgcagcgcaagaattagttcagatttgctttcatattttaatagcacttaaatatttttgttgtttgctttaaaattgctatttccataggtaaactttttaagatacttctcaaacttcacatgcagttttaagaaataatacagagagctctcatgttccctgaaacacctgctattttaaatgtttatgattatttatgcgaaacacttcaaagaatgaagtaataacattgatttttcaaaatttaatactgggacttaatacattattttataattacattaagttattcagtatgtataaatgtatctctattccaagtcatttaaggagtaaattaaagtaaaatgcataaattattaatcttaaggatcaggatcatacatggtcagtaaagttactttgccatcataattgtagttttaaaaaaaattttacacacactttacattgtttcagtcgtatgtacttatattacaaaagagtttaattagacctctgatgttagtagcaagaaactacaacctttgaaattttaaggaaaattccattttattcaaagtccaagaaaaatacttaaatatcagagttcagtcagcaaagtggaaaccacccaggaaatttaatttgctggttaccgatatgggaaggctagaagttgcgtgatgtaagggtgttgggttcaaacccaagtagaccagtatccctcagaaggacacggattggaagctttaaatgccatgttactacttgggtataagggtacacaaggtggtatttcatcttcctaacgcacataatgtgtagcacatggtgattagacagtgtaaaatctattgcagtcaagattttacaatctaatggtagcagttaacagatgagagtattagctaatgtacaaaataattggaaaaatgtatgaacacattttggaatgt

SEQ ID NO: 95185 - DNA, 1054 bp, Homo sapiens
gtggctcacacctgtaatcccagcactttgggaggccgaggagggaggatcacttgagcctagcagtttgagaccagcctgggcaagagaggggagaccctgtctctacaaaaaaatgtaaaaatcagccaggtgtggtggtatacacgtatagtcccagctgtgtgccagaggctgaggtgggagtattgcttgttcctgggaggtcgaggttgcagtgagccatgatagtgccactattctccagcctgggcaacagagtgagaccttgtctcaaaaaaaaaaaaaaaaaaaaaaaatatactacacacacaaaaaattgattgagtgattgatagagatgggatcttgctgtgttggccaggttggtcttggcctcccaaagtgtgcaaaaaatatatatatatatatgtattttaactcagttctgttcttgatcactgtgacctttcatctttttgtttaaaactgtaatctttttcctgctcacacgtcttctaccactcttcaaagcaattaaaaaatattctttgtttagttgctttcttttgtctgtcttcatcattaacaggctttttcctttgttactctttttccatgtgtaaatgtccccttcttgtgtgttaatattattattataagccttgcctggaataatgatggttaaaatgcaggtggatgcagacaagacttctttcttttgttcgttcccaaccattgtccattttgtgtgagtttatgtatgcagtggacagtgcccctgtttgtgtgttattcaaacatgtggcagtacaaatatttgtgtctctaaggagtcagatgtgaagtgggtggtgatggtggtagtaaatttctgtgtgtttctctgttaacccaggaaagtataaataccatgagtaacatatatttatagcacctacagaagcggctcaaattatttctgcagcaggtgataccctgtcggtcccagcccctgcagttcagcctgaggaatctttaaaaactgatcaccctgaaattggtgaaggaaaacccacacctgcactttcaggta

SEQ ID NO: 95186 - DNA, 1142 bp, Homo sapiens
atttttagttattcatacttttatttatttatttatttattttttgagacaaggtcttgttctgttgctccaggctggagtgcaatggcatgatcatggctcacagcagccttcatctcccagtcttaagcattcctcctacctcggcctcttgagtagctggggcacgtgctactacacctggctaatttttttggcagggtgtggtgggtagagatggggccttactgtggtgcctagggtggttttgaactcctgggctcaagcaacccttccacctaggcctcctaaaatgaataaatactatttttggtggcaacatgttataaacaaatcaggaaaaggtgatgtgcagacatggtggtaaacttggctgctatgatctgaattagtggtagataagtagaggctagaggtcttcgagatggttacattggtataggaaaataggtgtaggagagccaagaaatataaatgtatttcctgtttctttcacttaggttgactactggcaaaattgctggagctggccttttgtttgttggtggaggtattggtggcactatcctatatgccaaatgggattcccatttccgggaaagtgtagagaaaaccataccttactcagacaaactcttcgagatggttcttggtcctgcagcttataatgttccattgccaaagaaatcggtaagagttttaaacaatatttcagtttatccaatgaaatactttaaaagcaagttgttttcatgttgaaaatacagttgtcttttggtattcttgaaggagaggttcaggacctcctgtggatacaaaaatcccatggatgctcaagtctcagatataaaatgttacagtgtttgcatataacctatgtataccctcccatatactttaaatcatctctagattagatgtaatatctaatacattgtaaatgctgtctaaattttcattatactgtgttatttagggaatgatgacaagaaagaaaagtctgtccatgtttagtacagatgcagtttgtttttgtttgtttttgtttttgtttttgttttgagacagagtttcacccttgttaaccaggctggagtatagtggtatgatctcgcctcaccgcaacctccgcctccgggttc

SEQ ID NO: 95187 - DNA, 1244 bp, Homo sapiens
tttctggatcagttagctgaggttagatctgtcccttgagtgtgtatcctgtaacgccatgtttttagctagactttgtgggtgatttttcagatgtctaaactaagcttttaaagtaaaaatagatttttttttttgccaattaagaaaacatatagcaaataccaattgtattcaagaaataattaacatacttaagacttatttaaaggtgctaattgatcatagtctgataatttttttttaatattaaaagtaattttatgtgagccttggggtgtaagaagcatcactgcttttaggaatctataaatatggttcatgataaattgacttctgaaaaaaagtaattttttgtttaatgaagacatttttaataaaagtattatttctgtattaccaaccctaaaagcttaccagtttcctttaactgtattggttgtgatgtgttttccttctttagagttgtctctgtgggaagtttgtcctccgtccattgcgaccatgccgcagatactctacttcaggcagctctgggtatgtattatgtctccctataaccaggcttttcactgtgtgctgcttagggagtgtgtgttttccttgaatatgggaatagctgtctaaacctttttttaaaaaggggtacatacaccgaagctttgctgtaacattattggggtaccttctggagcattgtttgtaggtaaaaatttgttaataatgcaccttttggctctttggtaattggatggcatccgaggcatagccctccttgtatgtgcaatcttccattctatggcaaatagatttatatccagaactcagcatgttgtaacttaaataagtgttaaatttatttggcattttattagcttttcatattgtgacttaagcaagtgttaaatttatttggcattttattatctatttttttttcttttttttaaagacagagtctcgctctgttgcccaggctggagtgcagtggctggatcttggctcactgcaacctccacctcccaggttcaagcgatttttctgcctcagcctcccctgtagctgggactacaggtgcatgtcaccatgcccaactaatttttgtatttttagtagagacggggtttcaccatgttggccaggctggttttgaactcctgacctcaggtgatccatccgcctcggcctctcgaagtgctggcattacaggtgtgagccaccatggctggctggtattttattat

SEQ ID NO: 95188 - DNA, 1266 bp, Homo sapiens
gataagtatctgccatttctataactaaagagcacgtgttctcctagaatagaatatgtttatactgaaatgtaatgctgcttcaatgtaaaattgtaatgtaaaatgtaaaatttcaatgtaaaaacttactggatttttttgtgggatatactttttaaccttaatgcatgattcttataaactattttaaattaacagtagaaaaagttaatttgttgtatatcaatctatatttcaaatgtagaactgcccattaacttatgggtgcctttttcgtttgtgtgggaggagtccttatgtatgacaagatccacaaaaacgttatcagttgacagcaaccagcagtctgtggaggaaacctggaacctctagttagagttcacatgaggcagctcatactacaggctccatgtccaggttgtcatgctagattgtggtttctttatgtcttcactttagtttggtagagctaaggaacagatggtctgtgtaacagcattaatcatggggcggaacacttgaggtcaggagttcaagaccagcctggccaatatggtgaaaccccgtctctactaaaaatacaaaaattagccgggtgtggtggcaggtgcctgtaatcccagctgcccgggaggctgaggcaggagaatctcttaaacccaggagatggaggttgcagtgagccgagatcacaccattgcactccagcctgggtgtcacagcgagactccatctcaaaaaaaaaaagaacattacatgggaattatatgtttcctcttttttttaatatcacgtttctgcgggttagaagcagcaaggctaaccttataacatatgtctagacagattgctttgaaacagtgttgtcctttctatgtcataggtccttattaataaaaaggaattccaggacaaaaaagtagccaatattttgtgtgttaatgtaggatatttagtttatgttaatagtttagtacttaagagagctctggagacagaccttatgtttggcaatggtttcttaactataacaccaaaagcacaagcaacaagagaaactaaagataaattggacttcattaaaattttaaatttttgtgcatcagagggatacttgagagtgaaaaggatgaaagtattctaatggatactagatattttggatactagaccctcatatctgatgaggtgtttctttttaggtaaggaactcctgcaactcagtaacaaaaaagactacccaaataaaaatacaggcaaagg

SEQ ID NO: 95189 - DNA, 1039 bp, Homo sapiens
gtatccagaatatctcacttgtcaagatcctttccactttattaaaccccatctttctttttttttttttggatacggagtctcactttgtcacccaggctggagtgcagtggcacagtcatggctcactgcagccttgacctcctgagcgcaagcaatcctcttacctcagcctcctgagtagctgggaccacaggcatgtgccaccatccctggctaattttttaaaaaatttttgtagagacggagtctctctgtgttggccaggctggtctcgaactcctgggctcaaatgatcctcccacttctgcctcccaaaatgctgggaatataggcacgagccaccgtgcccagccaaccccatcttcttaaatgtcttactgcttttactgttccctcctagagtccattctttactctaggagggaatagtaaaagcagtaagacatttagtaaaaggctttttaaaaggcaaacatgaggtcatgctctttggagacatcgcatcacattcaaaataaaatctaaactgcttaccatgggcccttgatctgactcttctcatatttcatttttctactgcctcactcagattctcctggtaatctccagcatgtgcctcactgccttttcatcaggtgtttcttttgccctgaactcttctcacaggtttgcttaacttattcccttcagttaatttctcaaatgtcaccttcccttcagagagggcatcctgatccaaaatagaattctgactactcttgccttccttgtatcactatatctttaccccatcctactttgttatactttgtagctcctagcactacctgatgttataatgtgtatttattacacagtttccacctttaaaaagtaagctccacaatggaactgtgtccatatttactgctgtatttccagtattaacaatagtccctggctccaagtagatgctcagtgaatgtttatgacatatataaatgaaagaatgaatgtgttcatgaatttttttttaatttaaaaagattttttagag

SEQ ID NO: 95190 - DNA, 1051 bp, Homo sapiens
tgaggacttcttgactgagagatagcagaagtaaaggcgactaaattaagttgccgtgacgttaagtactttttgcaaaaagttaaaaatcatccaaataccataggatgctcagtaagttactttcacacaaaatatattgttaggataacattttgtgggagaatatacgagatcagtcaagaaaatgcagcgatgtaaattttaccgttagagaaaagctttttttatgtggagtattttttgtgttcgcgaaatataatacatatgaagaaaattttatatagtatgcatgaatgatttaacagttctaaagcaaacacctgtttaacactcaggtcaaaacagtgcactaccagaagcctcctctcccctatgtatcaaaattctctacttcccccccagatataaacactgttctcatttttatagttactattaggttgcctatttttcctatagtagttttagcatccatatgtgcatctcaagaacatagttttgcctggttttgaacttcacatgaattggttcatacagtatatacgctttagtatcttcttttacattgtgagattcattcattcattttgcgtagctgtaatgctttctcattgctatataattctttttttttttttgagacggagtttctctcttgttgcccaggctggagtgcaatggcacgatctgggctcactgcaacctcctcctcccaggtttaagtgattcccttggagtagctgggattacaggcatgcgccaccacgcccagctaattttgtatttttagtagagttggggtttctccatgttggtcaggctagtctggaactcctgacctcaggtgatccgcccgcctcgacctcccaaagtgctgggattacgggtgtgagccaccctgcccggcctgctgtataatattatatgactgtgccacaattctccatttccagtttggggcaattatgtacaaagctgattgatctcatcctggcgcatgagtccaattgtttctgaggatgtgggtatgtgtgaaaatcgctgtgga

SEQ ID NO: 95191 - DNA, 1030 bp, Homo sapiens
tccatccccctccccgccaccctcccttcccccggccattgagaatcacatctttccaagaaatagtccagcccctatggaagtctggtttttgttcttattgggtctataaaccttgagttgtgaagatacctgttgtttcatacatagtatgatgttttacatttctttgtaatatctgacaggctggctataagaaaaaattatggaaaaagacacctgcaaggaagaagcgattgagggaatttgtattctgcaataaaacccagagtaaactcttagataaaatgacgacgtccttctggaagaggcgaaactggtacgttgatgatccttatcagaagtatcatgatcgaacaaacctgaaagtatagatcagaagtttcacttgtttctcagttattggatatgtatctttgtgtacatatctttgcaaaaatggataagtacaaaacttgatgtaaattgtaccaatgaatacgtaaacatacagtgacaacattaaacttagaaaagttttaaaacttaatggatcagactttgccagatttggttagggaaacagaaatttagaatggtgcattatttttaacaaatggtattggcttaactagttgtttcagttatgctcttttagttgcaaggaatctcaagtgggacaaacataaaaagactcaaaagctacaagttagctcaagcaatgtgacattatttcaaggatatgtgccagggaattcaggaaccacctcaccaaccccatctcccactcagaaatcacctcccagcctcaggaagagtagaaattgggtggtgctcctcagcaggggaaggtggatgtttaggcttgggctctgcatgcatgtgacttgcttctttttgcattgttaactccattctctctattcaccaacttctctacacagcttttgcatacttacagtttctgttcctttgtaataactttaacttgcacctttgaggttcttttctacatgatgaccttcagctcctgctgctagtctccaattgc

SEQ ID NO: 95192 - DNA, 1009 bp, Homo sapiens
aaaaaaaaaaaaaaaaaaaaaaagcttacacagcttcttagcaatttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgtaataaaatagtatactggactgtgcatcaaagggatgtaaaattacagtattccaaaggttgaagttctgctgttttgttataatgcc

SEQ ID NO: 95193 - DNA, 1011 bp, Homo sapiens
ttcccagagcccctgaagctcatctgtgcgtcccaggttaagaatttctaacttatccaaccccactggaaacaagaaaataatagaatttctaacttacttggcacttaggcctgggagaaacagaagagggcaggggagagagggagagagtgcttctctgcagtttcctagggtgcactgggagagtcgcctaaatgcagtggacaggtggagagactacctgagcaagcgggtggactcactcacgatcatgtggcccagcagatccaggggaaggaacccaggtcctagaataagttgagtggtccagacatggaggtcagtaatgtgccaagccataacaactgaagtggaggaggtttgaaataaacaccagtctgtgggatgttgtggtgtgagcattacttctttctctattctctccagcccttttcaaaactgtgtttcttcctagcatcttctcatatcaccctcttgttgtcgtcaatttgtcattatttacgtagatctgaaaagttaaattggtcagatatttcctctcatgtgaaatcagcagatcatcctagtgttccccagggacaagcccttccccaacaaccatgtgtggagtagggacctacattcggctggtggtggagggaaggcagttatgctgatgattggaaagacacagtggttgggaggtgagttgtattagcataaggaagtttgtcccttgtggtgatgtgagggttttggggaaggaggcgatggggcttaaaaggtttgcaagaagatgattagtacagatcttggtgctctatgaacattgtgcggatggcaggatggagggtgctgagagccagtttcaagagactgagctgggttttccttgccctgaaccaaagagaagcacattaggatcatttctggaagagactcagcacactgggccgggtagttgcttgaaaagtacctttcaggaagccaaggaattctgcagacaaagcctggacaagagggaagggg

SEQ ID NO: 95194 - DNA, 1040 bp, Homo sapiens
atttgcacacagtgaaattcaccctttttactgtatagttttgtgagctttgacaagtgcatacagtcatgtaatcacaaccacagtgtaaatatagaacaggttcattgcctccaaaacttcctccatgcccctttgtagtcatcatcttcttctaccccactgccagcctctggcagctcatctgttttctatctccgtagttttgcccatcatcatttgtctttccttccatacttagcacacgcagctttgcctgccacctttcttgttctgatacacctggcaccccggccatgttgtgacttccctgaagataaaacctctgactttgaggtatcaagttggattagaagagcagagtttgaagccagatagagcatttgaatccagctcattcagttagcagctctgtgaccttgtgttggcctcagaatctgacacagagtagggactgaataaatgtctgttggatgaacgaacaaacaaatgaatgaatgaatgaatgaatgaatgaatttaacctcttaatgtcccaggtccctcctgtgtaagagggaatggatagtagttgcctcacctgacttctgtggggatcagtgccttgtacagtgcctggtgggcattagtaaaggtttgtcctgttcccatggccttccccagggcttttgataccctctgccagaccgacacatgcactcaaagttggctgggccctggcagaggacatcagtacctgctgtgtgagagcgaggagggcaccagctgagcagacaagtccccagaaaaccccacagatacccgctgaccacctgccagtcaatctcaaagagctcctcactctttccccccacccctttttcatggtgcacataggaaggcccagcagtccttttctcagcctaaatatataccatgtagggggctttagatgaagcccaccagaaggagaaaaccataacccttcagcacagaaccctctggctgggggtcaggtctctggctctgaggtctggggaggggagcataagctgggaaat

SEQ ID NO: 95195 - DNA, 1049 bp, Homo sapiens
gggggccaatggtgatgatctgtttcccccggagcctcgcccagctcctgtgtttcagccaatgagcggcggaagcggctccgaggggggcgggtccgggaggctgtgcgtgtcttgtgagagctcttgaaccaagtcagcgctggagtcggctaggcggctggaaacggcggctgccgccggtgactcagggaggcgggaggcggggtaagagcgccgcggcctcggctgcggggagaggggagagaaaggtgaaagcgccgagcgcgcggccccgtcgcccgttggcagcggcgcaggcccgggagacgggcgcccggggttcggggccggggagctgggcgccggggcggggcggcggggcaagtgcggaatcgcgggctcgcccaccctcccccgtggggccgcccggggcggggacccagccgcccgggaccggctctctgcaccaggggccttttcttttcggggctgggggctgagcactttcaaatccactcgagccgcagataatttttccctcactccctctgcggttgcgtttgagctgttagaaaagccaaacttgggagagcgagggtcacgcggcgctggggcccgggtgtgtggcgggggagggcggcggggggcgggagggcgcaggaggggggctcggtgcgggtccgcccggggccgcgtcctcgcgcgggttcggcgccctccgcccgccctccctgctgtctccgcccggccccctcccaccggccgcccccgtcgcattttgtttttgtgtttttgcagggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtacaggcggctccgggcctctgccaccggacgtttcgcagttaccgtggtaa

SEQ ID NO: 95196 - DNA, 2061 bp, Homo sapiens
aactgggaattcatgtcaaaaacaattttggctaggttggatttttgccttacttgtacacatcacaactcaaccctcatgtaagatgccaatcttctgtctcttttctagtcatgatttatcactgcattccttagttgagtagcagatgttaagtttgggggccatgttgcattaaaaaaaaccaggattttattttaccttgattttagagttggggggtcttgttgcccaggctggtctggaactcctgggctcaaaacaccaaaaccaatttgtgcttggtgagatggaggcaggaaccaagtaactaagaccatgcttacactagggtttaggggcattaagtttttggggggtgagatgggggtggggcgaggggctgagatgaatgtcaataaataacattcaagtaatatgtaaccattcttctattattaggacaaatacaagtctgtctagactggcttgtttagatagttatggatgatattaatgaggccaaggcttgttaactttgtttcacctagagagactttataacaaaaccacttacttagatgacaaaaagagaatatgtctagtagttggttacagagaagttaaggtgaagacataataacagtggataactatgattaaatggttacatcaggatttagcaaagaaaaaataatcattaaatggatattatgtggcgattacttcatttaatcctcacaaatatcctagatggtaaactacatttttagtgtcaaaaactgaggcttaaagaagttaaataacttgagtttgtctccagaccttaaacactaggctttaatattcaggtagagcgaggttagagcattttattttgctagcctctatatccctagcaccgagaacactgcttggcatgtagtgtgtgctcagctatttgaatggataagtgaaggaatcataaaattattacctctcctatggagaaacagtttagaaagaatctactgatgaggcagtagcattctcttcatctggaataacaacagatcttaattagatgtggctataaagactgctttaatcttatttttatcctgctctttctacttgagtatgaaatgagttgcttcctagctgattttgttcacataattatgcgtggtgggaatgccctgcttccttaacttgtccttttttctttgaagcctacctttttcttgagtctaatgccctgcttccttaacttgtccttttttctttgaagcctacctgtttcttgcgtctaatgccccttcttagtccttacaggtgtccttagcaggcaattagtccttgccatctgtatgtaccatttcctgctattgtcagcaatttggtgccttgactaatgcctagcctttcatttttgcacaccattgaaactttaatgttagtgcaatctgctgccagtcaagccatgtaaaatgaaaaaacttctagcacggtataaaaactgtttaccccttttaattgaatgctggaccttgggatcttcgacaaacatttaggcataagaagacataagtggaagcacaaggaattaatttctttgtggagtagtgaattaagtggtatcctgcattgtagtgcaaggcataaaatagacatgtaattaaaaatttgtctaaaaaccatatcattctgtgctcctgcttttaaacttggaaacattttcattggtgtttctgatggcctttataatcatatagtcaggtgagatgagagtatggtaagagtgggagattttgatattagtttattagatacaatattaattcatatatcagaaagattttctgttggggaaacattggcttgaaaaatctgaaatatcgagcatttggtcaaggtgtttcataggtactaataaggtacacatttgcaaaatacccattaaaagaagagcagatttcacaattataggtagtgaatcatagttgactctggcctttgaagccacacagtgtaagtcacatctcattgtgggccaaaggagcatgggtgaaataacacaatttagaatagaaactagctgca

SEQ ID NO: 95197 - DNA, 1129 bp, Homo sapiens
gagtccctaggtttgtctaatgttacttggcaaaagaaatacatttttccagcacagcttctctaacagactagttatccttcccagtgggaaaaatggatgacccattcttggtcattatccatttcacagtggcagaaaagcataaagccctgatattggaagggcttctgtgttgagcactgttttttctttgccctgctagaattcggtttggcaagttattcctattgacagtttctgtattacatttatcataactgggtgtgcacacaaagccagaagactgtggaatagtgccaagaatggagctgctgccaagaattgaatgtttcagaactggcttactctgacgccttaggctattcattcagattttctgtttgtccccccacctccctttttgtaaaaaagaatgcattttgtaatactagttaggttaaatgaatctgtgtgaaatgagttgttaaaaacagcagtttcttaccaggaagggagctgaagcttggtcagctttaaggggccttagaaaatagggttttggcctaggtaaccaggctgagatgtggttcaaaattttccctaaaattgccatcatgggtgcatgcttgctcatccccagggtggccactgggcacagccatgggtttactaatgggaatatggaaaaaagggctgcccattatcagtggactttggtggaaagagatatgtgtacctctggagttaatctttacaatgtgtcaaaaggtttggagaacattgatcaaggaaacatttttctgattgatgaataaactaactctcagttatggtcatctacccctgctagtaggttacacagtgtattatatagtacatgcagtgtgttatataaaataaaaaaaaaacccagacagtaattgcaatgaatcgaccatatacatctgtctcttgtgtgtcatatctgtgttttttgtcccttggatttggattgtgatttccccatccccagtatttaggatacagagtgttttttacttggattgaccagctgtttgtttgcttacttttttcccattgccaaagttagtcatttttaaaattatgctttgagttcctcttaatatttctcatgcttctagcttgg

SEQ ID NO: 95198 - DNA, 1056 bp, Homo sapiens
taaggcattaatttgatactccttaccttcccatttgtgttactgagtttctacaatcatacattttttttctgtgttttttagattatcagacatagtatttttgttggggttcctgaatttgattcctctaaaactacacaggacagtgagtgaggtcttgatgaattgtctaatactactttggtccgatacaaaataaaaagtttaaattttctcatagcttttctgaaatgtcagtcatcttatgtttgtagtgattcttttaatgtttacttttgcgtttttttaaaaaagacttaggaaaagattgtcctggatgatgttgctattgggagataatgcaaattgctctaagattttttttttttttttttttttaaggtgacaaaaacttagttggttcagaagtaaaaatttatagcttggacccatctactcagtggttttcagcaaccgttataaatggaaacccagcatcaaaaactcttcaagtcaactgtgaggaggtaaagacaacaataactctttgtaagataactcgacaaagcatgataactatacaaagcatttatgattttctaggcactaaatacctttattattttatagggtagaaataattacagttgttttaaaaagaaattattcataagaagctcctattgttatgttaatgaacctgattttcagtatgttcttgagcattttttattttccggtatctttgtttcatttatttttaagattccagcactgaaaattgttgatccgtcactgattcatgttgaagttgtacacgataaccttgtgacatgtggtaagatatgttattaaaatctttcttctccttcctcctttcctccgttcttctcacattaagagaaacagggaagccaacttaacctatttttaaatattttaggtaattctgcaagaattggagctgtaaaacgcaagtcttctgagaataatggaaccctggtttccaaacaagcaaaatcttgctctgaggtaacctttatttatgtcacttgtgtaaagctttccttaact

SEQ ID NO: 95199 - DNA, 2530 bp, Homo sapiens
tgtttaggaaagaatgaagagttaagtatggaaattagtcttactacctttcatttttgccttaaagtttacaaggtaatttcaagtacatccatccaagaaaccatagttactgtattaagtactcactgtgtggtggatacttggtcctggagattgaaaggtatctggagttcctgtctcagattccataggatagtgagggagacagacttccagagggctcccacaagtgcagggagagtgctctggtcaggagctctgcaggtgcctcaagaagcagcctgggcagagcctctcagacagggaggacgtgtcttgtttggtgaagggcaaatgtttcattgtggcaggggcacaggaggcatggaaaaagagaagcagggtcagagataggaagtttgggttttatgctgcagatgaagagggggtgtctggggtgttcaggggttttaagttcaggagattgacttaagctctgtagatgatggatgagggaaggacatgagaatagaaatgagggcactgatgaggttagttgtattgcacatcataaataggcttgaggtgaggcggtagctaagggggtggagagctatttaggagacagcagtagttggatttggtggaagactaggtgttaggactgaagaagcacaggaatctagctaatgaagtaggtagaacaaatggaatgtctgcctcaaagaacatgacagttctagcttaggaagcccaagtgacatggtcaggcaattatttatgatactatatagtctcccagtatagaaaggggctgagctgctgaggaataggggtccctggtctagaagggaacagatagtaaggctctgggtaattaatgtggccaggactacacagaggatgtcaagctcagagacaatattgtcaagtaatccatagtattagaagctgagagataaacaggatataataataatttctttatgtcaggttttaacgttagagaaattgttggcagtctagagttagaagtagtaaatatcagtttggagaagttggttgtgtgttgcctgtcatggggaatgtgtcagtgtaaattgggagtatgatgaagaggagagctgagctgtgagacttgctgaggaagaagggttgggaataggaatgacgtatcctgttggatggtggagcgatcaatctggggtgcaagcagaactgaggtcagtgggaacctcccttgggggaaggtgccttcagaatgttgagtgtgtcagcaatgagaaaggtgtttgagcaagtaaatttctaaccttcaaggaggtacttgtaaaatgtgggcatatagacatatatgatatgatcctgtctccttgattcaaattcttgcaaggccagaagcattacttttttatctttctcagcatgttgcccatactatgtgtgctattgagctgattgttgggcacattagaagctattaaaaaaataagcctgcacttcagcctggagataagtttcttaacttctgcatctaatatgataaactaaattaagtgttttaaaaatgtacattgcagctcttgagctctatgctagtcacgtcattctaaaggaagtcgaaggtggatttttacctgggtttcagaagttcttgaaaatatttttttgattgtgaagctcatctcatttgaaaatttttggttaacctagaaaagtatagtaaagaatagaatcatcacttgtaatcatacttctcagagactctctgtttacattttgaaatacttcaaatgtaatgtaaggaaatactttccttctgtctcttctccccctgtatttatcacagagacctgattttttttgttagttttttaaaactaaaaaccatactcttgtagcctccttgattcccttgcaatgtattataactattattccatatcggtaaatgtctttcgttctgggtgattcttgtagtcagacaagttttggatacactggcctggcctagatttcaggagggctggagagataaagggagcagtggggaaagaaagtttttgaaaatgtatgagtgaaaggtgagtacagtaatgcactcagcacgattctcactgtgtttgcacttcccagatgtgttggactggcacttttagggtggtctttagaagacaggcatttgggactagtaggcaagactcttgactgtcttgatgaatacttttggttaagataaacctgtttgccagtgatacctggctccttgaaggtcttctctgcctagcagactattcctcagagttacgacgttgcctggttagttgggaaagagtctgctgaggaatgtgagccggcagtgtcctttttagaattctatcatacactcaattatattatctccgtctgctggcagggaggaactattgccatgactggtatagaagaccttcagggaaaactcttcaggtaagaagaaactttgaccctttgttgagtcagaggccagtgcggaggtgcactcgtgaacatgggtttgggaattgga

SEQ ID NO: 95200 - DNA, 1021 bp, Homo sapiens
gctcttgggagagtgaggaaaggtattagtgcatcaattctaaacatattcagaataaggaaggtgaccaatatgaggaaagataattggtaaaattgagccttgaataagcatttcaaaatgatttagcattaaactttgggagactaacctcagattaacagggaattgcaaactattacaagcaaaagggactttaggaataaacaaatttcctcatttaaaggattaggaaactcaaaaaacacccaaaaccaaccatcacaccttctggagaacattaaggtactatttaaccaaaattgagttgactgaaatagtgtaatatatgatcagataatttagtgcctaaaaatagttgaaactatgccaaaactttgccagtgattaaattcttatttttcagatatatctgtatatgctagctagtcttttcaaggctgtcaagtaaatttctgagaaaagcattcatgagtagagtacatataaatatattcgaaattgtcaggttttaaaaacctgctggccaggcacagtggctcatgcctgtaatcccagcactttaggaggccaaggcaggcagattacttgaggccaagagttggacaccagccttaacatagcaaaatcctgtctctactaaaaacacgaaaaactagccgagcatggtggtacatgcctgtaatcccagctactcgggaggctgagccctgagaattgctagaaccctggaggcagaggttgcaatgaaccaagatggcgctgctgcactctagcctgggtgataatagtgagactgtctcaaaaacaaaaaacaaaacagaaaacctattagtggaagttgtaatcaaactttagaagttaatgactagaagatgaagaaactttggagattcttcaagtttagatttggtggtaaggcaagacgattgagaaaggtatatgacttaaaaatttaaggtatataacttaaaaatttaagcacatgtgaggagcctggtgaaatgggtgaattggtttc

SEQ ID NO: 95201 - DNA, 1463 bp, Homo sapiens
agagcaagaactgtcctcaacttttattgcattgcaaaggcttatctgggtaccaaataggcatccctgcctacaagagtcctatgtggtctggtctcctgccaaactatgcagtaagtgcgtggtgggcactcaagtcatgccaaagtgaatgcatgtgaagctgccaccatttaaaactgtcacttaaaagttcacctctgcgttgcattagtaaagtaattgccacctgactgttttcctggcacagtggttcagaggtctgaaaaagataagcttgtgatcctttgtaggaagacataagttttgtgaaaagctggagtgattacttacagtcttaaagccctgaattgtatagtttatcacttgtttcactttcctgtttctttttatttggcaatggtattatgtttgtttagtattaagcaaatgatcttaaatttggtagcattttattatttcctaactagggacttccttttaatatctgttggtttggtatcttctaggcctctcccagtatgtgtcctgtgcagtctgtacctacaacagtttttaaggagatactgcttggctgtactgcggcaactccacctagtaaggacccaagacagcaaagtactccccaggctgccaactctccacctaaccttggagcaaaaattcctcaagggtgagtagtgatttgttaaagatgtttaattataataataaaaaattattttagtcatggctcattgtttttatccctggttgtccagggaggtttttcgttagagtttctgagaaaagatggatagatgcttttgaaggtgaaaagtatagaaggcacacagagcaacatagaaaatggtatagaagtgaaagggggcatgagaaaagagactgtcttgatacagtgtgaaggagcaattgaaatagtacctttgtaaaacaggtgtcttcttttaaggaaaagggaacagattggttgtacatggaagactgaggtcagtgggagtgtgaagaagcagtgagacatggttacagtgagagattctccgcagcctcgacatgaattgacccaagtatagttgagaaatttggcagtagagaggactctaagaataatagaaatgaggaagcaatatctgtaggtggtaactgttactaacttgtagaggaagaaaatgagtacgaaatgtaaagtttcactagaaagtttaaagtaggtacaaggttgacagagcaagtagtttcaagggaaggatctcttctgggaagtggtggtggcctgcgtaggcaggcagttgatacagccttaagatgtaggtcagagagactgtggtatagaaaagtaggtttggaaggtgggagagtggctgagcacactggttcactgggaaaaagtagtcagtctgggatagagcttggaggatggccatgtggcagtcagacaggaggaggagcagtcttcaaaatag

SEQ ID NO: 95202 - DNA, 1434 bp, Homo sapiens
gtttctctgaaatttacacacaaaaaaaaaaaaaaaaaaagaagaaagaaaactttcggaattgcccctacacagacttctggttttgatacttataaaccagcttatctgctgagtatattctttggtttcatacaatattttgttttgagggaaagctaaggttcattgtgctgtgagaagtagaactaacgtaagaagttaaagatttctgagaacgtgcagacataatttagggttgtatttttctgagtgtttatgatttttgcagaaccattgactgatgacttttaactctagctcacagaaatctatcctaaattctgtaacatatgagaaattttcttttttctttcatactcgttaccttagggaaccaaacagtttgtttggggaagataatggagagataaaaagaggcctggatgctagctttctatattatatttttcagatgtcataaacaaagtttaccagaggaaatttcttcctgtctaaatacaaagtctgaagctctgagaacaaaaccagatgtctgcaaagcagggttgctctcaaagtcctctcagattggaactggagacttgaaaattctgactgagccaaaaggcagctgtactcagcctaagacaaacactgatcaggaaaacagattggagtctgttccacaagcattgactggccttcctaaggagtgcttacctacaaaggcttcttctaaggcagaattggaaattgccaatcctcctgaactgcagaagcacctagaacatgcaccttccccatcggatgtttcaaatgcaccagaagtgaaagcaggtgtcaatagtgatagccctaataactgttcaggaaaaaaggtagaaccttcagctttagcttgccgatcacagaatttaaaggaatcttcagtaaaagtagataatgaaagctgttgttcaagaagcaacaataaaatccagaatggtgagtgtttctcaatatctttattggtagaaggtaagaaatggtagatatatatatctctttcttgtcctatgagaaactatgtgaaaatgactttgtagaaatagtttatacagtcagaaaagttgaaagaaggtataattcccaaatctcagaaacgattactgttaatattttggtgtacctggtttcatgtatatagaaatacagataaactgtattacacaaatgggttcatgccaataattttaccctgtgaattagtgtaggtgtctattagtattttaaagcaaggattccattatgttcatttaccataggatttaactggttcctattaggtgggtaattaggtggttcccaattcttaggttaagaaaattttgaaacaaaatctaaagtaatctggtgtttactttatttcagcttgtcactgatctttctgttacatccaggttggagtaggaa

SEQ ID NO: 95203 - DNA, 1048 bp, Homo sapiens
actagttccccagaagctgttggtttttgactttcgtttgtttgcctaaaaacccacttccctcttctcagctctctgggaccctaagaaaaggtcttttctgttttctatgaaatactccttaaggctcttgacatacaaatggattccttactttgttattttctctgacacggtgattgctctttcctgatacatgtctaccttgtctttagaaaccatgttaacatttcaaattctccggcctattacaagttaaaacataaaatctgcatttacttagaatgataatcctgtctgtagccagtgctcttaatcctgcttggaccacatgtgtgaaagaaggggagacatgtcaggagtcaagtgacaggcatttagaagatgctctaactccatagacccaggggctacgtaggaaagtgattcgtttattgttatttttagaatggttagcttttgcattgtacttttaaaaacacaccttaaaccagtcttttttgaatttggaaagtgacagaatggacatctactaagtcaggcctctgcagaagtgagcctcgagatcgagtttgaattaaatgtctgatttgaaaacatcctaaaatgtagagttgtgaatagaagtatacattaactttgaattgtgagtctggctgtttaatttggggttttatgttgccaaatggattgagcaaataagaattgttttataaagagagtaaaactttcccagttattctgatagttgtcttctgttgagccatttttagaaattacaattgaaccaggaattgagaagggagttctctttaagggaatattgggtttttgaatagaattcagtcatatatgaatgtgatttttaaaaatttgaggtcctgtctccttaatcttttgttttcctagccccatccaggaagtcggttttgacagacccagctaaactcaaaaagctgcaacagagtggcgaggccttcgtacaggatgattcttgtgtgaacatcgtggcacagttgcctaaatgccgagagtgtcgcttggacag

SEQ ID NO: 95204 - DNA, 1719 bp, Homo sapiens
tcaagaccagcctggccaacatagcgaaaccccatttctactaaaaatacaaaaattaggcgggagtggtggcaggcgcctgtaatcccagctacgggggaagctgaggcagggagagttgcttgaatttgggaggcagaggttgcagtgagccgagatggcaccactgcactccagcctgggtgacagagcgagactccatcccaaaaaaaaaaaaaaagtaattacaagttgtaaataagttgtgtgtgtgtgtgtgtgtgtgtgtgtgtgtgtgtgtgtgtacattacatctttttttcccctgcttcccctaggttacaattcaacaaacatggtgtgttgcgggtagaaggcttcttaacaccaaacaagtatgacaatgaagcaattggcttgtggttacctttaaccaaaaacgttgtggggattgatttggacacagcaaagtacatcttggccaacattggagaccacttctgtcaaatggtgatttctgaaaaggaagctatgtcaactattgagccacacagtaagagcatctcttagggggtaggattttcgagcccaatttgatttttgttcctaagtgacacctaagtcctaattgcttgggttttttttcacccagaagtttagataactttggtataatgaggttgcatttttccttttgcaacaggtttgatcagagttagccacctatctttggggtttattttgggccaattaacagaggagtggaactccttttttgttaggaaaggtgaagtgagggtggaatttgcacagcctcaccagcagtgcaggcacactaaaaggggatgaggtctcagattggtttattttaaaacaaaggttcttaatcatgaatacatttcgaggaaaataagaatgggaaggctgactctcagacctaccgagttagagtctgcagggctgggtcccagacttgagaatgagaacaggttcagaatggaaatgattgttagagtcaaggtttgaagggaatacttggaggttctagatgtgcatgtgcttgtgtcttcccctctttgggagcactgttacactgatctggcagccattaagccacaggaatcagggtaggtggcacattagagccagacctccttcatgacatctcaagctaggatgtttggaggacggtgcagcgtcttcctatccatgtccctctgtggaaatgagttatccagccagaagcaccatggggcatctgtcttgtaagcctcatattttcttccatcattttatctttaccagtggttgaagttaaaagtgaagcctttctattcctctggtgtgtctctttttagactttgcttaaccaagtatgtttgaatacaagcatccatgccagtcttaagaattttgatttattaccagcaactaacaacctagcttaagcacaaaaataacttattgaatatatgtggatactgtctcagagtccaaggaacaggactaggtcattcccagctctaggaatccagagctgcctgggagaaagggaattgcgagtgcctgggacaaccagagctattctttagaattacttcattctgctggggtagtggagactctaagtcaagagtcttattatacttttccccctgtagtctgtttaagacaagcaatattagttttccattttcaatagagatacaaagtttctttattaaatatatttaagtaaaa

SEQ ID NO: 95205 - DNA, 1045 bp, Homo sapiens
atgagttaaccccaaactggattaggaaaaagatgttctccatagaacaggagtgcagcagctttgatccagtgttgttcaggagagagagagactgactgccaggagtctcctagtcaggagaccttgggcttttctgtgacccacagaaatgtcctccctttgctcatacttctgaaagcttgctgataacctggtttggttccctgatttggcactcctccatctaggggaagggttcaatggcccatccagttttggaaggcctctccctccagttattaggtcttggccactggaacagaaaatgctgctttgtggaatccccggtcgtgccttaatctgctggatgtttggttagtgtgagttagtcctgggtgcctgcatcattcctggcactggctaaatcgaatttctgactgactggtgaagaaactgatcttggaccattgtgcctgcacaaagttaatgtgcaactccctccaggccccctgagaaccttggagtttttaatgggcagtctgagtggatgtagggtatctgaataacctgatactcagtgcagattactgggtttgtggatctgagtaaatttttcttttttcctttggagaaagcctggaacatgctgcctttaaattctgaaagggactcatgactcagaggttaagaaccactgttgtgtgataacctgtgtctgagctccaacttgtgtaactactgctgcacagtctgaatagggattctgcttggagttcattctcctagagggaggtgagactgtgcctgaatacataaagtgagaagaggcatgaatctgaagtacaaattcaagttactaggagtgctgaggggatccaggaacacttcatggggtggaggacagcatttgcaatgaagcctgaacaaagttaatttgaagtctagtcacagggaggaatgacaataacccctacctttcgtttttggtttcagaagccctctccttccaaagactaagtgatttactgatttttgcaggacaggttgcttggaagcgagctgt

SEQ ID NO: 95206 - DNA, 1008 bp, Homo sapiens
ctccaacacttttcgagtcaagttttgtgggatagttttgtagtagaaaagaaaatgcattttggggaaggcctctggagcaggatgaaaaggagggagtgggaaaagtaatcctgtggggaatgccagcttctgctctgtaatgttgaggttgaaagttcctaatatccttgttcagatgtttgcctctgccctttctttagcactctatgatgttggagacattgttcattctgtaagagcgaaatggggaataaaggcaaactgcccttgttcaaacaggcaattcaaactcttttcaaagccagcctcaaaggaagacctaaaacaggtatttactgcttatgttaaattcaacatctcttgtaattgtcatttgtctgtttttcaaataacccaaggatttctatcagtgcatttgaaaggaacctggggatagctatcaagtggaaagagagagagaaagaattcatacagttcatgtgacagttcagagacccgttctgacttttcacattactttcgtagactctactgtggcctcttgtagtaggttttacatttttgtttcttgaagaagcacaaagttctaaagtagtctacctaataagtagctgtcgaatttgtaaagggtttaaaaaaattttttgtgtattttgcagaattaaaattattaagataagctttaacatttttaaaattactaaatatattttgcctgtgtttatgcagagttgaaggaaatgatgaaatgaacctttagttgcccatcacacaatgtaaaaaatgttaattttctcagtcctcatatgtctctccttggtggcatccctctcctccccaccatcacatgtacgtcttgctgtcccttctccccctcgttccagtaatcagtatgccgcattgtgtttaataatcagaaatttacatttctataaagctgtggtgtcataaggcaggatgggagagcagaagacttgtaatatttggagtcagaactgaatttga

SEQ ID NO: 95207 - DNA, 1342 bp, Homo sapiens
tgacacccgtaagcaacaacaattctggtttcctccggaatctcttgaattcttctacaggaaaggtatgtgtttgtttgttggtattccatgttttaaagttgaagacagaacaggaagagagtagagaagttggaactgaaagtagaaaggagactgaatcacatacttacctttgtgggttcagaaggctgagtcactggaggatgggttttatgggactatagttctgagctgggccactttctcctgttacctcacttctatgagttgtcaagtggggacaggggacgtacctttttgcctgggggtcctggcttggaatcttctggatatgtaatctatactcattatgggaatggagtttcttgatggtaagggaatgacatatttgagacttttgttctttctccaattcagacagaaaatggactcaagaatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcaggtaatgtaggcctcccatcctcctgccctattcagaacccccttctcagttcctttagcagacttctgacaaccccaccccaggctttccccctccttcacctcctgttttattctttattgtttcaggtgaatataatcaggtcaggatgtggccatgggtcttactttttaaagcagatggtcctaagctggacttttccagtcaggtttttgttgcttcctaccagtccctgttgggtttttgacgagggcatccaggcttggtgattcctatggtaaacttcagcagaggaagtgagggtgtgactacaggctgatgggatttgggagatcagacaaaatgtgctacaaaatcatgcacccctcttacctgaatgaaaagcctgtgctgaaggcagttctaggtgggctagggccgcgtggtgtcacatagtccccaggtgcctgcttcaaagggcagtgttgttggatcttaagtgccggttaatatctttaggagaatttctaggcctgcttctgtgctttcttgttttggttctgttttctggatctctggcttctctgtttggccagatagggtctttgctaaaggaacactctgctcttggacaagaatttgggagaattgccaaacagaaagatgtgagtgtttaaccaaaaataaatttccaaaatgtttttct

SEQ ID NO: 95208 - DNA, 2285 bp, Homo sapiens
aacaggctcaagtacggtggggtcagtcaccctgtttcactggtgactggtgtcactggacactccttccagcgcttgtcttcttcacagtccgtcttgctgtaagtaatgagatcttactaggagaggtgatcctttctcctagatgcttacccatgtagtttgagagcaagggtgtgtagcagatgaatggtgaaggttggaggtgctttgggagctcagagaactaagccgaaactgtcacatcaccatctgagacggagcaccagctccatggaaatataccaatagcagtgtgaagagggactgccttcgggagtggggacagagctggcagagttcagactaaagttttccttctcttcatttagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaagtatgtatgaaagatcttttaagggggttggggatgtgaaaggaggggacacaggaatggcaggagtctgagacccatcagtggcagccgcagcattttccaggattttggagtttaaaattaacgtctctcctccccttccttgttacaatgtttatgcttttaaacactgaggcattattacctgttctgttggtctttgttgtccctggacagaacatcagatagggtcagtctctctctctgagcagaataagtaatttctgttgcatgctggcctcagaaaaatgggtttactaaacacctgtgacccttgatggttgacgtgcattgctgttggttagttgggatgctgctcacttcttctggaacactgtagaggaggagcagattggatcgatgacagctgttgaaataccacctacatgcagtgggcaaaagggagcggctgaatctcccaagaatgagtagcagcttaataagcttctaggaaagacaaggccctgacacagatccattagttggtgatctttattttgctgcaccttgctgcctcctgggtacaaatggatttttttacactgcagaaataaaatggtggatagttggtaggaggggaaaattaaggaaaagtaatatttgtatactaaatttatcaggttatgaaaattttgcagagacatattttatttgtattgttgaggcataaaatgctaatttgtcatttattttggtctgtttctgaattataaatagtaatagttcattctgtttacctttcagatcgtttgaaaaatgaaaaagaaccaatggtgttgaaacttaaggactggccaccaggagaagattttagagatatgatgccttccaggtatgattatgaaggtggggagagatgattctgtccttcacttggtaggataaattcttttttgaggtagtgagaaaacagttttcaagaaaataacaaaagttctgtaattatactgccactgatttttcatttctagtctgtagtcattggaggcatgtttatttttagatgagatgaagaagtgattggcttttaggcctggctgactaatggaacaccacagattttccatggtaggccctgctagagaagaggctcactttttcttacaaggctgatttggaggcagttgtggaatctgacctgtcagggtcaggacaatgtagtcacagcactgagttagacaagaagacatctactgggtagatctattttcctgactgagcttgaaactttgaaaagggtgtcacaactaatcaatgatatatctctaagaataactttttgtctagaatttattgctgagatcttttgtctgaacggttacagctgattttgacacattggtgtgttgtaggagagagagaagacatctttgtaactgctgtacttctcatcttaaatatttgatggctgtcagtctgcatgatcacagatggatttgttccttttggtgtagaaggaacaaaacaggttacacaataatgaattagaaaagcaatctaactttgcaaattcctggttctgttgttctaggtttgatgatctgatggccaacattccactgcccgagtacacaaggcgagatggcaaactgaatttggcctctaggctgccaaactactttgttcggccagatctgggccccaagatgtataatgcttatggtaaggaggagatggctaactttaaaatggaaataaaacaa

SEQ ID NO: 95209 - DNA, 1021 bp, Homo sapiens
tttaattgtagcagatgttaagacagctagaatgccagcagattgacctaaatgtccgaacactgaaatcactaataaaagtacattctctcaatgatgtatcacacaccattaaaagtcatctaaagactattaagtaacatgtaaagattttacaatgtaaaattaggtacagtaaagggaaaaacacaaaattgcatatgccctacaactgcaactatgaaaagaaacacacaaacatgtggccagggaacgaaaggaaatatgtaaaaatgaaagctgtggctgtattacgcattaggattatgggtgttttccacctctccctcccacaaaatcaattttccaaacattttgaattgttttatttccattttaaagttagccatctcctccttaccataagcattatacatcttggggcccagatctggccgaacaaagtagtttggcagcctagaggccaaattcagtttgccatctcgccttgtgtactcgggcagtggaatgttggccatcagatcatcaaacctagaacaacagaaccaggaatttgcaaagttagattgcttttctaattcattattgtgtaacctgttttgttccttctacaccaaaaggaacaaatccatctgtgatcatgcagactgacagccatcaaatatttaagatgagaagtacagcagttacaaagatgtcttctctctctcctacaacacaccaatgtgtcaaaatcagctgtaaccgttcagacaaaagatctcagcaataaattctagacaaaaagttattcttagagatatatcattgattagttgtgacacccttttcaaagtttcaagctcagtcaggaaaatagatctacccagtagatgtcttcttgtctaactcagtgctgtgactacattgtcctgaccctgacaggtcagattccacaactgcctccaaatcagccttgtaagaaaaagtgagcctcttctctagcagggcctaccatggaaaatctgtggtgttccattag

SEQ ID NO: 95210 - DNA, 1021 bp, Homo sapiens; identical to SEQ ID NO: 95209

SEQ ID NO: 95211 - DNA, 1021 bp, Homo sapiens; identical to SEQ ID NO: 95209

SEQ ID NO: 95212 - DNA, 1048 bp, Homo sapiens
cttttcttgccagctccatcctcttcctattgcccttagtctaaccaccatcttcaagtttgtgtttatcgtttgcttatatttacaattttaacatatatatttgtattcctgcacaatattctttcagtttttagcctgcttttgaacttcatataaatagaatcagattttttatattcatccatgctgtcatatatcatccatgtgttcatttcattcattttatttctattacattaattgcttttttctgaaattttgctttttactatggaactatttttcaaatacagtgaaaacttgagagtctggtagtgactccatataactcatcacccagttatataacagcttttaactttttgccataatcgtttcattgtcttctctctttatgttttttcatcatcctctcaactatcctatgatttcaccctaataccaaacgctttacctactcccaggactgatatttcagcaagctggaaagaaaggaaagtacaacagggctctgggggccctggtcccaagctggagtgaagaaatgtgccctctcaaaagtatagcccctctaaaaccaaagccccaggcaagccagagataaagccttcctccaaaacagtattatggggcgttttcagaggctggcaggttagaaaacagccgctgcttgctcactacaagctgtgcttctccctactgcccagtctaagaagcagagtcctggtgttacaatgggttgcccaaagtgactgcagggtaagcttcaggatgattgttgagcaaggtgagctttctcctgtgagcaaggaattagccacagactgaacactgtgggggacctgtctttctggctcactcctcacccctcctcttttacagttgagagaaccaaggaatgcgttgggcagtattccttcttatactcatgatagccatttgacgttccaggtttatgtgtgtgtgtgggtgggtgctttcccttggactccccatctcgagtggtccttgggctttgtctcttgccccagaactcctaggctgt

SEQ ID NO: 95213 - DNA, 1519 bp, Homo sapiens
gggaaaaatgataaaagctgtaccttggaacttgcctctccctgtactcactgtgagtaggtctacgtggtatcaaaacctctaaaagggggaaaatgagttcttgaaatcatgggtttaaaatgtatgtgaaatactggtctgaaggagcccagggaccttttgcaatgttgacatttcatacgaatattgaattttaaattctgagagaaggtaataaaattagtaggaggaagcttattcttagtgacaggttttagatttaaatgtaaaatgcccatattttctcctactatttttaggtgaagaatgttatctaccatgcagtgaaagatgcagttgctatgctgaaagccagtgaatccagttttggcaaaccttaatctccctgcacattggaaatgaattacaggcagctgttcaaactcttcaggcaggattcctgtggactttgagattcatgttacctcatcttcttttttaaactgtacccaacttgtgagggtactctgtctaatgtatatttctagtgtttacagacagtaaatgtgtatatgtagtaactatttacagaacatgcatccttaaactgtgacttctcacctagtgcagaacttttaccaggctgtaaaagcaaaacctcgtatcagctctggaacaatacctgcagttattcttcagctgtttggacaacttagattgggtttataactattaggaatcactgcacagtttatttgggttgtgttttgtgtctgagtcccctccctcatcccttagggtccagaagagcaatggaggaagtgacagctaatgttgcagttcttattgtatggcataggactggcattatatagcagaaatcaactactgtacaatttcttggggttaaccatctttagttaaatggaattttaatttaaatgacgctttgctaattttaagtgttaagcattttgcattaaaatattcatataatattttggctcagtttattggcattatcctctcattgtggtttcaacacaactttcttcaaatgcaggtgtaatggattgctccaagaactcttcttaaaagcaaagaaatcagatgctatagtgattttcttagtgattattacaaagctaacatggaaatttctgctcagccaggtagaaaccctgtcacactttgtcaaggaaacaccaccaattaattaaatttagaaacaggaattaaccaagaaaccaaatagtgccaggctaaatggttctaaaaaggtaagtaatgaaacactttgttttatggcccttcataatgttaagtttatgaaggaaaatgaaattataagttctaggacagtactacctaaaatattcatctctgtgaaggaaaaaaattcacaaagaagcgcctttctttagcccactgattctcctaggccactctttcatttaatttctttaaaaaaaggaattaaacatagaaatcagatagtacatagacaaagcctagaacctgagttttaatttgtgag

SEQ ID NO: 95214 - DNA, 1073 bp, Homo sapiens
aatttagattaggagcttcagaaccgagattcttaaaatccttacaattattatgactttggtatcattacaggtagctatttgcacatttcccagagtgagtaaacccccccaaaaacagcttgctgtactgtctcatttttgtatctggtcagattggtccaggaatgaaaggcagggaagattgaggggctgcttccttaagccaatgtggtgttcatctttgctctttcttttcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttggccccattgtagattgccctgtgcagtaaactttcaaggtgtcggctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatga

SEQ ID NO: 95215 - DNA, 1003 bp, Homo sapiens
atattccaacccctgcgttcacggattatatttgcagtgttaggacagatgcttcccaaaacagcgctggaaatacactcatctgtcagtgagctgtttctcaggtgctgccattatattaagtctgggttactttaggaagctctgctgacagccagtagtagcactccccacccctagggtgttaaatttagagagccgtttccctttggggcttttgcatttctgcagagaggacaacatccagtgtttcctttggccagctgtctcgtgtgtcagctcttgaaaggatagactggacttaggctagagctcggtctaggtgatgtgtagggtgtctgatgggaacagatttaacagttgaccgaagtgacatatttattctgtttaggctgggatcatagaggagatgttagaggacacttttgaaagcatggacgatcaggaagaaatggaggaagaagcagaaatggaaattgacagaattctctttgaaattacagcaggtatgaccgtgagatccatcctttctcctctctttttatggccattcttccttcattcactaaattagctagtagctttttctttaggcattaactcccttctacatttttaacgttttacactgtgcagcttatttcttgaaaagtaagcacaatatctataaccatcttttaaaaaacacaattcttaaaatttttagagtttgcatgattttaaaggaagatactgctctcatatactgctgttgggattttaaactggtgtagactttcttgaaagcaatttggccatagccattcaaaagcccttgccttcgccaagtgcgatggctcacgcctgttatcccagcactttgggaggctcaggtgggggatcgcttgagcccaggagtttgagaccagcctgggcaaccatagcaagaccgcatctcaaaaaaatatatattaaaaaaaaaaatttgacctaatagattgacttctgggagtttaatgaaata

SEQ ID NO: 95216 - DNA, 1489 bp, Homo sapiens
cagaaactgagcttttgggtcatcaggtagtttccctaaggtcaccttggttgtaagtgaagatatagagttggggcactgcagtctgaccttatcacgtgagttgtcacagaggaaatgaggatgggaggtccctcacacagatgctgtttcatgcttcagacctgtggctgacaaccaagagtgtacacctcaaattcttgtatagaggctgtgcatagaaatcacctcccttcctctcagggaatttcatttatgaacttgaattatgtacagggtttagggcatgggagagaggggctggaaaagaaaattgcagaaaaatgacatagaaagcccagggcccaggttgtttgaatgagaactccttgggcagtagcagtaaggaaggaactgggtcaggagggtatgtcctttacaaatagcatgtaggtgtcttgcccccaagttggtgatcactgttcatctagaaccagataagaagatcattcttggagtgccttcaggcttgctcattttaactcagccaccaggatctgagagggaagcctttttcagaatctgggatctttttcataatggtttctgaatactgggagtaatacagatttggaggaaggcttgcgtgtagtacattctgaaggccccagtaggggctcagctcctcaagggcaagaacacatcttagtcattctgtttatcccaggcctattgtgtggcacagagcaggactttgatgaatcgttgctgattgaatgaataaataaatgacaacttctacctccagagtgtgaagggctattacaattaggattctggtggactctttttaaccaattagcaagcatttattgcacttcttttatggtagcccccagtactaagatgatcccattcaggaaggccctagggtttcacctgggtgaacatgaatatgaatttatttgttcattttggttgggaagaacggatctgaggatgggcagaatagggtgctagttagattcaggcaggcaggatagagggttgctttaaatctgaacccttcagcatagtcactgagaattgtaccctggctgagtacaagggagccagggccggagctgctacatgtgaccttctgctccttgaatcaccaaaacatcaaggtacaaagcaagggacttagttttttcaggtggcaagacaaccaggattttctttttctagcaacttctcagaaacctgaacccatgccctccaccacagccactcagcacccccagtacctgttctgcccagggatgtcagcagccctcttgttgactttggaggttgctgttccgaccctttgcttcagtaacaaagaacattcagtagggccctatctgggagttgaggaactgctgagcacaaagactgcagggctaggttgggttgggccagtgttaaagccatttgcttgtgtcctgcagtggtgccatgctgccttgagaacagaggaggctga

SEQ ID NO: 95217 - DNA, 1489 bp, Homo sapiens; identical to SEQ ID NO: 95216

SEQ ID NO: 95218 - DNA, 1489 bp, Homo sapiens; identical to SEQ ID NO: 95216

SEQ ID NO: 95219 - DNA, 1489 bp, Homo sapiens; identical to SEQ ID NO: 95216

SEQ ID NO: 95220 - DNA, 1489 bp, Homo sapiens; identical to SEQ ID NO: 95216

SEQ ID NO: 95221 - DNA, 1054 bp, Homo sapiens
cccatttcagtgttaagagaaatgaagtgttctctgcaactagcaaactcccttactcctttagaaaaatcacagtgctatgaatgtcagacaggcatttctctggtcactcttgttttcccttagatgtgaaagcttcctagggtctggattccaccagaagtaaacctgtagtgactcctggtttagccaggaggaaggaagtctgtgtgccggttttagggaacagcttgtatatgacagctctcagaacttcaagtctcatgaaattccaaaacaggtttagatggttgccaactctttgacatgttaaagacattgagggtggggcaatgatcttttgatactaccgtgatttcttataaagaagattgtagtaggcatacaatctcagactacagaaggtttttctctagtaaggaaccacctcacattgacacacatacacatattcactgtatctgtcctagtttctctcatttttctgaggaccaatgataagctggctccatactgaacagatactgtccataggctggtgtgtggggagctctgctcgggtcctgaagccttctctttcctagtgtggcctttacaaggtctggagctctttctcccatttgtgattttcctgggtgtcacagttactccaagctggcttcctttcctaaaagtcaagagtggcttcaggccactctccagattggtcatgtggtgtgcatgctcattgaattcacatcagtagtaacccagatagcatacaatttaggaaagtcaatctcttggtcaactagcacagtaattaatttaaaggcacacaaataacttcgggagtccatctgctactgctgtcatttattggaatggctcataatttggctgtctctctctattccatcctgttgaacaatcctgactgtacacattctctttcagcggtcttgcgagtggctggttccctgcagaagagcacagaagtgatgaaggccatgcaaagtcttgtgaagattccagagattcaggccaccatgagggagttgtccaaagaaatgat

SEQ ID NO: 95222 - DNA, 1054 bp, Homo sapiens
tgggcactggggttaaaatcgtgaatattacaggcgcaatcactgccctctaggtatggggtaaattgcagatgattgaagaaatataataaaaaataaaaataataaatttaataatcaaatggatatttataattgcttactgtgatatgcactaggagaacgtgaaagagaaatgtagagtcaggaatggctcctttcaggcactgatgaatcctgaaagaagatgaactattaagtttgtgggggtgtgggaagtggtgtgccaacttggatggctagcatgtgtgaaggccctggggccaaaaagaactgtgcattcccaacacggaaggaaggtctgggaggttgggtaccgagcaagtgggagggatagctggagaggatgggcaaggaggtgaagatgacaatttttacagctgttaggagagcaatgcttctccaagacaagttcaaaataagacgtgctgtagcaatgcagataaagtgcaatgggagttaagaggaaaagtattttggggagaatcagggcagcgtctgagtgtagagggattaggtatacaaaggcacagttgaaatatttcaggctatgttcaggaaacagtttgacaggaatgcatgaaggggagcagtgggaggtgagactggaaaggtaagttggagtcagagttctgagatatcaggctgaggaatttaaattattctgtagacatttgaaagctttagcacattataagcacagagcacaggtgcagggagggacagtgcagtgtgattggaggcagtgggacctaagaggtaatggagtggagtaggggaatggaataggttagtctagtgagaatggagtagaagacagaagaacaggtgcagagtgaaggtataaacaaggctgagatgctctgagcctttgagcctggaaagagactgcagggccattaacagacactggaaacacagggagaggaacaggtctaagagaggaatcttcacttgggctgaccagactagccccaggaaatcagtggctatttggttcacctggcttctgcag

SEQ ID NO: 95223 - DNA, 1054 bp, Homo sapiens; identical to SEQ ID NO: 95222

SEQ ID NO: 95224 - DNA, 1054 bp, Homo sapiens; identical to SEQ ID NO: 95222

SEQ ID NO: 95225 - DNA, 1054 bp, Homo sapiens; identical to SEQ ID NO: 95222

SEQ ID NO: 95226 - DNA, 1054 bp, Homo sapiens; identical to SEQ ID NO: 95222

SEQ ID NO: 95227 - DNA, 1250 bp, Homo sapiens
ggtgccatctcggctcactgcaacctcagtagtcttaatggagaaaagcgggaaaggagtcaccagacagatagatgagaacagtatatatatgcatagttatcaagtattttacctgtagcgtaacccacattataagtggtgttttagttcagcaaagtatcacatgaaatttacgttgttaatgtgaattttattgattttgaagttttttgtatttaattttgtttttgaaatagttttataattgtacaattataggcattgggaatttttacccaattagtaaaatacacataattaaagccaacaacagaaagttattggtaacaggggaactgctaacattttatttttcttcagtggaggactgaatcagtaaattatgatttatttaggtttcagcatagtattcagctacagaaagatgttaatgatgcatcatttaataagaaagcaagttgcagaacagtatatatagcatgatagcactctgtaaataagtagaggatgtgtttgtgtagttgtgtaaataaatgataaatggataaacagaggtctgaaaaaggttcacttctgaggagagaagttggattgtttgaatcatcctgtattgttttctctttaacttcttattatggaaatattaagcatatacaaaagcagagtgaatacccaaatgaatctctatgtacctatcacccagcttaaacaattgtcaactcttggctgattttactgaatttatattcatcccacctagtccctatattttcctctgggaatccatatacatttatccctcggtgtccacaggggattggttccaggatccccacagataccaaaatttgtggatgttcaagtcccttatataaaatgaggtagtatttgcatataacctacacatatcttcctgtatactttaacctctagattaattatataatacctaatacaatgcaaatgctatgtaaataatagttatactatattgtttagggaataatgacaaaaagcttatacgtgtttggtacagacacagcctttcattttcgttgttgttgaatatttttgatattgaatattttgttgtctttggttggttgaatttacaaacactgaacccacagatatggaggaccaactgtaatttcatctataagtatttacatatggatttctaaaagaaaagtgttgtatccttctattccttggtgcatcctttcagtcctggggacttgtatcct

SEQ ID NO: 95228 - DNA, 1250 bp, Homo sapiens; identical to SEQ ID NO: 95227

SEQ ID NO: 95229 - DNA, 1250 bp, Homo sapiens; identical to SEQ ID NO: 95227

SEQ ID NO: 95230 - DNA, 1250 bp, Homo sapiens; identical to SEQ ID NO: 95227

SEQ ID NO: 95231 - DNA, 1250 bp, Homo sapiens; identical to SEQ ID NO: 95227

SEQ ID NO: 95232 - DNA, 1049 bp, Homo sapiens
cgagtatcagagagaatggaaatactcagagaaagaacttcaaatgtctccataggatccattggagtctttggctgaatactaagctgtgcatgcttagagtgaaatttcaagagactgggcaaagaacaattactaggaacagaacaactaccaggaagctgtaagctgaataattcttagagctaataaaggattgagaagtggttgagctctgatcagacacagaaaagagactttgttgaacctctgggatgttcaatagagacctcagaagagtcacaccttaataataaggatcaggtaggtagtcctagaaaaaaggctaccacaagcccataccaaccaaccaacaagacttaaaagacttcacggctgatttgcaggtaatttgactgcctgccaaagtaaagattaacactgtttaagggaagactacaaaatgcaggcacccaacaatgaaacatatacagtggccagcatccaataagatactattatgaagaagcaggaaaatgtgaccccaaaacaggagaaaagccaggtaatagaaatagatttaaaaaaaaaaaacacccaaaacccccacaaaaaaagatgattgaatttgcagtcaaggatttttaagcagctattataaatatgttgagattaaaggataacttaaacataatgaggagataaatacaaaatacagaaaacaacaaaatggaatttctagagttgaaagatctgaaatgaagtgaaattaaatgaagaatcactgaatgggtttaacagcaaattagacactacagaaaacaagatcagtgaaattgaagatatacaaaatccaaaatgttcaaatgaacatttcctttgagtatcctgtcagcaacccaaatatttcagattttggatttcggattttctgattagggatacacaactggtatgatgcatggtatgatgcaaacattccaaaatctaaagcctgaaagacatttggtcccaagcatgttggataagagatattcaacctgtaatacaaattatccaaactgtagtac

SEQ ID NO: 95233 - DNA, 1049 bp, Homo sapiens; identical to SEQ ID NO: 95232

SEQ ID NO: 95234 - DNA, 1049 bp, Homo sapiens; identical to SEQ ID NO: 95232

SEQ ID NO: 95235 - DNA, 1049 bp, Homo sapiens; identical to SEQ ID NO: 95232

SEQ ID NO: 95236 - DNA, 1049 bp, Homo sapiens; identical to SEQ ID NO: 95232

SEQ ID NO: 95237 - DNA, 1056 bp, Homo sapiens
tcctctaacctgaaatcataaatgtattctcctatactgtcttcttaaaacaccacagttttgcattccatatgtcttcagtccacctagaatgaatttcagtgaaggatggaacaggaattcaatcattttgttttctatttgtcttaagctgtctctcagcattgttcatggaaaataacctcttaatggtgttagtttcctttgcctagtttcgcatataatagacctctgtgaatgaatttgaataaaggataatattttggtagtgtgaaactctttctataggttccttgtggttttcaaatatattgtctaatttactagttgattttttattctgtacacgttatgttctgttttacttaattataagggcctcatttactactgaaatcctattggcactaaataaatatttgtcaaattttctttacatctgttttaaatttccttttattgtagtagtctttacagttatgagacttgcttgatacattttcttgagctctttgtcttagactgtgtttcttaactctaacataacattatagtcacctgaagagattttaaatgctacctgtcatttgggctctacctctggcccagttaaattagtatttttaaagtttcccagttgacttttgtgtagttcaggttgagaagcactggtcggagacatgactggatacttttggttcttcagatttctcttaggtaagtttttcttttttgcaaagccccttttgattttacaagtttagaaggaatttctctttttgacagattttatgaaacttttactctttgacatttaaaaacatacatagaaagtttctgaagattgttacataagtgttatttatggctgaaattttttgtcccatcacatcttgtattccgtgcaatcaaattcaacagatatttattatcctttgtgccaggcattatgcaagggcttggtgaataagagaaggtctttgactttctggagcttatagtctatatttgtaagtaatcataagtataatgagctctccaaaagaggtgggggta

SEQ ID NO: 95238 - DNA, 1056 bp, Homo sapiens; identical to SEQ ID NO: 95237

SEQ ID NO: 95239 - DNA, 1056 bp, Homo sapiens; identical to SEQ ID NO: 95237

SEQ ID NO: 95240 - DNA, 1056 bp, Homo sapiens; identical to SEQ ID NO: 95237

SEQ ID NO: 95241 - DNA, 1056 bp, Homo sapiens; identical to SEQ ID NO: 95237

SEQ ID NO: 95242 - DNA, 1096 bp, Homo sapiens
tgtgagctcttttcattggggaagttgctttgagaatgctgtctatttattgacaaaacagagtcttgggccacgtttccacatgcgtaacttggttttgtgaggtcctttcacaaagatgaagtagtagggtttcaggcacagcaaaaggaaaattagaacttcttgatattttcagggtagcttttatttttatggtttaagtgctcttcatttattttcacttaatttctgagccaagtggctaaaacagtaggtttctggaacagaattcctcaagctgactcctagctttgttgccagaggcttaggtaagagatacctctcaaaatgtcaaacatggcaatgtcttggaattttaaaaccatcttgttaaaattacttattagttttgaatgtggtggacttggtgaccaatcttgacgtatattgctttgctttaaaagcacctaggtttgtttagtgaggaaaaaaaagaatgtgattcttacagtttttctgtttaaaataatagaatctgagtgtcagaagcaaatgtgaaggtcatttagtacaattttctctatgaatttagatcttttatgtcccggttacaaattggcacacttatcatctgacaaaaggcatgctacatttgcaaaaatctataaacattccacctgccaggatccacagaaaagcgagcagtgagctggcaacgcagcaagagcaagtgctgaaagcccagatctggacactttgttggacacttcccagtcatcatctttgggaggcaggatgagtcaggagtttatcttttttaaaaagctagttctaatagaacctacttgctctgaaatatatttccattattcatcaaaatggctcatagttaaccaggatttttatttagagagaaacctgtgaatgtaaggtagtaaagatcatcctcatgagttcagcactgaactcattttactaccctgaacatctccaaaaaagggaacaggaggcaagagagcagctttcttctgcttcagccaagcatactctctgctgttactgaacaagggcagatttacacagactttgctatatttctgtggctatgggaagg

SEQ ID NO: 95243 - DNA, 2342 bp, Homo sapiens
agaatacaaaaatatatggggcttgctgttgctcttttcttggttggcttttgtgcagattactttgtagcagtcaggcattgtggtagttgttaattaaatgggtaagcatgactcctaccctcaaggagcttgcaccaaaccagtgactcagccttaggataatctgttttcttctcttttctccacccatctggattctaaccatccttcaagacctagttcaattcctaaaccattcatgaaatctgcaccagcccaaactttgaacttcttttgcattatttagcaacagaatatatacagttttatctctattttgtctcattaataggattttaaattccttctgaacatgaattattttcttgtcttctggatcttagcacataacgcagttgtaggtacatgagagatgctgaagtatttgctgattcctttgactcagaggcttttcaagatacactttatttaataaaaaaaaaagaaacacagaaatacaaaacaaactagaaaaacagagcttgtttttcacagctgccaagtagtggtaccactttttgattatttggaaattatttggctttggggtgaggtgctaaagaaatttgtcagggaagataaattgtttgcattacagcctagctgtttatttacagtttcctctcttgtagatattgcaggagaagaggctgggtccgatccacactcattatgtctgttccacaaacaagtacttcaaaagggaaagtcatgcttaaagaatacagtggacgcaagattgaagtagagcacatttttaaatggataactgctcatgcagcttctcggatcaaaaccatttataatgctgaacacttgaaagaagaatggaataaaagtgatcagtattggttaaaaatatacctatttgcaaaccttgaccagcccccagctttcttctctgcactaagtataaagtttactggaagagttgagtttatttttgttaatgtagaaaattgggacaacaagagttatatgacagatattggcatatataatatgccatcatacatacttagaactcctgaaggaatttacaggtatggaaaccacacaggcgaatttatatcccttcaggccatggattcatttttgcgctcattacaacccgaggtaaatgatctgtttgttttgagcttggttctagttaatcttatggcttggatggacttatttattacacaaggagctaccataaagcgatttgtggttctcataagcactttagggacatataattctctattaattatttcctggctacctgtgttgggctttttacagctaccttacttagatagcttttatgaatatagcttaaaattgttgagatattccaatacaaccacactggcttcatgggtaagggcagactggatgttttactcttcacacccagccctgtttctcagtacataccttggtcatggtttactaattgattactttgagaagaagagaaggcgcaacaacaacaatgatgaagtcaatgccaataacttagaatggttatcaagtctgtgggactggtacaccagctacctcttccacccgattgcttcttttcagaactttcctgtagaatctgattgggacgaagaccctgacttattcttggagcgcttagctttccctgacctttggcttcaccctctgataccaactgattatattaaaaacttaccaatgtggcgatttaaatgtcttggagtccagtctgaagaggaaatgtcggaggggtctcaagatactgaaaatgactcggaaagtgagaacacagacactttgagtagtgagaaggaagtatttgaagataagcaaagcgtacttcacaattctccaggaacagcaagtcactgtgatgctgaggcttgttcatgtgccaataaatattgtcagaccagcccatgtgaaaggaaggggaggtcatatggatcatataacactaatgaagatatggaacctgattggttaacttggcctgctgatatgctgcactgtactgaatgtgttgtttgcctagagaattttgaaaatggatgtttgctaatggggttgccttgtggtcatgtgtttcatcagaattgcattgtgatgtggttggctgggggccgacattgttgccctgtttgccggtggccttcttataaaaaaaagcagccatatgcacaacaccagcccttgtcaaatgatgtcccatcttaaccatgtgcaatttgtcctttataagctttgagtatcttacagcttgcctttttaatgttagtcacaatgtttttgtggtttgaagtttagtt

SEQ ID NO: 95244 - DNA, 1048 bp, Homo sapiens
caaatcctatatagtctatgttttttcctatacatacatacctgtgataaagtttaatgtgtaagttaggcacagtaacaacaacaactaataaaaatagaacaattataacagtatactgaaataacatttatgtaaatgtggtgtctctctctccgaatatctaattgtatgtagtattttcggactgcagttgactgcagaaagtgaaactgagggtaaggggagaccactgtattttagaagaagctgactaatttgttctctgtcatttgttttaagtctatgaggagtgttttcataaatgaagatgcacagatggcagccagttcaatcctcttcatatttttaagcttttccaggtccatgttacgtatagtctctgtaatgtgaacagaatttattttagttttcaaggtagcaacatacatatgacatctttaccaatgacacactatgaaatacatgtagaaccaagtgctcttttttctaagttattcctaacattgtttttctcctttgtccctaacccaagctcatatctttcattagctattcatttaacagttttgtggattctttggccccagtcttcatagcattacaaatagaagatggttacttttctttcaaaagacccttggtcagagaggcagatggcacagtggataggcttctgaagtggagaagttagcataatttatgggttttatggatttatcctcctcctaacatttctgtttctccgttttgacttttgtcatagttcaaagaaggacatatttgttccctactggctgtgttacatcatatggaatttaaagtcactggaattgaggtagcagtgagaagcatcatatgatttaaaataaagctttgggtcaatatttactgaagtattacatcaatatatttcctgtttggctgacaagagttaatagctgattttaaacttgtttatctttgctcctagacaaaagttttgttcgaggagattctaaattacgtatttctttcttgatactgctatggaggtgaagcacatagc

SEQ ID NO: 95245 - DNA, 1007 bp, Homo sapiens
atttagtgatttgcactgtttctcttagtttttattatctccagtttttaattcagtggcctgagtaatttttatatataagtaagaaccctaaagtaaaagtaaaggaatcattgtattagggaaatagccaactttgtgactatagaggagctgttgtggaaaatggtgggggtgctcattacgtaactcaggatgatgagattataatttttaacccttgtttttatgatagcaaaactgtgagacttaattagcatattagaattttagagctatgatggaccttaaaaatattttatgctttccaagatgtaatttatggtgagtgggcatgcattatcatttacatattttaatgtaaattagaaaaattatattaacataaatttcataaattttgcttaggacaggactaaagttatttacattttaaaactgtacattcaaagtgacatatcaagtaaattaacagcgtgaatgtggctaaaattattaatgtagtctgtgaatggctgaagcttggaaattatatcagactaaccctttctgagactctgagaggtgaagtagcttgcccaaggtcatggaactagttggtagtattgaaccaggatgaaacccaggtcttctgatttcttgactggtactcttatcatttcacactggagtgggcaaagtttgattcagggcatgaaaattaaaacagtttcttcatatttctttctgagagtaaagactgcaaaatatggtaggaaaagctatgagttcagagacattagttgcaggtctggtactgtcgctgttacaggtctggtactgtcactgactagcagtatgattgtaaataggtatatttttctgttgcacgtggcctcaaataaatacatatacatctaaaaaggataaaatggtactgtagtccactgtgctaaagggttgaggtttgggaattcttccagagatttacattgttcatccatggcctttctttattgtatccttcc

SEQ ID NO: 95246 - DNA, 1007 bp, Homo sapiens; identical to SEQ ID NO: 95245

SEQ ID NO: 95247 - DNA, 1007 bp, Homo sapiens; identical to SEQ ID NO: 95245

SEQ ID NO: 95248 - DNA, 1015 bp, Homo sapiens
aatccaaggttttaaacatgaatgatgggtagatcattatggaaccaggtagaaaataggaagtttaggagaggggaaggtggaaatctgagtttgatttttttttgtttttgtttttgtttttttggggggtgggggagggggggtctcattctgttgcccagactggattgcagtgtctcggcttaccacaatctctgcctcctgggttcaagtgtttcttctgcctcagcctcctgaatagctgggattacaggcatgcgccactaccgcctggctaatttttgtagttttagtagagatggggtttcaccatgttggccaggctggtcttgaactcctgaactcaaatgatccacccacctcggcctcccagagtgctgggattataggcgtgagccactgcacctggcctgagtttgatttttaaatatgaaatccagattccaatgctacaggaaacctaatgtggttccaccattcatttcagagataaatgagatgcctagagattaagtctttatatttggaatttgaagggagtgaataggttctctaaaatgtgactgtcacagacatatgtttaaaatcttgtgcctgtatcttttttcttctctctgcaattcttgcctcatatactttgaagcctttcctgtcttctctatgatagtcattgatactgttctttgctccaggagcactattagtctgtaccatgtaatttcactctaaatattaactttatttcgtttttttcccctcatgtttggtttgcagcacactgtgcctctaatttgatgcacagtctttaataatctctctggatcagaacacgtgtctgtcagtctactgttctctgaaaggtcaggagttgaacaccaaataccatactttcttttactttgcagatttaccagctactaatatactggaaaaattttgttttcagtgtttacctcctccagaaaaaaatgaatgtgttctatttgtgccttttctctttcctctaagcagc

SEQ ID NO: 95249 - DNA, 1015 bp, Homo sapiens
ctcttgaggaaatttagtaacaaccagaacgttttgagaatgacttgaacagtgtaactgggtttaataagtgagtttattcacttagacatattttctcaaaaataatactgccttgacagtattattcacagcctgtgctggttgttgtaatgataaaaatgattcctttcacagtaaaattttcttatttccaaaaataaaaaaattatatctttctgagtatccatttgaaaaatcacatctatgaatgtgaccatcagcttcaaagcagatactggtttttcttcacttttcttccatctttcatggtccaaaaggcccattagaaacttgccatctttgggtttgcttaagtgagtaaccaatccttcctttgtttttttataggccaagatgctgaattatcagggacactttcacttgttttgacacagtgctgtaaaagaataaaggatactgttcaaaaattggcctccgaccacaaagacatccacagcagtgtttctcgggttggaaaagccattgataaggtatggtattgaaagaagtgttttgtattttttagcatcattctttttcttctgtcagtgctttgataatactagctttcacaaattactttatgctattcctgtcatgtttgcttttgatgacttttacaggtctagttttactatgttattcttactaaagttccttgttgctattatttaaaaaataaaagcaaaattaaaaccctctgcttttatagctttgttgtttatccatttgcatatatgactagagctcctagggtcatgataaataaagttccaaagaaattttaacccagtatgtgggagtttgtttaccagaagtaacttttcctaattcctgaataattccctagctgtgactctgtctctgttatgggatgattagaataacagccttgtatcagtctcccctgcatcatcctaactgttttcttcctatgggcgtcccagctacctttcaattttgccttctgtgt

SEQ ID NO: 95250 - DNA, 1028 bp, Homo sapiens
ttcttgtgacattttttgagtaagccatctttgacctggtggttgacttataagcagttaccatttttagtaccagctgattttattcatggagttcatagtcctattggcacctaagagaagtagttcaaggttactgtgtgatacctctgactacttcagacattggggagattgtgactggttggggcatttctcttcacacatcgtaaatgtctgggagggtaggaagaactttcgaggagtgccctttgtagcaaaggcatcttctaaacagtcttatgagttaacttagtctgtactcacaagagtgatagttgtaacagaggtaatagaagctcattgaatctggagagtggttcgtgtaactcatgggtagacccaactgttagaaattatcctgtgaaaaggctaggcttgacgctgcttgagtcagaactatatgcttataaggcaatactgttcactggtaggtgtggtatgacaagactgtgagtggcatgggctcagaggacttgttttggtagttgtggcttacagaagtgttagtggcctttcagaaagttctcactactcccatagtggtgtgaggggtttgacttggccagagagtcggagggtggttttggcagcagcagggttccagccacgttgttatgtcagtgatggcagtcaccagcaaagtctgggaaggcagactctggggagattgtgactggggagattgtggggagattgagactttggggagattgtgaaatggctttgaggttgtgaagcctgtttggtaactccaagagagtgaacacagttttagaagtgggtttggcatcaaccctctctggtactatgatatttgaagtcttcagttggttcctggagtggttgttggtgtgtatgagcttaagaactgtgggagtggtggtgggacactttattttcttccagcagctgtatccttctagaatgtgatggggcactttagagatggtcttcatttgtgggtgaagaaccctcagttcctctag

SEQ ID NO: 95251 - DNA, 1019 bp, Homo sapiens
gagaatcgcttgaacctgggaggcggaggttgcagtgagtcgagattgcaccactgcactccagtctgggcaacagagcgagactccatctcaaaaaaaaaaaaaaaatacatacatacatactatattatttagctgacactgaatagtgtttgtggtactgtagtctgccaccacagaggaaagcctggatcttttagctcagttccctagtatctttcagtacacactctccccgtatttttggcatctacttggcctcagctgaagaggaagctgtttccccaatagaagtacctagacgttgtgaatgggcttctcacatacatcaggaattccgtgtaggctgtttcacataagactgcattgacttgttaagtcctccaggagctcttttaatttgaacctggtagttgtgtaagctctgggcagcctgttgtaaaggctgggtggacctgattggtggtgaccaaacaggataaagctgaatccagtgtggcataaggcttttaagaaccatgccaaacagacctgagtaataaactggaatgtccatcagcctgtgagtaccactttatggacacatgctcccacccttacaggatgaggacaaagaagccagtggctcctgtatgagcaggctggttttgagtgagaaacattagtaaattttagtcatgctcagtggtatttttccttttatattttaatacttatgttttaaagttccctacctatcatgtctctgaaaatataagcagaatagaagtttctggtggtggtagccaagatattgtttggcttttaattattatgaacagagtctcgctctgttgcctaggctggagtgcagtgacaccatcacagctcactacagccttgacctccctgggctcgagtggtcctcccacctcagcatccaagtcccagacaagtagctgggcctacatgcgcttgctaccatgcccagttaatttttttcatttttgcgtagagatgtggtcttgcagtgttgccca

SEQ ID NO: 95252 - DNA, 1573 bp, Homo sapiens
ctgttttcacatctagagatagggtagatagctgtttatagggagaaaaatgtgcttaattttggagaaaagcactcctgcattgtgattgtaaatagtgggttgtttgcagttgctgttgctggttacttactacctgttcttgtacatcatgtaaaataatcccatattggttggactgtatatttaagcagtggttgactaggattgcaattttagttaaatctaaatggccttgtctagttaagtttatatatttttaaaaagaaatgcaaaacatttattagggagcaatgcctatgaaagataaagggtgctgaagtggaattaggctgggaaagctttcacactgtgatgtacgtttgctcttctttcactcttgatgtttcatgttccttctggtgtcattttcttctgtctgaagactttagcaatacttttagagcaagtctgatggcagtaaattcagtttccctccgtctgagaatgtctttatttcatcttcattcctgaaggatattttcactggatatagaattctaggatgacagttattttctttcagtacttgacaaatgtcatgccacttctttctggcctccatagtttctgttgagaaatctgtagtcatttgaatcatggttcccctgtaagtaacatgtcacttttctctggctgcctgcaagattttttgctttatctttagttttaacagtttgaatgtgagatgtttgggtcagatttctttgaatttgtccatgttggagttcactgaccttctagaatctgagatttatgtcttttgctaaacttgggaaatactcttcaactatttttttctgtaccatactgtttctcttctcctagtattccgatgacacacacgttagagcttttgtaattttcccacaggtccctgaggctctgttttttttttttttttaaactggtgttcagattggatgaattctattgattttcactgactttttgcactgccactttgcttctgctgttgaaaaattcatccaatgaattttttattttggttactctatcagctttttccttgctaagtctctccctttgtttcaagattgtttgtatttttataataactgccctaaagttttggatggttccagcatctctgtcatgttggcattggtgtctgttgatcatctttttccatgtgagttgagattttcttggttctttgtatgccaagtaattttgcagtatcttgaacattttgaatatgtattatagtactctgggtcttgtttaagttctgtggagagtgttggtatttttgttttagcaggcaatcaaccttgttggattcaggccacaagttctaaccagtcttttctgggttgtagtttcagtgttagttttgtttctaaagccattacagttatttagatttgtcctgtgtgtgtaacacctggtagccaatatgggacctaggaattaggtctattccctagttcagttttcaaaatctgtagtatgctgtttagagtcaggaccatgcatgtatagctcaaaggcaaacccagaggtgtagata

SEQ ID NO: 95253 - DNA, 1020 bp, Homo sapiens
ttttcccctcccattatagacagtgctgcagtgggcatgcttttacaggtcatcattgcattcctctaaaaatattgctgcatataatgcctagaaatcagttcattcgcttgattttattttattcatggacaccattattaaatctactttaaaaaaacattatctaaaaatatacctatttactcttctagcatgacaagttttagaaaggagcagtggaaaaattccttcctttgggacgctataaattgcagttgggttcttattggggtatctcagactgaaacaaagaccatttttttcctgttaagtggggtgaaaataatctatttatgattccctttctctttcttttccccagaattttgattctgacattagcagtgtgggaatagatggctgctggcaggcagacagccaaaggcttctcaatgaggtgatggtggagcacttctttcgacaaggaatgctggatgtggctgaggagctctgtcaggtaacagtgtgccaactgggaggatatgaaaaagaaacaagggaactccttggagtttatagtatttgcagggtggggttttgagtcttcctctagctatagatagatttttaatatttaaattatcagagatgacctcattttactaggagtattttggggaattttttaagtggcaaaaattatagttctagaacttgttatccagatcatttttttcttgttcctgtcccagaaggttagtcccagttcatgaatcaaagggcgcaaaagcgatattctttcttcatgtccatttttgatatagaaggttagtatagcagacaagaggaaagggacaaaaacattgatgtttgttcttctgttctagcccagcttaaacgattttatcaaatgaatttccagctaaaattttttacttcgcattagcagcatttgtcttttatttctatcacacatgagttagaactctacaacagtttaccaataccatgtagtcataatagtagtagctgccatat

SEQ ID NO: 95254 - DNA, 1059 bp, Homo sapiens
tgggtttcaaatagtttttaagacaccttgcttatgcttttgattcttaaagtcttttttgccttttctttaggtgggcagtgtcaaaccgggaaatgcttatagctcaaaacagctccttggaatttaagctacacagactgtattttattagcttgttaatgggtggaaccacaaatcagcgagaggcattacaatatgctaaaaattttcagccatttgccctaaatcatcaaaaaggtgagtctagagtcagatgttattaatgtttgaaacagggctatagccaccactgtaacttaacagttcttaactagagctaatacctgtttgccagtaaacagttgtagttgataatcacttacaggaaaagttctgactggctctagacaaaaacaaaaatattaaagcctcttagaagtcagagatgttgcagattttggaattccatattaaacttagaggagatgtgagaaagagcaaggtgtgcacttgctcttttccacccccacctggctgtatgctgctgctcttgccacagcaaagtgtcagagagccaaggtggcaactgtcaaccccacgaaactgtgtaggaaacattaactctgcagtcagagataatgtgatgacataattgttacttctctaggtaatggtaattatactatgctgtagagaagaatttaaattataagttcagtattttcactgctttccttttcttcccttttctctccatgctgtttaatttaggatgaaggaagaaaccaagcttaaggaccagaattttaaaagacctgttaatacattattttaggctgtatcagtatgggtgggggtattcttgcttttcgcagcttattactgcaagcaaactaatgctttcttgctggtgctttttttagacattcaggttttgatgggaagccttgtgtacctgagacaagggattgagaactcaccatatgttcacctacttgatgcaaaccagtgggctgatatctgtgacatctttacacgggatgcttgtgccctcctggggctctccgtggagtcccc

SEQ ID NO: 95255 - DNA, 1072 bp, Homo sapiens
tcctcaccaccacacacttgcagtttaagaaatgctagttttacttaaccacgtctgtaatctcagcattttaggaggcctaggagggtggatcacgagatcaggagtttgagaccagcctggccaacatagtgaaacccgcctctactaaaaacacaaaaaattagctggacgtggtggcgggtacctttaatcccagctagtcgggaagccgaggcagaagaatcgcttgaacccaggaggcggaggttgctgtgagccaagattgcaccattgcactccagcccgtgcaacaatgcgagactgtctcaaaaaaaaaaaaaaaaaaaaagaaaagaaaaaaagaatattcttggcctggtgtggtggctcacatctgtaattccagcactttgggaggctgaggtggggggaatctcttgaggccaggaattcaagacccacccgggtaacacagctagactccatttctacagaaaacttttttaaaaaaggatgttcttggtgaaacattaaaattattagttttattaaatcttgacctttcagtacacatcatcttaataatttgtatgacaaaataggaaatccacataaagcacttcagtttcatgtcaaagtatggtaattgtcttgagaaaaagtatgttgttttgagttatgagctagctggtcactttttttcatggaatacttgttttgtttgttacttgtttttttcttgcttttttgagatggagtctccctctgtcccctggctggagtgtagtggcgcaatctcagctcactgcagcctccacctcttgggttcaagcgattctcctgcctcagcctctggagtagctgggattacaggcgcctgccaccacgcccagctaatttttgtatttttagtagagacaaggtttcatcatgttggccatgctggtctcgaattcctgacctcaggcgatccactgccttggcctcccaaggtgctgggtttataggcgtgagccaccgcaccagccttggaatagtttttacttggaagaatcattaacatagttacgcacactcaggtttttggcag

SEQ ID NO: 95256 - DNA, 1029 bp, Homo sapiens
gaacttgagccttcacttgttttgtggaggcaggtgcctggcatctggcagtttcccatttatgttgtaagcatctctgacatgcactaagagcagactgaaatctgaattcacctaaagactgtgtgtcaagccagtaaagccattagaggtggtgatcaggtcattgtttgtcagacttgtttttacactttgtcagctttcttgaaaataatcttgaaggctaatttaacactttgaatcactaagactgtccatctgagttagaagagtgctatagaaagttacattcaggtgaatagatctgatcaatgttctttgctgcacagtgtatattaccatgtggatggttttgtgaaatatgacttcagcttttttacttttttttttttttttaacagattgaagtggaccttggtaaaaagtgctggtatcactctatatttgcctgccccattcttcgtcagcaaacaacagataacaatccacccatgaaattggtctgtggtcatattatatcaagagatgccctgaataaaatgtttaatggtagcaagtaagtgtctgacttttaaaaaatgttagcaaataaattttgttttggaacttggtaggaggataagaagtgatgaggattaaaaaaatgtagctagatttagaactaaataaatttcttaactattcatttggcaaagttggtggtatctgatttgagtatttttaatgtgtctatggatttggtgattagatttataagcatgtctttaacttaacttttggggtaggtgatagattttccccttttttatacaaatggtcgcatactaaaaaatgttctgtactttgctgttttcacttagtgatgtattttggagatctttttctgtgctgcagaaacagccctcattatttttttgttaaagctgcagtatattctactgtatagaaatatgattgggtagccagttccctattgatgaacatttgtttctctaaacagtgctaagtgaaggccaggtgtggtggctt

SEQ ID NO: 95257 - DNA, 2198 bp, Homo sapiens
tgcattttagctctgcatgcagccccagcaggctgcgtgtttaagaatttcattgtttaactggctggtgtgagaagtcttccgttagcatagagtggaaggagtactattgtttggttgggtttttgtttgtttgttttttgtttttgcttttattgccaagaggtgcttgttttaaaagtatgtttaataaaatgaaattctaaagttagaagtgttcttaagttgatatttactctcttggtcttggtagccctattatatcattgcagacacagtgttgtgcatgtgtgtattgtatatgtgcaccagcatcaaacattgtgtatctggaaggaaagcagcatgttccagttctaaaatgcagttaccagacccatcactttaaatccttaaagttagaagctagcaaattttctgtagtgcagaacgtttattgctgtttttgtgtttgaatagtataatgtttgatgcctctcttctgcaaagcgtatcatctcattgactgtgaatctgtatattattctgatggatacagataatgatcttttctcttgtgaggtatcttcatttatgcactgtccaaaaatagccatgtgtaagagtctttctgtatgacgaactacatggaaaagacttctgtggacataattctgaccgaaacccatgaagttacttcagtataagaagaacgttacacggaaatcaccaaatattttgcaactttatttcttctgacatggagtgaacatcaataggaatactttcaaagaaaatgaaaacacagaagcaaagagaaatgtggcacttcacattttaaactacagatggacttggtttgagggagggggaatcacagatttggtgctaagttaattagaaactggcagcgttttacagtagtacaccagcctggatgttttttctaaaatgtttacctgggagagctggggtttgtttgtgaggagaaagagtactgtggaaaacctctgcttgagtaccatgtggccaggcctatgtggatggctactccgtgctgtgcggcttcaccagcggttgggattggcccagcttggagtgcttgtgtggtccaacctcagtctggccccatagcgacttttgccccatgattctgcttcactgttggaatcctctttgaagttccccctctctttgctaaagcagtgaaggaagagaacagagacaaactctttggactgtgaaagagaaggtagagaattccaggcaacagtctgaccaagggtgtaaaccagtttattatatatatatttttcctttgaattaaaacctagagtgttgtatttttctttctttctttttttttttttttttttttaccctttttctccttaggccaagtttagcttattcttatctttccacccaaacacctacacaacgtttaggcttcctgtaaggtttgaatgagacagatgtactctgaaggctggtggtaaatgtgtttgatgaccagactcttcatacagtcggcttgggccactttaaaggacaaaagccagagctcagctttatccctctcccagtgctgggagccaaaaaactgttgacggttttttgtgcagctcaagaaaactttgaaaagaacatgctttaactgaagcattggactctgcagctttctgtgtaaggcccgtgtactcccactgggcagggtgaggaccaaaaatctgaaactcttatgaatctgacatattatatggaaattatatcttgtgaccgtcttcaagtgcatggacttaaaattcatgagagactaaatgtgagggagaggtggatttaaagaggccagaccttaaccaaagatgctgagatacagcattctgtcccccctgccctagaaactccataaatgctgtcacaaccctatcatcgctgatgctttctgcatgtcagcagtccaggaggatgctttttgtctctctttgcctccactttacaaaagataatatgatagaggcaacgtttataacagtcacatttaattataatgtacatcaaaggcagaatttcagaatggtttcttaaatttccttgggaaccgtttccacatatcagttatagacaaaggccatgggactatgctaaaccaataaaaccttattagcaaatctttagattctgacttagccagagcatctgagtgttcaagtacagtt

SEQ ID NO: 95258 - DNA, 1174 bp, Homo sapiens
actaggatgtataaggtgacgacacaaaccaaatacctttctttcatcacttaactatacgtactttatctctggtaacactagaatgctgtggtcttgagggaatgttagcaaggaacacatagaagatttggtgtttcataagcctgtctaggtgtggcaggttttgtgtggtacactgatgtttaccataagcaggtacaagcttcatgaaccgttcttaatgaactataattgaatagataccaaaaatagaatgacaaatgtattttaatagcagatgaggcagttttaggatgaattttccactgttgattttacttcaagacatagcaagagaaacaaaattttgttttcaagacatttccactgcagtttcaagctgtagtgggcatatgcttcatttacttccaaagaggcaaaagcagctggaattggcttacagcacatgctttgtttcatgttatgggtgaggacctacatacactcttactttagcagtcacttaaccttctccagcaaggcagttgtggggttcactaggatttagtgcctgatcttttttttgggaaggggcgggaatgaatgtgttggggctgggagggaagcagaagaaaatgggagtgtgagtgagtgtgcatgtgtctgaagttcaccattgcccccacctgcacctagcaaggaacaggtgtttgatgtattttgctcatgactgcagtatgcatgtatttttttccttctctgtgttttctaaacttacactaaaggattcatcaaatcatcttgttcagatggctcaggattgtatttattttgcttaccccgtgctcttgggttctatagtatttctataattatgtaacgagaatagtgttgcactgtaatctatcatatagagctatatgtatggaaaattttgatcaattttttaagaaatgtatcctgtttgcaaaggcacagtaaagttgcatcttatagactataggcaataaagctaacaataaaccttatttaacacaaaccacatccatatcctctgttcatttgattttggaaaaagtagcatatccagtagtttcagggaattcattttaactttaagaattctgatatatttaatttataaatttcggactgatataatagagttttggaaaactataagaaatgcttt

SEQ ID NO: 95259 - DNA, 1868 bp, Homo sapiens
cccaagagcaaccccactgcactctagtctgggcgacagggcgagacgccatctcaagaaaaaaaaaaaaaaaaaaaagagcaaaggaaatgctcaggacaagatgatctggtaagaattttctcccttttttgcagaaaatcccgttttgtcaacctaatgaagcattcaaagaagacatatgactcttttcaagatgaacttgaagattatattaaagtacagaaagccagaggcttagagccaaagacttgtttcagaaagatgaaaggggactatttggaaacctgtgggtacaaaggagaggttaattccagacccacgtatagaatgtttgaccagagactcccatctgaaaccatccagacctacccaagatcatgcaatattccacaaacagtggaaaatcggttgcctcagtggttaccagcccatgacagcagattgagactagactctctgagctactgtcagttcacgagggactgtttctcagaaaaaccagtacccctgaactttaatcaacaagaatatatttgtggctcacatggtgtagaacatagagtttacaagcacttctcctcagataacagtaccagtactcatcaagccagtcacaaacagatacatcagaagaggaaaaggcacccagaggaaggcagagaaaaatcagaggaggagcggtctaagcataagagaaaaaaaagctgcgaggaaattgacttagacaaacacaagagcatccaaagaaagaaaacagaggtggaaatagaaaccgtacatgtcagtacagaaaagcttaagaatcgaaaggagaaaaaaagccgagatgtagtctctaagaaagaggaacgtaagcgtacaaaaaagaaaaaggaacaaggccaagaaaggacagaggaggaaatgctttgggaccagtctattcttggattttgaagctttcaaagttggttctcccaaagttaaattgaaaaaataggtgagagcttggttttatgatatccgtgttcataccacttttcttatgtgaataggttctttaacttctaacaaaggcctagtaaacaaagtgtttagcatgcttgctctccaacacagaaattgcttttcctcattttctaaaagcattattacattttttgaacatatagtgtaatttcctttaatgaaagtgactctgcttttattcatcaaattgctttgatggtggaaatattttctgttgggaggttatttattttaaattggaggattaatgacctttgcacaatctgtttcttgattgggtttgttatagttttgagttgggtattttatgttcattggtttttctctgtgaagcaatttttttctcctttattagatctaacttgcagtgtattttctaggctggaaagtggaaaatgaaatatattataatcttaggttacataaagtttctaaagtttcaaagagtcttgatacaaaatcagtttatattctgaaaatatttataataaagtattctaatttctacatgttgttgtgtgtcagtctgttcctatttaacaatgatttttctcttgggaggaggagagaataacttggcagttcatcatacttaacaggcaagatcttttgggtaggtcacactttgaagctgtaaaaattccttatctatcataccttgcttgctcacatttgaacctggtttttaaggtagaaatctatgactgactgttacaggaccccaccacttacccaaagttagcctttgggtcgggggtttcctcactatagtcccttcactggtcgccagaatgatgttataggaaaaggggtccgaatctagaccccaagagagggttcttggatctcacgcaaga

SEQ ID NO: 95260 - DNA, 1474 bp, Homo sapiens
tttagcagaaacaagccttgtttctgagagctgaagaaatgttcagttctacatgggatatatgccctcctaattttttgagataaactgtatcaccaaaaatatatagggcaggtgggacacagtggctcacacctgtaatcccagcactttgggaggccgaggcaggcagatcacctgaggtcaggagttggagaccagcctggccaacatggtgaaaccgcatctctactaaaaatacaaaaattagccaggcgtggtggtgtgcacctgtagtcttaactactcaggaggctgaggcaggagaatcacttgaaccctggaggcggaggttgcagtgagacgagatcgtgccattgaactccagcctgggtgatagggcaagactccatctcaaaaaaaaaaatatatatatatatatttttttatatatatataatattataatttcatagtaagtacattttctgctatatttgtatttattcaggatttgaggtgaggaaaagaatcaggaacagtcttgcccttccccccaaaaaagaatcaagcaaacaaaaatggtgtatctactgcaagtttcttctgaaactcttctccaaatcagtcctatcccttttcagttttcacccctgtttcttcccttattcctctcaccagtactttaagagagaacaaaccagaagacattctagaatgcttttttcaccaatcagaagtagtggaatgaaatccaagcctacacagaagatacagaactctgtgctttcatcttccctcatacctgatacctaaaagtagttttcatcttataactgaatttctgattttcagcattcccaatcaattttataaacatccttttattgttaagtcttacagtactctcgtcaggtgagtacgtttattttatcttgagtaaactgaagattttaaaaatcaaattctgtatctgtggttcctttacttctcttagaaactaatatacaggaaaccaattcatgagaacttcagaaattaattgaacattaatatcagccacccaccgtggttgtgtggttcctatccacacatccctgcttatctcacattttagccctatgacagcaacatgtgtatcggttcctttctgccctcttcgtctcacttctgagaagggtaaagttactggtacgtgacctgggaggtatctgaccatcctgatgctaccctttggcatataatgtcaagatactcagcttttatgctgaaataggttgtaatttgtttgagctgctttgtttttcaaagctctttttaagagcaaaggaggccaggtgcagtggctcatgcctgtaatcctggcactttgggaggctgaggtggatggatcacttgtggccaggagtttgagaccagcctggtcaacatggtgataccccatctctactaaaaatacaaaaattagctgggcgtggtggcacacacctgtaat

SEQ ID NO: 95261 - DNA, 1220 bp, Homo sapiens
gccgggcgcgccccgagtgtgcgaaatggccgaccagggcgcggcccgagtcccgcgcacccctcaccggccgccgcccccggaaagagacgccagggcttccgagtggagtgcggagggaaggggcgctcggcttgcggaggaagccgaggtcggagtgggaaactaggggcgaccaagaggaaatctagacccggaggaaatctagacccggagcgtcagggaaagggaagtggggtgaggaaactcgaaaattgaggggacagggataaatagagaaaagcccaaacgtggaagagagtaagcttccgtttggtgaagttcagcatcctggaaagtagagactttgacgtaggacgcttagggagaggtggatttaggaatcggggaaagcaggaagtagcggggcccttgggggaagagaagaggggatgaggtttagggggggatcactttggagttatcctaggcttttgaggatatggccctataagacaagcttctaagatttataggcccgtcttgatagtgatctggggttttatgtgtgtgtgcttttaatcctctaatttagagacggaggtctcgctgtgcccaggctggagtgcagtggcgcgatcatagctcgctgcagcctccagctcctgggcttaagcgatccttctgcctcagcctccggagtagctgggactacgggcgcgagctaccgcgcccagctgagttttaatatgtacctaccaatgtcagagatacacgaagctggacgttaaagcgttgaaaaaggattttattccgcaactcctgacagaggggaaagactgagctccattcctattttcaccgagatgactgcgagttttaaagggagatgaagggagtagggagtgggaagagagggctcaagtagagtcagggaggtgaaaaattacaaagtgctgatcattgtaaaaacgcaagtaggccagctgtgtctcctatctgggaattatctaagataaaatactatcctcccacagagactgggagtcaggcccagtccttcctggttacatttcagagcgatggctttcaggtccttgagaaagacactcctgagttgtaagaggtacaaacacatctcaaaggaacagaggaggattcgtagttgtgagccctttttagtaaatgccttttaaaagggaagtcagggagctgttattaggtgttggctagaacaaaca

SEQ ID NO: 95262 - DNA, 1031 bp, Homo sapiens
gtttcctggggagctgttcatagtagtcctttcctccatgcagggaattgtgctggcattctacatggcactggacatttattctctgaagtatttccaccaggctcttccatgtcattccaagagatgctaaaaggtaagagacctgttccagtccttcctctgatctagggtatgaatctgtgtgtgcactgggaaagaaggagggattatctttgcagatgtgcaggataggaaggggaagtgtggacgcctgtcacaaatcaccttttcctcttactgtaaagtaataaaaacaaacagcatcctaacctctctgccagggagtggggctgctgtttacagataaacagagacctgctgcctgttaggatcctggtaacaaaattcagtgagaagactgaaaacacaattgtgtttacagatcagcagcgacatgccaatgtcatgttggcggtggaaggcaaaggtcatgtttactgcaagcagaggtgcctgagctgccacaggggctgctggcgggggattttgaggaggaggaggagggctgcagcagcagtggatctgcagtcgcctgacgtgggtagcctcaaacctaaaaccacatgacacaggatcacaaaagcaaagccccgatcccattgtgcattatagcactgcagcaccatgtggtctgaaatgggcccagtgagctggctctgatttattccaatccccagaaactttgcttctggctagggaagaagactcctctcagaaaaataggttgggcagcagaggaacacaaatcccataaaaagggcatccatcttatatacatataactgtggtcacagcaagacataagctcgcatccccaaggacaggtactgtccatccagtgaatcagtcctttttgaaggcagaatggcatgatagttacacatgctctgaggtcaaaaagacttgagacctggctctgccacatgcttttatttttcattttattttatttttttctttgagacagggtctcactctgtcacccaggc

SEQ ID NO: 95263 - DNA, 1015 bp, Homo sapiens
gaaaagcacctgacaaacccctatggaagctggagaatgcatggcaagatcgttcccccatgggcacccgctaagcaccatccttaagatggttatgatccctggccctcagctgaaaccaggggaagaatatgaagaggcacaaggagaggcccagaagcctcagctagcctgatggcaagaataacttctggggtgaagcctgggtgatgaggcttctggaagctttaaagtcttccatctccatcatgctatagaaagaaatacctttgttctctcccgtcctgctcgggtcttttcagcagtctcaccgtcaacaaccatggctgatggctggccccaggcaggtggcaggtataacacggccttggatcctcttcttttttaaattgtgtatctagcttctgagtctagatgaaaggcagtatgtttcagagaatgtcggataccagtttttcccacagcaggggctgtgggagataaccagcagtattctgtttgtaatcacagggcagggatcagagtttaaaataaaacactgtcagagtgtgtgggggcgaggggggtgggcagaacagaacataaaattcacaatttaactttttttttttttttttgagatggagtctcactctgtcgcccaggctggagtgcagtggcaccatctcagctcactgcaacctctgcctcctgggttcaagcgattctcctgcttcagcctcccaagtagctgggatgatagatgtgcatcaccacgcccagctaatttttgtatttttattagagacggggtttcaacattttgaccaggctggtctcgaactcctgacctcaggtgatccgccctcttcagccttccaaagtgctgggattacaggtgtgagtcaccacgcccggcccaatttaatcacttttaagtatacaattaagagtacattgtatacaatgtatacaattaagtatacattgagtacatccacattgttgggtaaccttcaccaccatctatttccag

SEQ ID NO: 95264 - DNA, 1080 bp, Homo sapiens
gtccaaaattgcagacttgaaaagtttgttcttcgctcaatttttttgtggactactttttttatatcaaatttaagctggatttgggggcataacctaatttgagccaactcctgagttttgctatacttaaggaaagggctatctttgttctttgttagtctcttgaaactggctgctggccaagctttatagccctcaccatttgcctaaggaggtagcagcaatccctaatatatatatatagtgagaactaaaatggatatatttttataatgcagaagaaggaaagtccccctgtgtggtaactgtattgttctagaaatatgctttctagagatatgatgattttgaaactgatttctagaaaaagctgactccatttttgtccctggcgggtaaattaggaatctgcactattttggaggacaagtagcacaaactgtataacggtttatgtccgtagttttatagtcctatttgtagcattcaatagctttattccttagatggttctagggtgggtttacagctttttgtacttttacctccaataaagggaaaatgaagctttttatgtaaattggttgaaaggtctagttttgggaggaaaaaagccgtagtaagaaatggatcatatatattacaactaacttcttcaactatggactttttaagcctaatgaaatcttaagtgtcttatatgtaatcctgtaggttggtacttcccccaaactgattataggtaacagtttaatcatctcacttgctaacatgtttttatttttcactgtaaatatgtttatgttttatttataaaaattctgaaatcaatccatttgggttggtggtgtacagaacacacttaagtgtgttaacttgtgacttctttcaagtctaaatgatttaataaaactttttttaaattaagtatgttgactcttattttgaggagttagtcccaaaatggtagattttctaatttataaaatgggatcatagatctaggaagagtcataaacctatcctcaaaaaaacttcttcctaacccatttcagacaggtatctttttcatcattt

SEQ ID NO: 95265 - DNA, 1016 bp, Homo sapiens
ggctaactacagttgattagtggtttggagtaatgaagattttctcataaaaatgggttaggactaagatgattagaaatgaaagatttgctttagatagcgttccctttgaaaaacctcacctcaggggtagtcgagcagattttgctggctcccacaaacttttttagcatggcaagtctccaggtttccgaggggcctgttttactgatgcatatctcagagctatacctgggctttccttctgtaatgctgagtagtttaattactcttggtgtagtagtgaagaaaagagacttgggagattaactctttgctaacatttttacacatgtacttgcatttaaaccaagaagtgactaagtaaactttgggattcaataatgctgtaatatcaactgtactgtctctgtgttaatttttaaattttctttatgtgggatttcagattcatggaaacagctattctcataaagtggacatcttttctttaggcctgattctatttgaattgctgtatccattcagcactcagatggagagagtcagggtaagtaccctccctactcaaaaaaaaagtttcaaacagaaaataatctaacatttacaaaagagttttttaaagacttagttcttcttaataccagcagattggttaactaaaagtgaaagaggtgatgtgagtaacacagagaggagttctagactatttgcttccatttaaagctcagtcttcaaaaacttgtttggttagattgtttgttcttagtttttgcttaaattcatcataatttaacaatgttttgcactcagtaagtttgttataagtaaaaatctaggggaaccacaaggtaatgggggccacacactcatatatttaaaagctggcagattaagcataattaggtttctttcctctcaaaataaaccatgaccacagcctttaaagcagatagtactgaaagtcttttttttttctcaaggcaaggtcttgctctgtcgctcaggctggagtg

SEQ ID NO: 95266 - DNA, 1044 bp, Homo sapiens
tctgtaaaatggggttagtactcatctaatggggttgtagtacatgagttagtagtagtaaactgctttgaacagtgcctagcacattgcaagttctatttatgaactagttattattagttataattattaaggctttaagtcataagtgtagagatgcttgcctgggaagaatatatagaataataagattgaggattaagtaccatgatccctagggaatgtgcacctcaaagggtttaagtagatgttcaataaatactagcactctttgctacccttcccttttctttactagcagtacttgtctggcacagaaaaattgtcactattttcctgttagcccattttaaaaagaaatatgcttgaaaatatctagtttgttgtattttttctttgtagtcttttaaataattctctttactttttcgcctccatgcacacccactgtacttttgtctgttgtattctttccagccatccaacatattctttacaatggatgatgtggtcaaggttggagactttgggttagtgactgcaatggaccaggatgaggaagagcagacggttctgaccccaatgccagcttatgccagacacacaggacaagtagggaccaaactgtatatgagcccagagcaggtgagtttttcagacctttacttactagcacagcagcagatgtacctgatgaatctcttctcatgttttcattaaaatacccagtaatctaaaacccagtaagtctgaaaattatgaaaactggcagtagtgttccagtagtggaatagtgacacagctaagatgtagtttctacaacctgaattggggctggattaagaaaaatacaacacataaaatgcactcaccccctgaacaagcacctgacagcaaccaggaatttggaaagagactttgaatgccaccctcccaaacttaactcgtttgccttgtgtagactgtgttggaactgttttcagagccagctagacccagaggtactatactgagctgccctttgtggtcactcataggcaactt

SEQ ID NO: 95267 - DNA, 1039 bp, Homo sapiens
gatgttaataatgaatttttattttcatttagagcatcatttcttggaagcagcagttgcttctaaaaaatgttaatcaaatatttctctatacaacttagaaaaactcttaatcattccctgaccatgccaaagtaacatttagcgcttaacatacttatattaagactgtttaggcaaaagttatctggttagcacatcatattctttgagactgaacgaatagaaatcaaatactgtgcacctacttctttcattatctttctaaaccttgtacgtgttttttactacatatgtcatgtcatattttaattgtttgtttaaacaactcagattctctgtaaaactgtgcttttcaaaggcaagagctctgggccatttgtttaacttatatgtttgaattgaattatggttgaatatcagtttattcaattaagcacgtgcatttttattcaagtcataacagttcagacttaagaaatattattattaagaaaataataattttcttttagattctccttccagaactcctgtcttggtaggatctgatgaatttgacaaatgtctcagtaatgataagttttctcatgaagaatatagtaatggtgcactttcaatcttgcagtatccatatggtaagtgaaaatactgagttttatttattttattttttaatttgaaattaatagaattcaaatgaagaaaagtcgattagagtatagacaataaaacatcttgggagacaatttcatgaatgattactaagcatacaagctccaaagttaggttgccagggttcagatcccatttttgccacatgctaggttgggcacatctaactcccctgtgtctcaatttctttatctgtaaaattagaataataatcctaatatctatgtattgagttgttgtgaggcctaaatgagataacgcaggcaaagtctcagttaacatcatacgtggcacatagtgtcagtaaacattggttctcgttattagctcttatttatcagactatattatgtaggctgtatag

SEQ ID NO: 95268 - DNA, 2940 bp, Homo sapiens
ttctttctactttggactatgaatagggctttgcatttacagacaacttgaccttctttatcctgactggattttgtttttttaagtgtttgagtgcttactgggagctcagccaccatagcagcagatgtccaacttaacagatttttgagttaccagaataggaaggatctgggtttctaagatccatgattctttaaaatataattatttccataaatgtcagaattcttaactatgccattttatatctaagtgaaaagacacaatactctcagtagttgagtgatttttctatttactaattatagaggaaacattattactgccactttaggataagactgctgaaacttacttaggaaagggtaaatgacttgccacatcttgttcagtggagatccaagattggggctgaggtatcctggatcacattgcctttttgaggccatgttttagtatgaatttaagactggtgcattcatcttgacttttacactggtttgttagggcatattaattttgctgcacttaatgaaatgtatcctgcctttaattaagaggtaaggcagactgtgtgctacctcattttaaggtgacattgatgtgtttggggaaaatcactctgatgtagaagtacaaacatttgtaagtttttgagagaaaatctgtcccttagctgttgtaagggacacatcaagtcagtccacaaccctcaaaaccattgtgtctgaagggtcaggacaaagttcttgtgggccctcttgtggcataaatcagtagagcactcttttccagaaggttatgttgttagttttctcatcacataattttagtatttgcttcttcaatctagaagagttctatattattttgtccctttctttaaatgtaaatttctaaaacacacctttgtaaatttaaggtggaatttcagtgttggccactttgaacttcggtatattccagacatggaaacgagagccggatttattgaaagcacctttaagcccaatgagaacacagaagagtctaaaattatttcagatgtggaagaacaggaagctgccataatggacatagtgataaaggtttcggttgctgactggaaagttatggcattcagtaagaagggaggacatctggaatgggagtaccaggtacctaacaccactgaggatttaaaatacggttcttcctctcccagtctgaccaaacttattgattgggtggaacgaaattactactacttggggctctcagcttgttctctgtgcttttataaatttgtgattttaaatggtattttatgggttggaactatataactactgcttgaattatttaagaccttttttccatttttgtttagttttgtactccaattgcatctgcctggttacttaaggatgggaaagtcattcccatcagtctttttgatgatacaagttatacatctaatgatgatgttttagaagatgaagaagacattgtagaagctgccagaggagccacagaaaacagtgtttacttgggtgagtaaatgtatcttatctaacgatagtacacattgacatctagattttcttcttacattgttccttcctacttcaggagtgcctgtagtagttttaaatcctaatatcatctctgatgtacgttgcccttgagatttatacttcgatttccattcctgctacttttccatttgtccaattctgaaaatttttttgttgttgttggagatggagtttcactcttgtcgcccaggctagagtgtgatggcatgatctctgctcactgcaacctccgcctcctgggttcaagcgattctcctgcctcagcctcctaagtagctgggattactggcacctgccaccatgcccagctaatttttgtatttttagtagagatgggatttcaccacattggccagaatatagtgcacctgacctcaggtgatccacccacctcggcctcccaaagtgctgggattacaggcatgagccaccacgcccagcccaattctgaaatttttaattactgtcgcatattctttttctctgaggtctatattagaaaggcttagaaatattctcattatataacatgatttcaaattactcattagccaagaatggtggcacgcacctgtaatcctagctactccagaggctgagatgggaggatcgcttgaccccaggagttagagcctaccccaaactataatcatgtcactgcactcctgcctgggtgacaggacaacactctgtctgtttatatatatataattatttataagtaattacatatatgtattacatatataattatttatatgtaattacatataaaatatatagttaggtatatatcctcaaagtctataattttctgtatttgtatttgcatccatattagtttgtgaccctcccctctttaagattagatttctttcttttttatcagtgcatctgtacaactgatctaaaaaataaaactctggtgtgcttctgggcaattgaaagcctttaatattataaattttgaaaactcttggatctaatttgaactagtctgcatcatcaaatactcataaaattctataagctctgacaatgtgccatccacctgttggtttgaatgaaaagcaagaatttgaaggaataacatgtcatttgtgttatgatagtatttaactgaattgttagcaatatttctagaattataggtgtttaggtaaactttcttgagaaagttacttagtgtaagctatttgttttgtgagagtacagtgacttatctttgaatttttctactggaacaattttcctgtattactgaaaatgtgctattattcagtgagaaatatcatatggaccttttgtgtaactttccctccctgtttttgttgaataaacattgagtttatctttgagt

SEQ ID NO: 95269 - DNA, 1085 bp, Homo sapiens
acagtaattggccttgataaaaatagccctagaaaatactgcatatattatctatttacacattaaatattcatattacacatattacacataatcatgttacacattaacatactaattgctataagagctcctatagtaacctcttcttgaactcacttgatcataaaactctcttttggtaactcacctaccattatgggacccttttggcccatggtaaactgagtttgagaaaaatcttactagagtactatgtgtagggcctgggagtgattggcagttcttttaaattacttttggttgatggactgcactgcttcatgtgctactcagaaggaggctggagtacatcaggatcaagactccagctcttaattactattattcttttaaaggtatgatgcttctatttttctgggagaaataagaaaaaaataataattaatgttatggcccttttaaaaagttagcttctgttttaggtatttgggaataagatgatcattccttccctggatggagccctcttccagtgggaccaagaccgtgaaagcatggaaacagttcctttcacagttgaatcacttcttgaatcttcttataaatttggagatgatgttgttttggttggaggaaaatctctgactacatatggactcagtgcatatagtggaaaggtaagtgaaaatgctgaatttactttggggaaatcagagtaaattagggtagaaaaagtaatttattaaactacacttattattagttgagttttattgtaattttcccctgaggttgtcatttgttttaataagagaactgtgaggtaggaaggggaaactaataacagaataaatggcagagccaggaatagcaggaggaagagaattcataaatatggtctactgtgtctcaggtgtttttttttttttttttttttttgagacagagtctcactctgttgcccaggctgatctcagctcatggcaatccccacccccaccccattccacaccccctcaggttcaagtgggttcaagcgattcttgtgcctcagcctcctgagtagctaggattacaggcac

SEQ ID NO: 95270 - DNA, 1118 bp, Homo sapiens
gcagtggtgcaatcttagcttactgcaacctccgcctcccaggttcaagtgattctcctgtctcagcctctcccaattagctgggattacaggtgcatgccatcacacccggcttacttttgtatttttagtagagatagggtttcaccatgttggccgggttggtcttgaactcctgatctcaggtgatccatccgccttggcctcccaaagtgctgggattacaggggtgagtcaccgtgcccagccagaaaagatttaagagaagcttcagaaatagaattaagagtacatggctgttgtttaaatgtagaggatgagggagcacaaagagttgatgtctgatttaaatgttaggtaataggatggatggctacccttttaagtggcaggaatagattgtgggaaagaagtttcctgagcctgttatggtgataacaagtagatcctgctgaagatgcagaactaggataggggagagatggtgaactataaatcctgtacaggtttgggggctgtcatactatagatggaggtgaagctgtagacattgaccatctaggtagaacatgtagtacaaacaggaaaatgcctgctctatagatagaaaactataaggatgataggtgaggccgggcacggtggctcacgcctataatcccagcactttaggaggctgaagcgggcagatcacctgaggtcaggagctcgagaccagcctggccaacatggtgaacccccacctctactaaaaaatacaaaaattagctgggcatggtggtgggcacctgtaatcccagctacttgggaggctgaggcaggagaatcgcttgaacctgggaggcggaggttgccattgagcagagatcgtaccattgggcgacagagcaagactccgtccccccaaaaaaaaaaaaaaagaatgatagatgaggacccaggagggactggtcctgtagaaaccaggaaagaaaaatgtccagaatgaggagctggccacaacggtggcttttgtgaagacaggcctgatgaggggagtgaatctggcagttaggaaaccattgaaaatctttcttgagagtggcttccaaggattggatcatgggtgagagttcagg

SEQ ID NO: 95271 - DNA, 1013 bp, Homo sapiens
tctaacaaaagtatttctaaatttgacattaatctctggtgcttcttcaatttgtgcatctgcaaactgatttttttattaaatgagataacatgaaaatatttgcaaatataagatgatataatttctctttttttcctctgtcgttttacaaagtgatctgatgtgaaacaaaggtacagaaatctagtcttcctcagactttcagatttataatcatttttttgtttgtttttttaactactaggacccttgaatagtagcatatcagaataccatgttgaaaggaagctcagtcatatagtcctattcctattcactcacccaactccagacttttaaagttaactaacagtcacctttaaggaagaatttacacagaactttcaaagcaagtaataagccaaaataaatatacttcaggcaagtaatgaactatcctttgtgtctgcaattgtctttagcttaattgatgccaggactgtgcttagactatgtggacagggatgggagattgctttttatctgatctcaggtccctgcattcataggcatcttccagattgcagagaggacctgtctttatcagttgctgtgagctgtagcttcagcgtgtctctttactccctaaacattgcctgataactccatttgcttttctccttttttgtaagaggggaacttcttatacatttttattacaaattgttttaaaatacaaaggagaaaacttgtaagttgcagagctaaatgtgaggggaggagataaatttgtgtgtttaattccattctatttgtaaatgaccattttgattaaaagtctttcatagggccgggcgtggtggctcacgcctgtaatcacagcactttgggaggccaaggcaggcggatcacctgaggtcaggagttcaagaccagcctggccaacattgtgaaaccctgtctctactaaaaatacaaaaattagccaggcatggtggcacacgtctgtagtcccagctactcaggaggct

SEQ ID NO: 95272 - DNA, 1035 bp, Homo sapiens
ttgaattcctcagcatcaagaataccatcaattcagctttctttctgaggaatcctttgacttaacctgaatctcaagagacagcatcaggtggcagttcagacgacggacactgtgtgtgccaggccactgcactctcagagcccggtgctggggagcccaccctcccagctacctgcccagatggcttcccctctctctggaaactggccaagtgccagccaggggcagcttctccttcctacaagacacaacagtctgtgccccactagaacctccttccaccaaaagaaaacacggtgcacaagttttcattcactcattgtgaagctcatcagcgtgttcctgggcagtctgctttgttcccattgtgtggataatacattattttagaatttcctcgggccactccataggagagaaaggagaggaaattacagagtgaaaggaagtacggtgacaaggggtgaatgccatgtttcaagtctgagatgtctgggttgaaaggagatgggatgattaggaaggaggcactgagttaggaatctggaaagcccagctctgttatgaaacgctcccttatcccatggctccgagaagttagtgccattccagagatgggacgctggaagaggtgcttgaagacccgtgagcttcctgccatggaggtgtgtggtagagcatctgcaacctcttgctggcagccatggggacaaagattcaagcttcaggctgtaacggtgtcatgtacctgtggtcccagctactcaggaggttgaggtgggagcatcacttgagcccaggagtttgaggttgcagtgagctgtgatggtgttactgcactccagcctgggcagcagagcaagaccctgtctctaaaataaaatgataaaataaaataaaaataaaattcaagcctcaagtggtgagtttagttgacattttactgctcttcaacttggagagtctacaactaaattggtctattcaggaggtcctttgttaatccaggataactggtaccagaaaccagcc

SEQ ID NO: 95273 - DNA, 1048 bp, Homo sapiens
agaaggtcatggttgcttctcagaaagggcatttaccacagaccaagcagaatttcccagctgggcgcctggggactggggatcgtgctgttgagcacaggggcatctgagagcattcggacactgctggccttcacctcacacagcctcaggtgtccggtgtgctctcctctccagatggccatatggccagggcttcttgtgtccttgggctgcgcaggagtgaaatctcctttcctgcccgcaggaagccacgtgggcttcagtggccgttttgatttgcgcctatgaatcagacgctggccagatcaccctccatagcccctgcccacgcctagggaaggacaatggggtcagccatgcggttggccaggtattgagggcttgttcatggtgtctttgtgggcctgacagaagcctttgaggccattaacacccaaacccttccactcaatgttgggcaggctgagaactcttctaagaatctaagagtcagcctgaagtatcgggtggggtggggcttcactaggatggcagccacggtgccctcaccctcaccccaggcagttccatggtcaaaaggctcactctgtcccaggccctcctctctaacgttgccctccctgtcacagactgggatgactcaagtcctggactgcccccgggccagctgtcacccgagtggggtgggagtggggtgactgcctgcccagcggtcagggcagcagccacccagctgctcattaactcagaggcagccactggcttcagggaggccctctccccaggacttcccagcctgtccatgcttgaagagctctgtttaatatacatatattttaaatttgcacattggtcctctacccaatacgcatgttaatagtaggtacacttctagtaactgtcgatggagatataagtttgtaaaaagctgctctgaggttagcggtgtttttaacgtaggcaccatgagcacaggtatacattttggaaaacaacactggagggtataaggggcttggactgcttatgaatgcacaaagctagt

SEQ ID NO: 95274 - DNA, 1048 bp, Homo sapiens
tccgggagggagggaggtactgctggccgagggctcagcactctgcactgattgtgtggttttttttttcactgtttttgttttttgagacggtttttcgctcttgtcgcccaggctggagtgcaatggcgcaatctcggctcactgcaacctccgcctcccgggttcaagcctcagcctccccagtagttgggattacaggggcccgccaccacgcccggctaatttttgtatatttcgtagagacggggtttcaccatgttggccaggctagtctctaactcctgacctcaggtgatccacccgcctcggcctcccaaagtgctgggattacaggcgtgagccaccgctcccgaccgattgtggttatttaaacaacccgaagtagaaaaaaacccgtgagctttactttcaagcataaagtaggatacagggattgggtggcactggaaagcttcagaacgttctttcttggatgcatggcgcaatgagagacccaacagaccaagggtcaggaagaaaaaacaatttactattcaaataatgagatatgggtccaacctctgcagtgtagtcagtgaatgaataataaaaagagggttgtgtggcctggggctgctcttgcttcctctgggtcctcagtttccccatctgtaaaacaaagggacagaccagaccgcatgatccttaactggggctgaggctacagccttaggtttccagggtgcagatcttgatattccctgggcacagcgcctgagcacagattcctctgtggggagatggactcacatccctgggaaccctgctggaagtatctgcccaagcaagcagctctgagcccttacctgaaggttcatctttggcaatgggattccttggaaagaaagctgccccttaaccccgggggctgccgtggggtgcccacatagcagggctgtaatatttttttcttatctctggagagcagctcaattcatgtccagtaaacacaaacccggaggccctttcttgatgaacactgcagatataatgaaaaactggctca

SEQ ID NO: 95275 - DNA, 1033 bp, Homo sapiens
acatttttattaaaagtgtttttggaatccttgaaaagatgtaaatttcaacaatagagttaagaaaaacattttcctttcaggcaaagaacagagcagttcaccatttgcattatatagaacgatatgaagaccatacaagtgagtgataatctatttttttttttttaatttgcaggattacatttgttaaagtctgtgtgacaatgtatctctataggtatctttgtgtttctctcttattacattcttacaaatatatgaagtgtgaaaacaaatctcctaagaaggttactaaaatgaatgaaatcagagcttaccatttatctttggtcaatatgtgctggctgttgaggctagtatacattgctttgtgatatttgcaaaggcttattaaagccacacacctaatcctcttgtgtttatgtttttaccctccagtattccatgatatttcattaagatttaaaaggacgcatatcaagatgaagaaacaacccaaaggtaactttaaaactcttaccatttgttgatgataaagcagagaaattataacagttctatcctctcctctatttttgttcatctttagttgaactcatcttggaaacaccaaaatgtaaaaggcttatgttagatttaagaacgatgaggctcttggagaaataagaatagtcaaggcacacaggctactgtgagcacaggcctgttccaggaataatttacggtggggagagcacattggaaacgggaaatagcacctgagtgagtagtagggtttggaggagtgggaacattagttcctcatagggaattcattgatgcatttaggtgtttcagttctgactcaggtccaggtgtttagtgctcatcaaattctgattgaatgccttctgtgagctgggtgctatgctaagcactagggatgatgcagagatggtctttcctgttttgtggacaagcaggcaggcaggcagagttcagggtcatgggctagggcagtcatgcctagtggtctctgagtgtaggattc

SEQ ID NO: 95276 - DNA, 1013 bp, Homo sapiens
taattcatttaaagcatatttagttttttttaaattgagtgtattttatctagatatttttaaaaggcagcatctaaccttggattttataaatacatctaaatttgttatttccagaatgcttcaaaacagatctctgtagcctcgtgctttgttattgttaggttttttttttttgttttgagacagggtcttgctctatctggagtgcagtggcacagtcatagctcactgtaccctcaaactcctaaactcaagtaatcctcccatctcagcctcctgagtagttgggaccacagtcatgcaccagcatgcctggctaattttttaaattttgttcttaatagagacagagtcttgctgtgttgttcaggctggtctcaaactcctgggctcaagcgatcctcccacctcagcctcctaaagtgctgagattacggatgtgaatcattacacccagcctattaatggttttgtatagcaagtcttttgtgggtggtggaaagatgaagtgctgtgaaatattgtaggagcagaaacttgaaatgtggcaaaaaccacatgggcaaaatttctgtctcttttcttatttttgcttttttgtttaaaggtttttctattgggaaagctactgatcggatggatgctttcaggaaagtatgtacattttttttctttgttgacactcagtaaaagattagtaagttatatgccagacacagtgggaaccacaaaacaataataatttgtcccagaaccttcccatgaggcttgctgtcaagggttaattagctcataaaaatcagtttcagaagtacttatattcctttgcaccattttttatcagatttgtaattgtctagccaagttatgagacaattgtggaagtttgaacactgacagaatgtttgaagatactaaggaattgttactttttttttttttttttgagacgttgtctcactcttgtcacccaggctggagtgcagtggcacgatctcggctcactgcaa

SEQ ID NO: 95277 - DNA, 1166 bp, Homo sapiens
taattataaaaaactgtacagttcgtttatgtgtaatttgttttacttctgcaagtatatcaataggggaaacttcttgcagtaaaattgctgccccaaggttatatgtattttaagtgctgataaatattcctagattgcctccccacaaaaggttgcatcaatgtctgtgtttctctacaccatctcacccttgccaacttcgggtttcatcagaccttactgattgtcagtatgatctgtgaaacaaatctctcagttttgatttgcattttttaaattatgagagcttgaacaccattttacatgtttattggctgttgttatttcctttttgagatctgttcgttatatgctttgcccgtttttctgttgggtggttattatttttcttattgaatggtataagctctttgtaagttaaggacattagcccttagtcagatattttgacttaggttttaatttttttccacacagaagttttaagctctgtggcaaatttatcagtcttatatcactacagggttataaatattagttatcacttcgggtttgtgtcttgcttagaaagcctcatttgaagattgtaaatgttagtaagtttccccatattttcctctaggacttccatggtttaatttgttttgtttaaactaggaattggcattcacatcctcttttgtcccaggtctcagaggtcccttgtatcttatagagcagtattgttttatgttattttcccatgtataatttaaaaacaaaatacgttgttcaaaacaaaatacagtggcagcagataatggcagtatctctgtaactgctggtaaactgtatttcatagtgaagtgttcataaactaaagagtcattgatttggtttcctggctaattaaaatctgaattccatttgaagttccattgaaatcatggttttactctatagcagtggatgttttttcccaacctttctgatatttttttccttcctgagacagggtcttgctctgtcacctgggatggagtgtagttgcaccatcaaggcttactgcagtctcaactctctgagctcaagtgatcctgccacctcagcctcttgagtagcaaggattacaggcacctaccactatgcctggctaatttttatattttttgtagagatggatt

SEQ ID NO: 95278 - DNA, 1002 bp, Homo sapiens
cattgcctgacattttaacacttgaaaaatgagtactttaacaaaattattatttatatttttaaaccttcagggcgttatggttttctatggcccggactgaatgtccctcttatgaaaaatggagcagtgcagaccattgcccaaagaagcaaggaagagcaggagaaggtggaggcagacatgatccagcagagagaagagtgggaccgaaagaagaagatgaaggttaaacgggagcgaggatggagtggaaactcatggggaggcatcagtcttggcccccctgaccctggtccctgtggaggtagcaaactcctggttttgtttgcctttgtgacagagagtacttgtagtttagaatttccttgaaatggtgttattacttgtctgtttatactacctttttccaaaaaagatttgaacatctttgaaataacatatcacatcaatatcccaactgtattttgtggagtgcagaagtattccactaacaggatagaaagcactgggttcctggtatttatcatgtaccttctcagatccttaaacgtggggatgtgcactgtggacctacaggagctgcctataggatacactgtttccaaaacacaggtggccacagggacacctgtggagcagcatggcttgggaatgctgtttctgtactagaaatcagcaaagcagatagttgtcatgttaaccctataaaaacacaaatgaagcaaaaattgaaaatacttaggccaaatttgaaaacaaagtttcccccagccctccgtgagtatgtaaagcagtaaaaatcatccaagagatgtgttcttgtcaatgagtgggagaagaggaaataggtaagagtttcgctgctttcttaagaagtttggcttaaagaggagggaagaggttgaaactggaggggagagattccaaagaacatgcttagaactgatcaaaatgcttcagtcaggaggatgaaggtatggaagggagagaacaaaatcc

SEQ ID NO: 95279 - DNA, 1050 bp, Homo sapiens
attgaaatgttgattcttgtttggactagaaaacttatacttaggaaggatagttattagttatcttagtggttataatggaggcaagaggacagggaagacgcctatatcatggttgataaaatgtcagggaaacgaacctattggtaagtaactgagatttgaatgctggcttttaagcagttagagggaaaaataaaatatttagtgagagttttgtggaggaaagtaatagaattgtctcttcttgggctttccaagtgtaaccgtctgatgtgtgcaaaggatgatttaattttgctttcattacctcagtgatgcatgggtaaagctgtaagctgacctccacttctcttattattcaataggagatcatagaccattgcttgaaaactacagaattaagaaaagaaaccctgtttcgttacagtgactgcagatgagctgtggaaaggcgctttagcagagactggtgctggagcaaaaaaaggaagaggcaaaagaactaaaaagaagaaaagaaaggatctgaacaggggtcagatcattggtgaaggtaaacttatttataaaaatagctaaagtgctttgtaagtttcttaccccagattttatagatattttacaaactagaagcatcaaaacatttcttatgaagggcactacgatctatggttttagaattcaaccagttgacttactcattgccccaggattctgggggaggaaaatcccatagaaatggatttattcattcagcaagcattaaatgtccctaggtgtcatctcctataatagtgcctgccctcaaataggttataattagtgataaaatagagactaaatggagagttggcgaatattccctgcaaagggaagatagtaaatgtttctggcattgtgagttacatagtctgttttgcaactgctcaactctactgttgtagcacagaaacagccacagataacacacagtcgaataggcatcgttatgttccagtacaatttcatttacaaaaacaagtcacgaactgagttggcctgtgggcc

SEQ ID NO: 95280 - DNA, 1042 bp, Homo sapiens
attaaagaaaaaaatttgtagagacagggtctcgcaatgttgaccaggctggttttgaactcctgggctcaagcagtcctcccgccttagtctcccaaagtgctgagattacaggcatgagcctccttacctggccagcccagtggatgtgaagtggtatcagtttgtggttttgatttgcatttccctcatgaataagaagcatattatcatgtgctaatggccatttgtatatgttttcttttgtttttgtttttgtttttgtgaaatagctattcaaatatgttgcccacttttatattgggttgtctttattgttgaattgtaggtgttctttatgttttttaggtacaagacccttatatcatatatatgatttgcaaaattgttgtcccattctgtgtgtcttttcactttcttgatagtatttttgaagccacaagttttaaattttgatgaagtctcatttgtctattttttttctttttgttgctgtgcttttggtgtctcatctaagaagccattgcaaaatccaaggtcatgatgatttatccctatgttttcttctaagtttcatcgttttagctcttacctataagtctttggtgcattttgaattaatttttatatatggtgtgaggtagggtgccaacttcattcttttacatgttgatatccagttgtcccagcaccacttgttgaaaacatgattctttcctcattgaatggtctcaacacccttgtcaaaaatcacttgcccataaatgctgtgtcagagcctgttctggagtaccacactgtgtgagagggtacacagtacagtcagcgtggtgctgcagggattccagagggaagggggaacattgtaggatcagggaggcttcactaagaggtgatgtttcagacaaacagagaaccttgcagagacacagaagtatgcgagagcacagtaggttcaagactgactacaagtctggcatggccagagggaagatggaggagagaaaggtggggcagcaggctggtgtggaagcttggggcc

SEQ ID NO: 95281 - DNA, 1056 bp, Homo sapiens
atgttggctttgggacctggaccctgtagggctgggctgggggtggggtctgcatctgaagggctatggtgcctgacactccatgtttaacacagtggggtcccagtccagaaggtccataaagctcctgaaattatgggcaagattatgtgtttggtgcttcttcctggagtgctgaaatacggttctcaaggggatctgcgttcccaaagtgttcaaaggctcgcccctgtggctctccctggagccttgctggtggagggtgttggtgggccccggcaggcagcattcctgatgtgctggtgacataaaggtcctccttgtccctctgtgtctcctggctcctagcacattccttgtaggagcagagactcccttacacacttgatttttctccacagccttgtcactcccttaagatactgggtatctcagtttctttatcattagtttgtggtttgtctcccccagctgcgggtcacatgagggcagggactttgtcttggtcacgttagcaccctgtgcctagaacagtgcctggcaccaggcagcagctcggggaggatttgttaaattcatgagggaacctgctgaccaagagggagaactggagccttctcctgtcccctctgctccacctcctgctggcgaacctgaggccaggtcctgtgagagctactgcctggatgggcaccgagcagggggcccggagcagcaggggtgggggctgctgcagagagcacagaggctggaggtggggtgtgctcggtgtcatcagggtaagtgggtggagccgagtgagtgaggagtggtggcagtggaggtggggggccagtgggctctttacccagctgtacattatcattgtaatcacctgggaactttaaaaaatacccgctgtgcccaccctggggcatcgaactctaaatctctgggtgaaacccaggcactgggatttttaggagtttcttgggggactctctgtcctgggtcccccatcagtgcctttctctgggtgacttcatgggggagtcactgcagccacttctcctgagc

SEQ ID NO: 95282 - DNA, 1016 bp, Homo sapiens
tgtttggctttgctttcctctctgaaagtttataggatcctctgcacccaatttgctgaaatttcaccatgatctatgcttgcagctaaactgcaggctgttttcatgcattgtgccaagccttggtggacactggaaatctctgcttccattctgggaaatcgtctttcctgattgctcctacccactttcctctgttttctcccgttcttcccgaactgcctgtgtcccagcattggcccctctggagtgcaactctcattatcctctgttctcccctatattccagctatttgccttctcattccacttcatggaagattccatttgctctcccaacctttctttttaagtctgtcattttgctttcttatttttaatttccaagagctctttcttttttccagttacctcttttttgggacatcctattcttattttagtgatggaagatttgtaatctctgaacctaatagttgttgtcaaatttttttctcctgggataatttttgttcttccaaatcgctttcctctgtctctgtctctctcatggtacagacttcttccagtcccgaaaatctaacacttgaggggcctcggggccttggtgcatggccctgtcccttgcactctgaccgtcctctgtcccacttcgctggtacagcccctttctcacccctttctttcagagtagcctgggaggaccccagggtgcagggagggtttcacctttaaaccttccaagaggtagggggaaaacctgctttctaccaactgctgtaacaaaacagttgaagttgtcacatggaaaccatttaaacagccatattctgtcatattagtagtaaagtttcccatgccaaaggcgatggccacacacagcatgtcatgactcaagagttgagcaccaggtttgggcgaggtggccctgggattacacctgtaatcccagcacttctgaagcccaaggtaggaggattacttggggccaggagttggagaccagcctggacaac

SEQ ID NO: 95283 - DNA, 1006 bp, Homo sapiens
aaatgattatccaccttcagacacaaaagaagaaatatgtcctcagagttaaccattgtgctattcttccttatccaggagttgttacagactcccagagcccagtcacaagagttgtccacatccagctcccagtagtgtttcccaaaggagaagaccctggctccccatgcagcaaaatagtcagatctgtcagaattcaaaggtccacgtctaaacatccaacttctcacatcctcaaagagcctgatattgtgattggttacttcaaaatggaaggaaatttccactgtagaaaaaagagaatgttccagtgaaaatcagtttgtaaattcttatgttcagataagaaagagattctcactagaaaacacaggtcaagattagaaagaaacttctgtctggaaaaatgttggaatcaaagggtgttaggagatctgcacaagtaaatggctaaactaggatgatcacaatttccataaactcaaaaagtataaaggggaggaaggtcatgtctatgtctcgttagcgacctttcataacaactgaaaaactggaagctcctccactgcagccaagtccatagccataaaattaaccttcattgtctcgtctctgtcagggcagagcaggaggctttggacaggagatgaggtggggagctattcttagtcccaaataaaaaagttatcactttccagaaatattatgatctgccacttaacctagcaaattcatacttaaagagaaaacctgaatctgccttctgaaaagtgctgattccttgcaaaaattatctgactttcatgccagattcaggcacagacttcttttattctgctggatttgtcatgatctatcctggagttctatctaagacctcatcaaccaccaaatcatgttcctattgttgacagattctcagtttttgcattgttatataagttactcatgtatgctttagttgattaaaaacatgattaaaattataaatgctatgaaacat

SEQ ID NO: 95284 - DNA, 1097 bp, Homo sapiens
acacagtaaggttacatattgctaggggatattacttcgtatttatcctttgttaaaagtatccagagtgacttttaaactcagtgccctggacacgtgttgctcttctgcagtcaatggtgtggggacctgtgcctgcatcccatgatgctgtctgccactgcccaaaatgtatgggtctacaagtcacacctcccttgtcgttcactgggctctggttcgtggtgatggcaaacatgggatggcagccaagccatactgacagagatccacagcgtacagcctctgagcatagttaatgggccccaaagccactgcggctcactattcctctcccaccctacaggaggtagattgggaagtggagctggccgtggtcattggaaagaaaggcaagcacatcaaggtgaagtggaaaaggtgggctcccaggccagagtgcagcagagtccccagctcctgcctctcctagttctgacctcgctcaccaacacatggtgccagctgtccctgacactaggaagcagtcagcctccttgctccctgacactgcctttcccttcacccacctttggctggctctggctactaacatgggataacagctttgagatcccttgccacaggtgttggtgtcacccatgatctatcctcctgtatggccaaatcccctgcccccataggccacagatgccatggcccacgtggccggcttcactgtggctcatgacgtgagtgctcgtgactggctaacaagatgcaatgggaaacagtggctgctgggaaaaaccttcgacaccttctgccctctgggccctgccttggtgaccaaggacagtgtagcaggtaggttcctgatccctgcccccttgtacctaccattgcacagatgaacagccctccagggaggagcacgggttcaggtacatgtggcacctgccctccctggctgccctttcactgctgactccatacagggaaagtcttttatcctcagccacgagttctcccatgggcttccttcccaagccccctagagggaacacaactgcagaggatgtgaaactgcatgcgtgaagtaaattacaaagaacact

SEQ ID NO: 95285 - DNA, 1880 bp, Homo sapiens
ggctcctgcacaggccctgcacataggatgagggcatctgctcccactcagcctagcccagggaaaggcccagtgacaggtgtggacaggtgccagccctgcaagccgcctcttctcggtagaagggagaaggacagagctctcttcaataaattcgtcgggtcaaagcagcagcttggcttctgctgtttgtcttcgtttgggctttgtttcatgggacaagttagggcattttgtgggactggggaagaagagagcaaatacacacacatacaccaaaaagatgctgctgggctggggaaaagacaactcgtctcgtccccttgtttatcacatcaaagaagggaaaaagcaagagatggcaagggacaatcaagcctcaatgattatatttatagagcagctaagggtttgcagcctcctctccatcttctggctctaggacacagctgtgttctggggctgagaagtctcagcacaggctcctcctcacagttctagctacaaatgaactgccggatgaactgttctagtttttcctgattgtccaggctggcaaaagtaggggacaggtggagcctggggcctgcagggctcggcgtctgctgcagaacctgggccatggaagataagccgtgagtgcgctcaccacagggactgtgtacacatggcccaggggccaggcctgtcccccagaaacctgccttgagacctctggccccttagacctcaatgtttgcgtgcaaatgctgccgcaaagcagtcccaataccccacctagaaagatgagccagtgatttgggagaccaagaggcaggaaaccatcccaccttctccaacccatcaccaaatctgttgctggaagacaccaagtaaatcccagggtcttaatgaggcaccatcaggccagccctgtggagtgatggggacatagctgggtttccctgagctactctattggggtgggagcagggggacagaagatggtgacagtggctcctctcacccctaggtctctgaaggtccagacagcactgatggcgagctttgggtccgcacactctggaaagaagagagaagtgaaggctctaggtagggagaacagagagccactgggcacaggcttctctcctcttgtttaaagaagcccagggagggatagagctctgactggacagaagactgtactctgcagcctgccttcctagagttgggttgtcactgtcctgcagggggcagcagccaccagcaaacaccactgcctgcaggagcctgggctgactggttgggactcaccgaagatcccttcttcctgggcggtggcctgcaggaactggaacagctgctctgtgtagcccaactctgcagaagagagaagacctagacctggcacccagcacagacacagcctgcctcgaggactgcaagggaacaagggcctcaccagtatcgggcagctggccctggcggaggaaggcggcagcctgtgcaaaggccttgagcagcgggctgagcaggcggcagaggaaaagaaagaaatctgggcagtgtgactgctggctgagctggaggggacaggccggggtgagtgcagctccccaccgcctccctaccacctccctccaggggcagctttttgaaacacaccctgaagtaccggccgtcagcctctccgaagtcatcactgtcactatcagtaaagtccccactcggtttccacagcagctttctgctcaatcgctgtcgccctgtgtcacaggctggccgggagcctggggtctaggggccgtggagccattgttctctgacaagctggccagggatcaaccctacacccccagaccaggtacatgcaggtgaaaccagtaaaagcagaccta

SEQ ID NO: 95286 - DNA, 1248 bp, Homo sapiens
tcagccagcagtcacactgcccagatttctttcttttcctctgccgcctgctcagcccgctgctcaaggcctttgcacaggctgccgccttcctccgccagggccagctgcccgatactggtgaggcccttgttcccttgcagtcctcgaggcaggctgtgtctgtgctgggtgccaggtctaggtcttctctcttctgcagagttgggctacacagagcagctgttccagttcctgcaggccaccgcccaggaagaagggatcttcggtgagtcccaaccagtcagcccaggctcctgcaggcagtggtgtttgctggtggctgctgccccctgcaggacagtgacaacccaactctaggaaggcaggctgcagagtacagtcttctgtccagtcagagctctatccctccctgggcttctttaaacaagaggagagaagcctgtgcccagtggctctctgttctccctacctagagccttcacttctctcttctttccagagtgtgcggacccaaagctcgccatcagtgctgtctggaccttcagagacctaggggtgagaggagccactgtcaccatcttctgtccccctgctcccaccccaatagagtagctcagggaaacccagctatgtccccatcactccacagggctggcctgatggtgcctcattaagaccctgggatttacttggtgtcttccagcaacagatttggtgatgggttggagaaggtgggatggtttcctgcctcttggtctcccaaatcactggctcatctttctaggtggggtattgggactgctttgcggcagcatttgcacgcaaacattgaggtctaaggggccagaggtctcaaggcaggtttctgggggacaggcctggcccctgggccatgtgtacacagtccctgtggtgagcgcactcacggcttatcttccatggcccaggttctgcagcagacgccgagccctgcaggccccaggctccacctgtcccctacttttgccagcctggacaatcaggaaaaactagaacagttcatccggcagttcatttgtagctagaactgtgaggaggagcctgtgctgagacttctcagccccagaacacagctgtgtcctagagccagaagatggagaggaggctgcaaacccttagctgctctataaatataatcattgaggcttgattgtcccttgccatctcttgctttttcccttctttgatgtgataaacaaggggacg

SEQ ID NO: 95287 - DNA, 1026 bp, Homo sapiens
gtagggggtgcaatgtggtggggacctgggcggtggggggggtggcgatgtgtggccctgctgcctagccctgctctgcccacccagggtgtgttcctgtcgcagctcctgggggagttctcctggctgacggaggagatactgttgcgtggctttgatgtaggcttctctgggcagctgcggagcctgctgcagcactcactgagcctgctgcgggcgcacgtggccctgctgcgcatccgtcagggtgacttgctggtggtgccgcagcctggcccaggcctcacacacctggcacaactgagtgctgagctgctgcccgtcttcctgagcgaggctgtgggcggtgagtcttgaggtgcacggggtaggtgggatgtgtgtgcagtggtgaagggaacggctccttcttcataatggaccctccgcccccagcctgtgcagtgcgggggctgctggcaggcagagtgccgccccaggggccctgggagctgcagggcatattgctgctgagccagaatgagctgtaccgccagatcctgctgctgatgcacctgctgccgcaagacctgctgctgctaaaggtcaggcctcccctacggcccacttggtcctaggccttcccctcttggtggtaggaatggcccatccctgcccatgctctacctctgaaacctcctgggtagtaggtgtggccttgcccggtctttggctaggcccctgcccatgtgcctggctctcctgaggccacatgggtgcctttttctcccagccctgccagtcttcctactgctactgtcaggaggtgctggaccggctcatccaatgcgggctcctggttgctgaggaggtaggcagggcagttggagacaagatccttgcctggagcctggcctcctccagcctcccaccctgagtgccagctgccccaggctcctcctctgccccgtgtgtgctgtgggggtgggcagcccctggccttgcagcggggaagcctagctcgcacctctgctccctgtgccttgg

SEQ ID NO: 95288 - DNA, 1135 bp, Homo sapiens
gctggactctcctcctgggttgctggatagtgtttaccagagtgggctgcagcctgccttcaccaccgcctcccatccccacattttgccagcacaggttggagcctatgttagatgcagcacactgttccagggaaacggagggtaaacgagatatgcgcggctgcaaggaggaaggaacagggctgagacagaataccaggaaggggacaaagagcctgtaagccagagccaagaggaagaaaaggcgaacaagaatgaggcgaacagtcttgctagagggaatagcctgagctttggccctgggcaggaaaggactaggtttgctccagaagctgacgtggttggaagccagcaagtgaggggtcgagagctgtgggaggtgaaatcgagaggcagaagggatcaaatcatgtaaggccgtgcaagtttggactggatctccaagtgcagtgaaaaccagttgcaaggttttaagtgggaagtgacatcatgaattggggtcaagagtggagaccagaagggcatctggaaggctgttttgttaatccaggtgagagatcatggtggacagtagaggttgaaaagtggattgagaggtcgaggtgatattaacaggactcactgagggattggacagtgggaacaggggcagtgagggaagtaggagaagttacaggacagccccgtttctagcctactttctggtggtatggacagagaacaggctttgggagaagtgagttggcccaaaaaggtagtttggagagagagagttttggtacctgacatgcttgtggagacactgaggaggcagctgcatataggagcctggagctcagaagagaggttggggccagagacactgcgaggctttagcatacagatggtgtttaaagccaaggagatgaatgagtccctgagtacaggtgggcttgggggcagcatgtgtcaagctcagctgtcttgaatgtgctgagtggccaactgagcaaggacagaaagtagaggttgttggtgaccttgaccagccctctgctgttctagtctcttgatctgcctaccttgacatcagccatcagcctccctttctgtgtttccttccctccaagcctagctcagattgcaggctcgg

SEQ ID NO: 95289 - DNA, 1388 bp, Homo sapiens
cacattaacaaaggaaatgacactgggaggcctgacttgtttttcatgactgcaactgtctcttgatgatcttctctcctttctaatcgtccccagctcagaattttgctagagccgaaccccagcttggaggagcgtaagccctgggataacttctttaatcagaatctggcctgagtccctgctcgaagctcaagcacccggggcctcgcggccgcctgcagtactcccctcccaccgcgggccagggccgactggaaaacggagcaggccatccccagagcacgggtcccgtggccacgttgagtgtcgcagagtacgggacgcagggcggggcttctggaccagcgcgcatcccaattggctctcggggctgccttttagccggacgcgcggaggtgggcaatccgctccttcccttgagcagtccacgccttgtggcggctttgcggagctgctgctttggcgggagttggaagctggtgtgaggtgagaggcgcggtggtcgctccccggcgaggccaggtcagaaggggaccgggatcatccaggggctttcctgcttcaagagcctggtctgagcggcctgttggggactgggcggaagtcgaaagggagggagtgccggccatgcgggtcttgtggcgggaatgagtccttgtggggcgtggtgttgtggagagccccgctttgcctcttcctcggcatcccgttcccctacatccagagagggcatccaggacctgatgtcgggcaggtgcccttcgcacatcttggggtagctcggggagcgcctgtcacgggtctgacgaggaagctgaggcctgaggggccctgggcgggggctgtggggcgccgaggccatgtttgagcagagccgggaaggtgaagttctcttgcggctctctgtagggcacaagcattccaaacgtgggggcaggtttagagttttacccttgatcaagggctgaacgctcagatgtgcacaggctcaggcgtcagtgataatcaaggtggaggcaaacgggagggctcctgctgtcgggctaaagggacagtggcggccagctgagccctgtggggtgtgtgctcagagatgccagagctcagctttttccattacagccgcgactggaaaccttgattttcaaaaaatgtatatgtaacaagccctctgctgttcaacgttggttttacatcataaggttttagcacgttgtgtagtcaaagaagtgtgtgtgtgtgtatatatatgtatatatgtattatatgtatatatgtgtgtgtatatatgtatatatgtattatatatgtatatatgtgtgtgtatatatatgtatatatgtattatatatgtatatatgtgtgtgtatatatatgtgtctatg

SEQ ID NO: 95290 - DNA, 2028 bp, Homo sapiens
cctggacagcacaggcctagtgactgtacttttggttgtaagggtggcagtggctggcatgaaccagaacaggggtttgtttgtgacaatgacaaggagaccgctaacccctgctgatctgtgtgtccagttttatttctcttttttctaatttttttatttccatacataccctgcttgtatatcaagctcttttctaatcagggatcctcaaatgacaggagttgacctctgattgtgtttgtgcatttcaaagcccagagctgtgacctcagccacggtgggcaggatgggtgctggagaagggcattaaggctcccagctttgtgggggaaatggcatcttcttgagtgagtggggaagtgcaaatagaatatgcacaagctaggaaggacatttttaaagcctgtgcttcgaacattcttcctctaaaggatcaggtgagctggctcagagcagggagccaaccgccgagccagggtgagagggctttgtatttggagagtgaaaagaatacggttgtttaggctttggactcagagcatcagaaactcaggagaaatgagatcagctgaaaaagaaatgggtttgatgttgtagaccaaacatgaacagtggggaacaggctgaaaaacgaggggggaacagtcagcagcttccacggcttctcccaaatggagggaagtggggccagctcaggggacaggctggaggcttatgacggaaagatggtggggtccaggtgtggcaggacaggaggcaaagctgggggctgctatgggacagagggggcagagggaaagttgtgctgctaatggggtcacaagagtcacttatggcctggggccttcaagaaccaagggaagccctcccagagcccagcaccaccacaagcaatgctcacggctccagccagcaagacttggggtagcagcccccagcctctctccccatattggggacaaaagagaactggagaagccagagagagggagctggccaagcatttccggagggcacagcccaggcctccaccatcctctccccatgtgtgctcaacccttaaacactttgctaagcattacaggtcaggcccctcccctgtgtgttcaaccctttaacactttgctaagcattacaggagttcttctgctagaagtggccaatcaaatgtccctgggcttggctcttggtccatggcaacattccttgcttttggagagggtgtggggtccaggagctaagtgtacccttcagccaagtcatatatcctctcactcaacctcacaataatcattccaggtggtatcattcttacccattttacaaaggtgaggttgaccctgtgtaatagtcagggtaggcttggttacgctgctgtaacacacagctctaaacatctcataacttaacacagtagtttacctctcactcccactcatgggggctggcgagggaatctgctccatgcaggtcgctcagggattcaggctgattgaggctctgctgtctggaacagtggcctctgccaactccctggcaggggaagacacagatggaggtgcgtactggcttctttagaatttggcatgatcctgcctaactagaaaggtgctgagtagtctgaggaacatctgggctgtctgaggatcccctagtcccctagattgggaagtgggagcgaggcttaactgaagcgtgtctaatgtcaaagtccttgctgtcagccccgccttatgcagcttcccccctaaaccactgtgaaaacgtgtgagctctgtggtaatgtgccaattccaggggtgtcaacaccatgacccccagatattctcatacactgcctccttagcccatcccaggcaaagagggctctgcaaaccagggaccctgcgaggccaggggacagtgggattatactgccccatcccctctggcctgcctcccgcccttccagcctgctcactgtgtccctgctgagtcccatgactctcagctgccctcaggatcctgcctccgaagagtcctttc

SEQ ID NO: 95291 - DNA, 1293 bp, Homo sapiens
ttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgtttttgtttttgttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaagtgtttgtctttggacaaatggtggtggaaaaatcttgcatattggacttaccatttctttctgatcacaaagttgaaaagaattttactctgagagttgggaggtggaagtggcagggcttgttcattcttggtagatagtggctgacacagtttgcctagaccacgagccctttccaagtgacctgcttggcaactgaaaataaaccacctatgtccacttccctagcttgatatactgacccatatcctttccctttaaaaaaagatcactttggagggagcagtgctagagcttagcagacggtagaaatcaggagggacagaagcaggcctgaggtctagggttgaggttgaggagagggtcaagtcagcgctcttggcggaggggcagtcctgctggcatg

SEQ ID NO: 95292 - DNA, 1365 bp, Homo sapiens
tgtgtttgtagtagagacagggtttcaccatgttgatcaggctggttttgagctcctgacctcgtgatccaccctcttctgcctcccagtgttgagattacagtcgtgagccaccacgccctgcagcacttgacactttgtaatctttatagccaacctcgagataggtactattattatttccattttatagatttagaaataggaactggttaaataataatctagttagtgagtgttggactaagattcaaactcaggaactcagtttttattgactatactgtgtcctgtttatatactacatactgtggtttactgtataaccttcttgcacagacctttgtgtggacacttcatttcacagggctgactaaccacctcaccatggctctttttcccctttacagatctattaatgagatgaagcggttggaagaaatgtcaaatatgtttcagagctctggagtccagcaccaccctccagaaccaaaagcccaaacagaagggaatgaagattcagagggcaaagagcaacgttgggaaatggtgatggataagaaacactttaagctgtggcggcgcccaattacaggcacccacctttaccagtaccgaggtgagcccagtgtggctatcttttgggttccatagttgcacaggtgcatgggatttctgttcttcatacttctctaaactgttctggttgtttctcagaaaatttgccgtagttttttgtttattgtttttcttctcccagatgacaaatgtctcagtgttgtctttgcttacatcctctttgtctttctttgttgctctactaagacttctagtttctgaacctgcctttaagatctcttagtactttagatctgaaacgccgctaggtgaaagaaacaaggcgagtgactggagtatggccagcatcccttattctttcttttcattctagtttttggaacctacacagatgtgacacctcggcagttcttcaatgttcaggtgagttaatttttctctccagatttggagcctcctagcatatcaattgctactgtctacatgaatcatttatctgactcaggtgacattggcttaagtacatccatctatctacctgtcatccacattgcatagcatttaggtaaacatttgacttagaatttctttatctgtcccatggggatgagatcagttttaccctcccacaggactgttgggaatatcagatagaggaatggatatgaatactttaatgtattttatgaggctttattgtttttttccccaaacaacttaagagtaagttacatacatcatagtcctttactcctaaattcttccagtgtgtatttcctaaaacta

SEQ ID NO: 95293 - DNA, 1026 bp, Homo sapiens
ttagttattgttgaaggatgctttatagacctcaaaaatgctgtaatcgatgccctatggtgcctgattgttctctgagcaaatctagctatggttttgcttttgctcttcttctgcaacatctaaatgcctatcctaaggttccttctctgtttctctatggttttgcagctggtcagggttcttggttgtaacaaagaaactggtcttggttaatttaagccaaaaaggaattaatcaaaacggtattaggtcactcagtattgacaaggccagggtacaggttgaccaagacctgcagcaggaataatctacttagagcagtgttgctggcattctttcccccagattggttgtactcctggactcccagctccctcaagatcctgtgcctttgtgttatcttcaagatgcaaagccccttctagaagtctctaacctcacttaaattaggagctgtgctttaactgcttgtgggcgggaggggggctgcattcacctatttgggttctttccaaatagaaagggatttcaggcagtcaaaatgacaaatattcccctatataaatattttcatccaagtccaaagcttaaaattcagcaaattcaattttagaactaataggacttcaagaaataacgtcctcactttaaaggtaaaataaaataagatcacacagctggtcagctgtagagccaggactagaacacaaatctttagacttaccattattttgaattgctctaaacttttaatcttggattgacactatacctttgaatttttggcttttgcagcaatatattaatgcaatatatatatatttttgagacagtttcactctcacccaggctggagtgcagtggcacgatctcaactcactgcaacctccatctcctgggttcaacagattcttgtgcctcagcctgctgagtagctgggattacaggcgcaggccaccatgcctggctaatttttttttgtagtgctgggattacaggtgtgagccgttgcacctggccaat

SEQ ID NO: 95294 - DNA, 3125 bp, Homo sapiens
tttgaattgtggtgtgcctactccagctcccaagctgcatgaccctatttgctccttaagacagatggaatctgactggcctagatcaggtcagactgctgtccccaacctcaggccaggaatcccatggtcaagagagctcctccttgcagagtctggggccaggcaggttctctgagaatggggtttgggtagagaggctgtgattgggtcctcaagcatcctagctgtggagtgctcactaattccccttctgtgctgtccctctgtctcctagttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtaaatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgaggctgtatttttttttctttttcttgtttttgagacaagagtctcgctctgtcacccgggctggagtgtaacgtggcatgatctcagctcactgcaacctctgcctcctgggttcaagcgattatcctgcctcagcctcctgagtagctgggattacaggcatgcgccactatgcccagataatttttttgtatttttagtagagacagggtttcaccatgttggccaggctggtctggaactcctaacctcaggttatccacccaccttggcctcccaaagtgct

SEQ ID NO: 95295 - DNA, 1053 bp, Homo sapiens
aatcatggcctggtttctttttggttcagcctttattctaccctatgcttctgggagcttttgcagtttgcatagttatcaaaggagacagacagtatcatctagttttttgtttttttgttttgttttttgtttttgagatggagtctcgctctgtcgccaggctggagtgcagtgacacgatgtcggctcactgcaacctccgtctccagggttcaagcgattctcctgcctcagccccccgagtagctgggactacaggcgcgcgccaccacggccggctaatttttgtatttttagtagagacggggtttcaccatgttggccacgctgatgtcgaactcctgacctcaggtgatccacccgcctcggcctcccaaagtgccaggattataggcgtgagccactgtgcctggtagtgtcgtctagttgaaatgtttttttaaagaatggctaaagtactggagggaaatacaagttgctgtgtgtctgctgcgtggttgttgtcatgggctctccctgcaccatgacccccaggaaccccttgagtgctgtgtcttttctttcagcctcttccttttccttcatttatgcccttgacgtgtgcacgttggcactgtccaaggcttctggggcttttgtggtataaatgtggtggcttcctagcttttcctgttgatggcttgtccccagctctgccgagtctgctgagtcccttttaggtaggtctatttccctttactttccagtttttggaaccttgttttatacctccctttctttttgtgtgggttgccttttaaaagaattcttttgttctcgtagagttcagggagggagctaaactaaatgtgatatagtctaccaactttcctaatctatgtaatactttcttgtagctgcacatttctctaaactgccgcaacttccttcttcctcttttctttattttacttttttttaaaattgtggtaaaatatacataacataaaacttagcattttaactttttttttttttttttttgagacagagtttctctcttgttgccca

SEQ ID NO: 95296 - DNA, 1976 bp, Homo sapiens
ccggcgggcgccggcggaggagcccgggaggcagcgctctgcccaagcagccggagcgtagcctggcctcggccctgcctggcgccctgtctatcacggcgctgtgcactgccctcgccgagcccgcctggttgcacatccacggaggcacctgttcgcgccaggagctgggggtctccgacgtgttgggctatgtgcacccggacctgctgaaaggtgagggtgctgcgcgctggcccttaaagcctcggtgggggacagaatgtgttctggctgaagcagagatagccagggaccagacacttggttgaaggaaacggccccataactgcctggtgttcatgcccaccaggtggctctgtttggggtccggcccctcattaattctgatgttattcagctaagcacctactcctcacagccatgttaatccggactgctgctattttaggattctgctggaggaaggacgctgtgtatcgagaaaagataagggtgctaggtatcacagttagctggcctcttctaaggatcctgtgaaatacggaaaagcttctttggggcagactgattaatggagaaaaaggaacttttaatatgactaggttttaaaagatatcttagagttctatggtaatcggatgcgtattagagaagaagggaatctgtggcattttaggtaatcggaagaccgttccattgccacccgcagtacaacagtcggaatgtggctcttggaaccattataggtgtgcctgacagaggcaaggttgctttgttcatcatcatgctttccggccagatagacagcagacgatgggagggtcctatgggccccatagtttatcctgcccattcttgtctccagtaaaaattgtgaagtgtgaggacaggactggactgtatcacctgctttttaccctaacaatgatcaatgtaccccaaacagtccttagtaacagcatagttcatcaaccccaaggtcttttgagccatcttgaaggtcttatatcctctctgtgctatcctgtctgtgctattccctggctgtgatgcattccagatgtttactgcaccgcctatcagaagcacttcctgttagatatctgcgtgttacctcctgaagaattcaggcactgggatttggtgaaaaggtccaagttccccgctgtgcatcggaccatactctgcttctgcaggtctaggctgaaaagcctcatccttgtggccaaatgttgcctttctctgagtgttctcttactgttttgcatctctcttgagttttagaagctgtagggtgattttgtagaaggttggggacaactggttgtttccagatttcaccttaatggtactctttgctgggttggctcattaaagccaaagttatgcacacgacagaggccttatatgcagccttttctctgtcatgttgctaatggcacaaagagcattaagcttgagtgagtcttggtggtttttcttttagcacattgccctgtacttgctttctttgaagcacacataccaccttcccaccactagacccatcagatctagaaagctagatctccgaaatctagcactgcatggggtgtgcttagctgtggctcagaaaaatgaaggatctccccaaggctacccagtttagggtggcagagctgggactaccccacctctgttgatgccaatataaaatgatgccgtgtcatttatagtttttatcctttgttttacttcagctgtcataaggagcaatctcataattatttcactttggtgtgcatccttgtcgaaggcatgttaaaaataaaagtaaatttttgagccgggcgtggtggcaggcatctgtaattccagctacttgggaggctgaagcaggagaatcgcttgaacttgggaggccgaggttgcagtgagctgagatcgcgccattgcgctccagcctgggcaacaagagcgaaactccatctcaa

SEQ ID NO: 95297 - DNA, 1962 bp, Homo sapiens
gcttggcctttgacccgagtggccagcgcctggcgtcttgtagtgatgaccgtactgtgcgtatctggcgtcagtatctaccaggcaatgaacaaggtgaggtccattagtagagctaaagaagacccatctctcaaggggttcacagtctgctaagacacgtacatgagtcagagcaaatgggggtaaaaggtaagatgtgctacaagagggctctggatagagtgctggaagaatcaggaaagttttgtagaatgggttgtttcatctgaatttaaaagggtatgtaggattttaacatgagaatttcacgtgagaattcaagtgaaaactcaacagtgtgagtaaagataacaatggcgggaatgcttagactgaggggtggtaatgcatttaaatggggcataggacgtctggggtttggagaggaataaagtgggttgggtcggctggtgggtggccttcacaggcacgcaaagtagttacatacagtctgcaacagaacagggatgtttcctcggaattctgcttgagaaacgccagtctggctatagtgtgtaaggcagataagcagggatggggacacgaacggagacacagactcataatcagttgaagatgagggtgagggaaggtaagttaggttctcctttgaggtgcccaggacataggaacgtttaagggcaagagaagtctgtcttgcaggggtggcatgcagcggctctgaccccagttggaaatgtatctgtactttgtccggcttccactcaaggaccatttatgacattgcttggtaagactccatccccccaccccatcccatccccataaatcagggattttagagaaggcataccctatgcagtcctctgcaaccctgggggagtgcttgggaattgagggcagccacccccattccttatcaggcctgactctaccatgctggtttacagctggctgggctggcattcacaggagcagagaacagtcccaggctgtgagggtagcaccagcgctagaggttcgcacagctcgtgctgtccagaagttattattgaatctgcattcgtggctgagggtttttttttgtttttttgttttttgagacagagtctcactctgcagcccaggctggagtgcggtggcgtgatctcatctcactgcaagctccgtctcccgggttcacaccattctcctgcctcagcctcccaagtagctgggattacaggcgcccgccaccatgcctggctaattttttatttttagtagagacggggtttcaccgcgttagccaggatggtctcgatctcctgacctcatgatccgcccaccttggcctcccaaagtgctgggattacaggcatgagccaccgcacctggcagtggctggggtttttataggtaacactgactctggccttgtggaagctggaaaagctgcaccattcatataggagagtaggttagagggtagttctggccctgagaattgatccctaggaaatccaaaacagtgaaaaaaactgagcacttaagcttgctttatattagcaaacatttgggaatcacctattcaacaaaagtgaacttaagtaaattatggtagaactcagcttgttgtatcactgtttaaagaaaggggttaagaatactttatgatggggccaggcgctgtggctcacgcctgtaatcccaacactttgggaggccaaggtgagtgaatcatgaggtcaggagttcaagaccagcctgaccaacatggtgaaaccccgtctctactaaaaatacaaaaattagctgggcgtgttggcacgcacccaatcccagctactcagaggctgaggcaggagaatcgcttgaacccgggaggcggaggttgcagtgagccgagattgcgccactgcactccagcctggtgatggagcaagactccatctaaagaaaaaaaaaaaaaactttatg

SEQ ID NO: 95298 - DNA, 1019 bp, Homo sapiens
atttggtcttaggacctctttacactactaaaaactaagaaactcaggtttttgtttttttttttttctttttaaataacaaatttatttttcacagttctggaggttgccccaaaaagcttttattatctagattaaggttaatgcacttttaaatcataatgttaacattttttttcttaatagagacagagtttagccatgttgcccaggctgaccttgaattcctgagctcaagtgatccgcccacctcagcctcccagagtgctgggattacaggcatgagccaccatgcccagcccacgttaacattttttatgaagaataacttccaaaacaatccaaggagaagggtggcattttacagtctctttagtatcttgttataataaacagttgaattcttacagctgcttctacatccaaacttttttgttgaagtaagttgacttcacacagatacgcagttggaaaagtttttaaaatagccttttcagctaattgtggctattctttgataccacaccaagactacaagtgattttttttttttttttttttttttgaaatggagtctcgctctgtcacccaggctggagtccagtggcacgatctcgactcactgcaacctccacctcccgggttcaagctattctcctgcctcagcctcccgagtagctgggactacaagggatctgccaccacgcccggctaatttttgtaattttagtagagacggactttcaccatattggccaggctggtcttgaactcctgaccttgtgatccacccaccttggcctcccaaagtgttgggattacaggcgtgagccaccgcgcccggcttactacaagtcatagtttcttaaaggcaatgtagactccgaaaacttaatgcactcttatattgttaatacattaaaatccactggcctgtcttacacttttgaatcaatctttgagccatgcatgattttgtaacatcacgtactggtcacttggaaaaatggttcattgaa

SEQ ID NO: 95299 - DNA, 1042 bp, Homo sapiens
aggaaatgagccagaaccaacaaatgaattcatctacttaaaaaattaagtctgtttgagacaacttttgatagtattaaaatgttaaatctaattgtatttcgggaagaaactttggaaagctatctgatttttgttctctcttttgtaactgtaccattttcatggttgcctatggtcatcaagttttacatgctgaaattcttggttttggatcactgcagaaacgtgaagagggctggtgggtggtgattggagatgccaagtccaatagcctcatctccatcaagaggctgaccttgcagcagaaggccaaggtgagtgtgtccactggccctagcatttgttctggcatgggggaagggtgagaatgcttcctgtgtccatgctcatcttgatttctgcctgctctttctaggtgaagttggactttgtggccccagccactggtgcccacaactacactctgtacttcatgagtgacgcttacatgggatgtgaccaggagtacaaattcagcgtggatgtgaaagaagctgagacagacagtgattcagattgagtcctgaggcatttacttttgggtaaaggagagttgagcctgaattaggaatgtgtacattgtaggaatcctggttgtggggaccaggtctgtgggcctcaggtctggccagccagggctggtgctgtccccgcctacctccacttcctttcccttgctcactctggatccagtgacagcaggtgtcatgggtcaagcataaatcatatatagcattttcaggcatgttcctggtagttcttttgagtctgacattctaataaaataatttgtagaaaccatttgtctttgtagtgattccaaattaaaagttttctttctccaacctgagggcacggccaaaaagatctggttattttttagccaggaacgtgcttgttaatgagtatgtctggaggacagacctgctcattaggtgtgctgtcccctgtagcctcgtgagtcagcccagaggagggtacatgcgactgtggcctggcc

SEQ ID NO: 95300 - DNA, 1680 bp, Homo sapiens
atccacccacctcagcctcccaaagtgctgggattacaggtgtgagttatagtgcctggcccaacgcttaataactttttcctgaaatgcagattagtttgaaatgaattttatttacgggttcatttttaatgtttgaacctgcttctaggtagggttaaagttgggtgacttgatgactcacgaaatacacaactatgaagtttggaaagtgtggtggtatgcacctgtagtcccacctgctctggaggctaaagtgagaggatcacttgagcctaggaggtaaaggctgcagtgagccgtggctgtgccactgcactccagtatggacagcagagcaagaccctgtatcaaaaaacaaataaaaacaataataattttttttaattaaaggagaaaagtttgggaagtttgacttacatatttgatcctcgaatagggagttattttggttttggcattagatagttttgtagcttggttcatggcacttgagcagcaaattcatggcccttacactgaatactaaaatgttatacaggccagccagtgaagctagttgtaagtgcagagattcataaacagagtcgtcccgtgatttgtccgtgtctccccgtattaacattttactcttacttggcgaagggagttgggcttcctgagcatggtctccgtgttgaggtggcttttccttctttccctgcttctgtcaccagctatgtggattaccccatctatgacgtgcttcagatggtgggccacgccaaccgccctttgcaggacgatgaggggcgctgtgtcatcatgtgtcagggctccaagaaggtcagtcctagactcatggagcctcttggatccgtagcctcagaatggattctttaatctttcttttgatagatgtcttcagtaactttagtctcttaacttctgcctctcttatttacacaattcttttgtgacgagcctgccacccacatggaattttgctgccttttgcttttgctgctgccgttggctccacgtgttgaggtcttcaccctctacttggttctctccttcctccttgggctgctcactgctctgccctcgtgacttgctgtacctctgttcccactgcgtattgtcaccagtgatgcactttctaaatgtgtggcttcttccattttggtattagttaggtctcacacagggaccatgccctgttgatttgcccttggccctctgtgaccgtgttgtcactaattctttattactccttctccctctccaacccacaggatttcttcaagaagttcttatatgagccattgccagtagaatctcacctggaccactgtatgcatgaccacttcaatgctgagatcgtcaccaagaccattgagaacaagcaggatgctgtggactacctcacctggacctttctgtaccgccgcatgacacagaaccccaattactacaacctgcagggtcagtgggcttgggagcacacgtgatcctttggtggttctcacagtctttgctgggcatcttcttgaggctccccactcacctctcgcctccataggcatctcccatcgtcacttgtcggaccacttgtcagagctggtggagcagaccctgagtgacctggagcagtccaagtgcatcagcatcgaggacgagatggacgtggcgcctctg

SEQ ID NO: 95301 - DNA, 1573 bp, Homo sapiens
aaccagatctcgtgagaactcattcactagacagtaccaagggtgggtggtgctaaaccattcatgagaactctgcctccattagccagtcatctcccaccaggcccttcctccaacactggagactacaggtcgacgagatttggtggagacacagatccaaaccgtctcaccaagatagttagactttagagattagcacagaggagagctctgattctcccttgagctcactcttgctggccactgtctcttgttgccctgtggcattttgtgcaaagatttacgttttaatactgtttattggagcctcattggagattcttctgccagaatcacttcctgtcactctttggcccttgaatctgcctgtttggggcatgcttagagtgatctctgttttgctggcatggctgagccagcccgtggctgcatgagtgttagcactttctggtcagaggagcagtccatcagctgtagttttgccttggtgttcctgggctttgggttctgttctatgatgacttgttttctcctggatagtcccagagcaaggcaccagcagcgtggagctacctcatagcaatgtgttagctctcattcatgttagaccttgttcctagccagccttgctgtgagttctgaaacatagcacagggtaagccacggcctgcccatgaggcagtgagcctacttcacccggagacccctgccctcagccttcctctcccctctactgctcaggggctatccaggtggtggtggcttctcggagtctctgctggggcatgaacgtggctgcccacctggtaatcatcatggatacccagtactacaatggcaagatccacgcgtgagtacaactggtgctctgtgttagcacagacctccttcctaaaatgaatgtgaatctgcagatacacagaaagtaagctaggatgaagaaaaggtgttagggaagttaacagctgagatgccaccagagccaagtgtttgagagttttgtgtctcaatacctaggctcacatttgctttttagtcattgtgcttccttattcagcagctgggagaggtaggaaattagagccaggaggaatgtttgacgttacgtcattaatctcagacatcttgtagattaggaaaagtgacttggtcgaggtcatacacctatatagtgacaagtaagaagctagaggagtgccgagcgcagtggctcatgcctgtaatcccagcactttgggaggctgaggcgggcggatcacttgaggtcaggagttcaagaccagtgtggctaacatagtgaaacccccgtctctactaaaaataacaaaaattagctgagtgtggtggcaggcgcctgtaatcccagctacttgggaagctgaggcaggagaatcagttaaacctgggaggcagaggctacagtgagctgagatcccaccattgcactctagcctgggcaacagagtgagactccaactcaaaaaaaaaaaaaaaaaaaaagcctgggtgtggtggctcacacctgtaatcccagcactttgggagggcaaggtgggcagatcacctgatg

SEQ ID NO: 95302 - DNA, 2328 bp, Homo sapiens
gcgctgtgtcatgtgaatttcccaagaagcatttcatctgtgattccgtatgaaggctttctaagccctgaaatttgcagggtcatttcctcagtttgtgtattaaagaaaagctgccccagccaagcgtggtggctcacgcctgtaatcccagcactttgggaggccgaggcgggcagatctccggagatcaggagttcgagaccagcctggccaacatggtgaaaccctgtctctactaaaaatacagaaattagctgggcgtggtggtgtgcgcctgtaatcccagctacttggaaggctgaggcaggagaatcgcttgaacccgggaggcggaggttgcagtgagccaagttcgcaccactgcactccagcctgggcaacaagagcgagacttcatctcaaaagaaaaaaaaaaaagaaaaagctgccccatcgcatcgcatagaggctgctatgggattagaacgtagcttgagatctgcaggtcaacaggtctgtttggcatctcaggttttcctcacataagtgaaagatgcctggtatggcctagtgttgttctgcctccctcctctgcccgccaggtatacatggactggtacgagaagttccaggacaggctcaacaagaaggtggtactcctgacaggcgagaccagcacagacctgaagctgctgggcaaagggaacattatcatcagcacccctgagaagtgggacatactttcccggcgatggaagcagcgcaagaacgtgcagaacatcaacctcttcgtggtggatgaggtccaccttatcgggggcgagaatggggtatggcgtgaccttgcagcacagatgagggactgggactgaccaagtggccttggcattggacctaatgtttgggtctgaggacggaggctcggggcttctccccagaggattctacctgctgccctattccaaagggacaatgttaacttttttggtagtactttaggaaaacagtattgtttagtggaggttggctgccgtggaggaggtagaaccaaacacatgagagctcctagttagaaggaagaatgaggtcattttgaggctgttgggctgttcacaaaggggacctccaggcagaggatgggagccttggcctgcagtgaccctccctccctccctctttccagcctgtcttagaagtgatctgctcccgaatgcgctacatctcctcccagattgagcggcccattcgcattgtggcactcagctcttcgctctccaatgccaaggatgtggcccactggctgggctgcagtgccacctccaccttcaacttccatcccaatgtgcgtcccgtccccttggagctgcacatccaggtaggacccactctcctcatccgtctgtggggtgtcacatagatcctgagtgacccaggtctgataaccttggtgtcttttcttctccccggtcgccagggcttcaacatcagccatacacaaacccgcctgctctccatggccaagcctgtgtaccatgctatcaccaagcactcgcccaagaagcctgtcattgtctttgtgccgtctcgcaagcagacccgcctcactgccattgacatcctcaccacctgtgcagcagacatccaacggcagaggtaggtggggcctggcgtctgggggttggggttaggttaagtgaggctggcctactccaagggtgtcctctttatgagggtggggttagcccatgttgcttggggccaggttctgcacagctggcaaagtgtctgccaggaattgaactactctgagctgagccagtgcctgtaccgcacaggttcttgcactgcaccgagaaggatctgattccgtacctggagaagctaagtgacagcacgctcaaggaaacgctgctaaatggggtgggctacctgcatgaggggctcagccccatggagcgacgcctggtggagcagctcttcagctcaggtaagtcaggccacggaaggggagcatagcaagggtatcaccaagtggtggtgttaaacttgaggggtgcgggtggcagtgttttctctacagcataccagagattttcaaaatactgtttaggactcttggctgttaactcatttgatcctcccaagaacctcgtgaggcaggtgagacaaacactatccctacttgccaggtgagaaaacaggcagacacatcaggttgtgctatttcagaacctggttttctagagtccaggacctttggccaccagaccgctgattctccgtggataccagactccccaagtgtattagtccgttcttgtattgctataaagaaatacctgatac

SEQ ID NO: 95303 - DNA, 1776 bp, Homo sapiens
ccagtttgcagtatagtaggcaggctgggctgcagcctcagtactctcatttccttgtaggggagcttatccgcatgccaaagatggggaagaccatccacaaatatgtccatctgtttcccaagttggagttgtcagtgcacctgcagcctatcacacgctccaccctgaaggtggagctgaccatcacgccagacttccagtgggatgaaaaggtgaggctttgctgggcagaggtgctggattggaggtgctcagtctacgttgctgggccgaggagatggattggaggcactcagtctacgttgactcacattccttttacccttgctcctgttggcaggtgcatggttcatccgaggctttttggattctggtggaggatgtggacagcgaggtgattctgcaccatgagtattttctcctcaaggccaagtacgcccaggacgagcacctcattacattcttcgtgcctgtctttgaaccgctgccccctcagtacttcatccgagtggtgtctgaccgctggctctgtgagtgtctcctctccagagtccccaggaacagtccctccaaggacagtagaagaatgtcttgcactttgtcccgggcttgcccttgctggggacagagtgatacatatgctgcctaggtttccagtgttcatggaggggatctagaggccagtgagggaaagagagcagtgcttatatccttcctgtttcttttctggcagcttgtgagacccagctgcctgtctccttccggcacctgatcttgccggagaagtacccccctccaaccgaacttttggacctgcagcccttgcccgtgtctgctctgagaaacagtgcctttgagagtctttaccaagataaatttcctttcttcaatcccatccagacccagggtaagtgtttccatccctcctctggaggcttttgaagtcaccgggagacagatgtgctctgtggcaggcaggggagtgggggtgctcaggcacttgggaggtctgggagctcctcagtgtgaccgctgggacccaccaggactttttcctttgtcagaagcctttggttgctttgctgctctgcatgtgtcactgtggaggggcaatagagcaaggccttacatggcatggtcatttctcgggcccaggaggcttagaggcctgcccctggcgctcaagtattgaaccagaaccatggggtggcactgaagcctcctcaccacatcatgataaataacggggacattcacagagcaggcactgtttcctcagtccatggctgagtacatcaccggtgttttctctcttattcctcccatcaagcctaaaaggaatctctattggagatactgccattagtgttccttttataggtgaggaactgaggcatagagggttccccagttgaaccaactgataaatagtagaacttggattttaattcagtcttgatgccagggataaggctcttactttctaccttaggctatttctaggaaacgcaggagagtgttgaaggggcagagaaagggatccagttcctttctgtcccgcatcctagtccctgagaagcaaagaagaatgtgtggcttcttttgctttgcttttgttgtcatcccacacatctccaggggacctgggctcttgatcttggcctcttcccctttaactgttaagtgggagcaggtaagggggtacagtagggctggcctggagttagaggcttggatgccttagctcctctgtctgcactccagaactgcctg

SEQ ID NO: 95304 - DNA, 1050 bp, Homo sapiens
gaggagaagctggagctgcagaagttgctggagagggtgcctatccctgtaaaggagagcattgaggaacccagtgctaaggtgagctcctctcctctttgctttgataaggatgaggattaagtggttttcataatcttctaaaagatgaaccttgaatttgggttcatgtgtggtttcctgctcagttctcctagtttttgcagccttctcgcatgttctttttatatgaaataacaattatttagtatttgtaaatcaagacctgtagcaaatctcacctggcctggatgctcagagcagaaatgtaattccctttcttggactgttcagtgattggtctcctgctggctgattttgcttctttacagatcaacgttcttctgcaagccttcatctcacagctgaaattggagggctttgcactgatggctgacatggtgtatgtcacacaggtgagagcggagttgtatggcagctgtgagaaggggcctgaacagttcaatccctgtgtgctgtgtgcatcctggggaaaggaggcccgaccctagtgagatgggaggagtgcttagttctgctcttgccgggtagttggttggtgcatgtgtggtacagccactctgtagtatacatcttgagcacgtgggaaaggtaagaccttaagagggaatgcttcgaggctccacgggccctcagagagacaggaagagccacagcacgcagtgtctgcttcccagcagcaaagtgatttcccactgttgctgcacagctcataaataaatccaaaaatggcacagggttttattagctgctcttcatctttacctctaagaacaggtcactggtaccctcaactcttcctagaactctaaatgctaaatgactcaaaagctttaaaatcatgcagtgaatgttaggttaaaatgttgtgcagtgaccttgagccgcagcactcttctaattgttccccatccggcaagcatctactatatggaacggagaaaggcgtaaagacagaggggactttgcctttgagttagggtgggtggt

SEQ ID NO: 95305 - DNA, 1085 bp, Homo sapiens
tcttgacatagcattcttggttcgctgtctctgatctagatgctgggacgtgccggaagaccccagtatgacaccaagggtgaaggcatactcatcacatctcatggggagctacagtactacctgtccctcctcaatcaacaacttcctattgaaagccagatggtttcaaagcttcctgacatgctcaatgcagaaatcgtgctaggaaatgtccagaatgccaaggtaggggaggactgcttgttgtgcttcatgctttccccgcagacaccaaggcaccaggagtgggtcggtccctattgtgctgcgggccagcagcgtccgaggccttccatccctgcacccacatcttgggtctggcagatagttccccttgttaccaagatcttagaagacgcttagatctttttaataatgaaatgctaaaaacattcagaatacgatgtaatatgcatccttgtagttgggaattaatttctaagcaattcatgggagcctgtcatttggacatcaagagtttctccatgctaagaaccatgagctgtgtcttgtaggatgcggtgaactggctgggctatgcctacctctatatccgaatgctgcgatccccaaccctctatggcatctctcatgatgacctcaagggagatcccctgctggaccagcgccgactagatctggttcatacagctgccctgatgctggacaagaacaatctggtcaagtacgacaagaagacgggcaacttccaggtgcgtggggtgagggttttgaggcaaaggtctcagcaaaagttgttggcccaggaaaaaatttttcagattgctctcttgatgtgagtactgcctatctaatcacctgttgcttagaacagcagaaaaatgggtagcttttcccataacttgaggtggataattcagctgtcttgtccgtgcagacatcatttcactatgggtcagcttattctgctgtttttcttcatgtgcctgggcctggcacttgtactgctgtgacttcatccagttgtcctattaggacaataatgacattgggtcatatactttaccaaaaaaaaagtacaa

SEQ ID NO: 95306 - DNA, 1030 bp, Homo sapiens
caaaactcagcccagatgaaatagataacatgaagagccctacaactattagagagttggagaattaaaaatccccccagcaagcaatccccagtcccagataattgttttgtgcattcgcattatccagggtccctccataaaagatttggggtcacttacactaaaaatgcaagacaataaaaagaggaaaatgaaaaactagagggcattttactagacagtgtgatagaatttttaaattgaaagtcgagttgagcaatgttaactaacaaaaaataaggaaaagtgactggttttgtatttctttttgtctgatgaaaagaagcatatgaatttatatgaagagacagatcttttcttggcactaaatactaggaagacttcattccctacaacagtgtactagtctcagacttatttcctaaatccttttataagtagtgtaatgttttagttgttattttgcagacacattttcatgcagctttgactcttgttaggtgcttgaacataaattctgagttgagaggcccgaatttgtagttgtagtctatttaaagttgctgttcaagataggatgttgaagttggtttaatttctcagctccaggactgtgaacttggtgggtgcattcccttaaaagtctttccagccgtgtttaggcttcctctgagcctgcacacattcctgcccttgcccctctccaggaccttggcttctggtggtgatggtgcaacttctgcttcctgctgcaggtgccctggggctgtgagtatctcgtgactgtagcaaactgtggcttctccttaggtgctggtgtttgtccactcccggaaggagactggaaagacagccagggccatccgggacatgtgcctagaaaaggacactctgggtctgtttctgagggagggctcagcctccacagaagtcctgcgaacagaagctgagcagtgcaaggtgaggaggggccagctgggttctctcattcctacctggcagctgtgtccatctcaggccccagaca

SEQ ID NO: 95307 - DNA, 2004 bp, Homo sapiens
agtgcgatctcttcattccggagtcaccacctgctttcccaggcatgcctctgtatagctcttttctccttagctgatcactgtttttgagtgttgattgtgtgtgtattagagagaggctatgatccagttgattgccattgtagcagcctaaggtgagaaatagaaagtagatatatctaataagtcgtgctaagcagtcattctatgtccactggaataaggctgaccttggttccaataggctctcggtttcaccccaaagccatttctctacccattgagctaatttagggtgacttgagggagaggttctgtggtgatgcaggatcagctccagatcatggttgagttggggtcatttccacaggaaggtgatgaagacgtatacggggaggttcgagaagaggcatctgatgatgacatggaaggggacgaggctgtcgtgcgctgcaccctctcggctaatgtaagttcagtttgctcttcctcattgctacaaggttacttctgggtgttagtgcttcttccccatgcctaggtcctgttacatttattgagccactttttgctggagtgaactataataaacacttagtgtctagagtttcttaaaatttctgtcggttttcttccttcccaaagatgtatgttgatgaaatcttagtctggtgtgcttctgaactcaatattccagagttttttcctctggaaagtcctcacaagaaggtgggctatggattgtcaagtagaacttggttgcagggtggtggcaaagtgatcgaggctggcagagacctggtgagctaaatgcctggttacttttatagctcgtagcctcaggtgaactgatgagttccaagaagaaggatttgcaccctcgggatattgatgcattttggctgcagcggcagctcagtcgtttctatgatgatgccatcgtgtcgcagaagaaggcagatgaagtattggagattttgaaggtatggccaagatgacaatagttgtatatttagtgtatcttagcacatggggacagcgtatgaagtggcagatggctttggccttaatggtggtgttacctgctctctgcagacggccagtgatgatcgggaatgtgaaaatcagctggttctgctgcttggtttcaacacctttgatttcattaaagtgttgcggcagcacaggatgatgagtgagtatatggtggggtcttcctgcagagtgagtacatatgtgtgcatgtgtgacatagagattctgttgttttcacagcctaagtgcttgtttcttttatttttcttctttctaccctgaggatggttttttgccttatttcctcctcctcacttcctttgttccttttgttgtgggtagttttatactgtaccttgctggccagtgcacaaagtgaagctgaaaaggaaaggattatgggaaagatggaagctgacccagagctatccaagttcctctaccagcttcatgaaaccgagaaggaggatctgatccgagtaaggactgggttggtttatctgtctgatttctgagctaacggtggctagaagattgcagcatgaagctaaattcatgttaaaagtggaagttgaaaaagtaatttcctaaattctttggggtttatcagtgcatacaggttagaatcaacacatccacattggtttggtcatgagaccagtgacctgctgctatctttcaccagcactgtggggacctttattgtttatttacacagtaaatccatggtgtttactaaaatagagtaacagaacacatgtacttgcttaatggaacccacccttcgacccctcaggggtagcccttggtacttaattatagaacgtgtatttgtggcatccttgtactgcgcattgcccctttaaaagtgtttgtttgctttgatcattctggtggtccccatgtaaagcactgtctttctgtttcacgacttactagtcagcacctgtgactcaagtattagctaag

SEQ ID NO: 95308 - DNA, 1057 bp, Homo sapiens
tagaatccatgttcctaaccattacacatgtgtgattagattggggaccattatgagtctgaggagctctgttgaggtgggtgctagaggaagtgaggacaaagaattacaaaagtgtggcaagctagaggaggtctgccaagtgactaccacctggagtgtggcaagctgttgtggaagctgtgtcctgctgcttgaggccacctagctaatctttttaaaaacagacaagtcttcctttagttgtggcatcagcattaatgagaaaggtcagagcctagtatgtggcaggttttgaagaggtgtggctcttcacatcctgccgccacatacacctggttgaagatgttttgcctgtcgtcgttctcaatattggttggttgtttcttgccaccagccacgtgatatcctttgtggggcagctgatgaagttctagctgttctaaagaatgaaaagctgcgggacaaggaaaggcgaaaggagattgacctgctgctgggtcaaacagatgataccagataccatgtgctagtgaacctgggcaaaaagatcacagactatggtggagataaggaaatccaaaatatgggtaagtgcgcgctttatgttctgatcatgttcattggttgttgttgacccctaaacatgcatcttctagcatcattcatttaaaaaccttaatgtcagtgagttcccataatctgttctgtgttttttgaagagttacaattgatggacaccagaatccctagattccagcagctgttccttactctgagacccttttattgtgtggaatatgagaaaatgtgggcagagccttgggggctcaagtggttgagcaagcagagctgggctgactccaaggctggcaggtggagaaggtcttggcaggagcagcataggtggctctctcatgttgatcatctaagtatctgtatgtgtccttagcacttagatctttcctgaggagaggtagtcggggaggacattggctccagagtgccttgttttactagccattcactgccctctttttctaatccttcattgttt

SEQ ID NO: 95309 - DNA, 1056 bp, Homo sapiens
gcaacctccacctcccgggttcaagcgattctcctgcctcagcctcctgagtagctgggattacaggcgctcgccactgtgcccggctaatttttgtatatttagtagatacagggtttctccatgttggccaggttggtcttgaactcctgacctcaggtgatccgcctgccttggcctcccaaaatgttgggattacaggcgtgaaccactgcacctggccaaagggttgtattttttaaatgagaaacatctcattgtaatgtttagtgcatctagtgagaagatgatagggaatttttctttttgtcactgtgtcccataaagaaatactcctgcaagtgattaaggccaaacggaatcatttgctgaggctcagatacctgttttcagatattaacttcttgccatgaagctgaggagaggagggtgggcttgatccagtcttcccttggggacgaaaggttctgccattcaatatcacattgcatgtccattaggcgaagaaagcgtgatgaggaccggcatgacatcaacaagatgaagggttatactctgctgtcggagggcattgatgagatggtgggcatcatctacaagcccaaaactaaagagactcgggagacctatgaggtgctactcagcttcatccaggctgctcttggggaccaggtgagtgtgatattgtgaaatatatattaggtctttatttcattttctggcatacagcttctaagatccttggaatcttcgaagtgctaagtatctttttgtatgctgatgagttgactgatggctggcagcacttaggtagttcagaatggaggctggtcatttaatcaatcatgcctacataatgaagcctccataaaaaccccaaaaggactaggtttagagagtttgtggatagctgcacacatggaggtttctggagggtggtgcgcctgagagggcctggtagcgccacacccattcccacatgcctgccctgtgtacctcttccatctgttgtcttttggtaggcatcttttgtaatatgccttatagtaaaaataa

SEQ ID NO: 95310 - DNA, 1693 bp, Homo sapiens
gaagagaaacccaaagcaaggcgccaatcattaaaacacacaaacacagacacacgcgcaagtcaccttgctcgctgggtactttagttacctcaaacggaaatggggttttcggcccctcttttcctgcctacctcatgggactgttgccaaagaggaaggaaccggaaggaaaggtcttgggacaggacaggggctaagcagccgtgcattcgttatgatgtgaggggtgccgggggctggagactgaggtcggggagagcacgggccctgggtccttagtgccagcgggcggccagaaccagagtgcgggggtctagggattcggggacccagacgcaccaggcccacatatcccgctcagaagggtgcggaaagccgcgcgcacacggcagggacacgccccagacacgccccgccccgcacttctggggcgcgacccggaagcggaagggaacccgtttcttttccttccccagtgcgtctttcctgcgtcgttccggcgcggcgggagcagagatctgcggccgtttgcagcttgcggtagggaggcgtggtggtctgaagcctccgagcagccgcggccatggcggatgtaaccgcccgtagtctgcaatacgagtacaaggcggtgcgtttggtcttggggaaggattccaggctcaggagtccaatggggagggggaggctgaaaaagggagtttcagtctgaaggcctacaggagagccacgaaaacgaaggggaaatggaatcggggtgaaggtgggggttatacgatgacgtgaataacctactggggtctggggagcgctaagatctctctaggaggagtttctcgagtaccttcaacgctaagccctcccccttccacacgtcactcccaacccactcactacttttcacaggtgtgggttatgatgggcgctgttaggaacaagaattgtttagctgattcgacagcgcataagacttattcagctgtacgcttctgcacagcgttatactatgcaattcttaaggaaaatatatttttattacgattagtgatgataagcaactagttactacgattttttccatcagctggggtaactatgatagtaggaattggccctgctcatgtcaaagcttcaataatgttttgatcttttcagaactcgaatcttgtgctccaagctgaccgttctctcattgaccggacccgccgggatgaacccacaggagaggtgctgtcccttgttgggaagctggagggcacccgtatgggagacaaggctcaacggaccaaaccgcagatgcaggaggaaagaagagccaagtgagtgccaaggggatactattttttccttcagatccaaagtctcttccctttaacattcgagcagcatttttgctggaatgcttggtgtaagatcagtggcattaaaacaattcagtgaaggtaaaaacagaccaggagagtttaaagattttttggccttaacaagtgcatctcaagtggaaaataacttgttggtacctttttcttacatgtgtgtttctggtccatagacagatcttaattttcttcagggtattttcaagacccttgctattcctatgtcccagtaattcgttttccttttttcccattactaacttcctacccctactttttccatttactcttgtccacgttctacctattttgtt

SEQ ID NO: 95311 - DNA, 1041 bp, Homo sapiens
gtcaagcttgaggaatttcctgctctttggggttgaatcccttggcacagagtttcctgagaaattgtcatgtgtagagctttcctctgtgtatttttagcatggccccctttagcctacttactacaatttccaaaataaatgatctccatggaaaactgttttctgcaaacatgtagttaatgggtacagaatcctgtttcatgttttacaaaatgtgcctgacaacaatgcagcttcctcctgtgctgcacaatataaacttccccctcactgtactatcgtgagagtcttggcccaggcaggcaggggatgggaaagggaagggtggctcaggggaaggaggaggctggaaactgaaatttaagggtgagaaggctgtccctccagtggtgatttggggtggttataggaatgagaattacagaaccctcttttgtccctccagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccagtaaggctctcagagtccgaaagtgtttctataggagttttccattggttcttttttctttttcttttttttctaattaaaaaatttttctttctttttttttccccccccaaaaatagagacgggcatctcactgcattgcccaggctggtcttgaactcttggggctcaagcaatcctcctgctttggcctcccaaggtgccaggatttcaggtgtgagccaccatgcctgggcactatcagttcttaacagatttcctgctggggtgattgaatttgatgtctgattggctgggctggtgtgctgtgtcatacacatcagctgagcttttcagctgagcctttctgactcagaggaatcacacctggctttgaatgtcggctta

SEQ ID NO: 95312 - DNA, 1039 bp, Homo sapiens
gattgtgttctgcacccagggctgaaaaccactgtactctactgagaggtcttcggaggcctctggatgaaggtggggtggggcaatgctgagtgataaataccagtgttgtgtagatgcctcacgttattggtctctgcatggcagcacattgacaactgcaagcgtaaaaggtggagctctttgtgcacatgcattggtaaggactggtctgcaaaagtgcttgatgtctaagagtgagctccctctctgtgcagcagcaacagcagcccaagaacacttggagccaagtgttctctggccgacccttctgtagtaccagcatgcttacataaggcagttactgtggttaatgacctagtcggaggtcaaagcccagaacacagcctacttcacgcatgcgagaatgaaacattcggctgcatgctgcctgatgtgctgagccagctgggaggagaccttatcttgccagtgttaggacagtggattgaaccatggctaaattgaaggagggaccctgtgatattatggggaggggatagaagaaatacagagttttcctggagggactggagatgtttgaagtgggcagccttgaaaaatggatagactattttggactataggtggattcatttagttgttgagtggtgaaattgggactggtaggatgcctgcgacatagcattgtatgttgaaagaattattgaattactacagttcaaaaatcctgcagagcctctgtccagctccatcaccagaattgggaatgggagccactcttcctaatggaagaatatccatcagaatggagtggggatgctgttgaaacttcttccttctacctctggagttcacagcacagtgcatttgttacttaataacatgctaggtatcagattctgttacagcactaggccatacagactagaaatgtgatttttttattgtgtattttatttttttaaattaggttttaattacacaataaatgcacaaatgtagtctcctgtttttgttttttaaaattctgtatgta

SEQ ID NO: 95313 - DNA, 1324 bp, Homo sapiens
ctctccttgttgccatgtagggaacagtggtttccattcaggaatgagacaggctgttaattaaggtaatgggttttcctttttttttttaaagacagggtctcaggctggagtgcagtggtatgagtatggctcagtgcagcctcaacccctgggctcaaatgatcctcctgcctcagcctcctgagtagctgagaccacaggcacacagcaccatgccatctttttttgtagagatggggtctcactgtgttgcccaacgctagtctcaaaattcctaggctcaagcagttctcccacctcagcctctcaaaatgctgggattacaggtgtgagtcaccgtgcctggctggtaatgggttttctgtcaaaattgttcaagtgcaacaaggtgactttcagaaagctggagggtagattttccaacttttgtttttagtgaaggaaccctttttcaggtaaaactgtgcagaaggcctaattgccagtcacacagaaatagagctgctctggtttatttgggattggtagagatgctgagccctgctactccaggtttgcactgtatagtggaaaagtctgttagacttagatgacttgtgagggcccttctgactctaaaattgtataattctaggaggagattgggcataggaattaagatttacttctctaacctagttcagtagcttttaacaaaatagctttctgcatttattctttcctttagttacttaagatggcccagggccatagggtagagactgagcattatgaagaaattgaagactatgattacaacaaccctaacgacacctccaacttttgccctggattacaggtaaaggggggaaaggggctctgtcctctcttctaagccagggagtcgtttttctctgcttctcatgtccccattttatatggtgggagactgttggcaattttgaatccagtggaggttttctgggtaaagggtctgccttccacccagtgcagggagctgagcagagtcaaggaaacagcctcaccttggcctgccttacctcacatcctacatgcaggaagcaaatggccacactcaagtgaatgcgtcgacatgtggatgggtgtttagcctctgctacaaagtactaatcttggctgttgtgggatttcaaaggaatataaacactttgtcctcttatgagctaatattttggccaggtagacaaccagatcacaccatatgtgatctggtgtggcaaaaaataagtcttcggggtgtatctcagatgaccagatttctagctgtgaatgcagttctcatattgcaagcttgctgtga

SEQ ID NO: 95314 - DNA, 1050 bp, Homo sapiens
ggagagtcatttgaacccaggaggcagaggttgcagtaagctgagatcatgctattgcacttcagcctgggcaacaggtcgagactccgtctcaaaaaaaaaaaaaaaaaaaaaaaagagtttgagaccgcgtggccaaaatggtgaaataccatctctactaaaaatacaaaaattagccaggtgcctgtaatcccagctccatgggaggctgaggctggagaatcgcttgaacccaggaggcggaggttgcagtgagctgagattgcaccattgccatccagcctgggtgacaagagtgaaactctgtctcaaaacaaacaaacaaacaaacaaaacaagagagctctgtagctccttggttgaaactggattccttctttagttgaactccagacctttgtttttacagtgaattatggtaaaagtttctttattctgcttagttttactttgtcatatacctatttcaggtaaataaaattgaaattcactatgccaagactgccaaaaagatggacatgaagaaactgaagcagagcatgtggagtctgctgacagcgctctccggaaaggaggcagatgcagaggtcagatgctcttgcctgttctctaggtgcccagcatgcgggaggggagtggttgatgtctacagctgaagacacctcgatttgggcaatgcctccaatacagaaatgttcgttcaaaaatacaaggagctgggcatggtggctcacacgtgtaatcccagcattttgggaggctgaagtggaaggatcacttgagcccaggagtttgaggttacagtgagctatgatatgatcgtaccactacactccagtctgggcaacagagagagatcctgtatcttgaaaaagaaaacaaaaataaaaggaagacttcatgcttctaagagagaagtgaaccaagtatacaagtaggcaggtcacacagactgtgatacaaatagcaaactagtgtgtaagacgtgattcagccttgctggtaatcaaaaaagacaaatgaaacaatcttgatgctactttaaaa

SEQ ID NO: 95315 - DNA, 1606 bp, Homo sapiens
ctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaacatttggattgcttcagcttcttttcagttgacttctcatatgtattctggaaaccacccaatgaagtgggcaccaaaggtagagctaagatattgtaaggccagtgatcatcacctcaccaatgccaggtggtatgagggggtactgtaatttccttttttttttttcgagatggagtctcgcattgttatttgggctggagtgcaatggcgcgatcttggctaactgcaacttccgcctcctgtgttcaagcaattctcctgcctcagcctcccaagtagctgagattacaggcgcccgacaccacgcccagctaattttttgtgtttttagtagagacagggttccactatgttggccaagctggtctcaaactcctgaccttgtgat

SEQ ID NO: 95316 - DNA, 1045 bp, Homo sapiens
agtcctcctgcctggcctcccaaagtgttgggattataggcatgagccacctcgcctggccttccctcctttactacattctcagagacctcttaggagtttcccaagggggaaatttagaaaagtggggaaagcgttggtaaaaaaggccaccctctctacttgcttccttattcttaagctgcagggctcaacattgatggcatccccccacacctacatgtctaaggcctcaaaatcagaagtcacggaaatcttcccttctgttctgttgcccttaaaaactcacctatttccttttttctgcattccttttctgtcttcatgtgtaataatatgaggtgacctttgttgttgagcacagattaaactcaggagctttatgtggattatttcatttaatccttacggtgaccctggaaagtagatgctgtcatctacctcttacaggcgaggaaaaggaggctcagagaacataggcacttgccttaaaaagtggaaagttgagtctctcactctagagtccatgttctgttaaccacttggcagctagaacatgtgtccttgtgtatccaacttctttcctattgagaattaattctttaaaataaattctcaggagttgggataattgggatagagggtctgaatatgatgataacctgtcaaagctttgacccttcttcactacctctcctgccacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatatag

SEQ ID NO: 95317 - DNA, 1092 bp, Homo sapiens
ggccaggcatggtgactcacacctgtaatcccaacactttgggaggccgaggtgggtggatcacctgaggtcaggagtttgagaccagcctggccaatatggtgaaaccccgtttctactaaaaatacaaaaaattagccgggtgtggtggtgggcacctgtaatcccagctgcttggtaggctgaggcaggagaatcgcttgaacccaggaggtggaggttgcagtgagctgagattgtgccattgcgctccagcctgggcaacgagagcgaaactccgtctcaaaaaaaaataaaataaaataaacccttttcctttaagagaacctttcttattgctttgaggctacttccttactgctttgattgtgtgaggcgaagtgaaagttggatatttataattcttttggcttaaaaagttcttccctggaaagaaaggaacaaacttggatttctcaaaatggtctaaaatgtatgactgatggtttgcagcaggtgcagagcaagtccggggcagtgtctggcacagtacctttcctgtgtggcatccattgcgtgtgtgcctagttggggagagcttcctgccttctctctgaggacgggtgtccaagggcaagcaccactggtgttttagttggtggtgagggtggatggatgtggctgctctcgggatagtgcaagtgattgagtctctactgattcctgctatgtcctctcttaggggccacatcagccagcagcctcctccaaggcctcagcttcagcttgcaggatatcagcagcaagacctctggccttccagcaaatccctccccaggaccagccccacaggtgcacatctgccatctgctgggctgggcaggtgtagggaggaggcctcctcagcttagttggttttggcagggaaactaggtctggagtcagtggatcaaggacaaacagccttctagctacatagcagggaacttacaaaagttaaggtctatcatttactgtgtgaccttgggcaagtttcttgaccactctgtttttgtttctttgtctataaaatgaggtaataatagtacctccctcatagagttgttataagaa

SEQ ID NO: 95318 - DNA, 1379 bp, Homo sapiens
cctggggactaggttgtgacatgggccagtgttgccctgttacttttgggtgggagccgtgaggttgcctggttgaggtactctctctcctagtagctactcatagccagcttttagtcctggtgacactcctcttcattgcctccatttggcaagtggatcctcaactgtgggctcttagggcagggtgggactcttgagagcctttggaaaactctactttttagagaggactggatgacctgctcctccatgagttctcatagaatgtttgatgtctccaactgtgtgatgatgtggggagggcttcagacaggaagatgatcacattttttgagtctgagaaggactgtttactcattctgttgaatcctctatttttgttgttgttgccattggccttggctaggcagggtcaggatgtcttctgtcttttaattcctaccaactcagggccccttctcttccgattccagtgcaggatgagggatgagaagggtgccatcctctaagaagggcaaagtggggtcccccacggacagggcctgagtgaagtggtcctgaagcatgggcagtctcctttgaggggtggccctgtacgtagagtggttatcctgtgtgttctacattctacacatggctgtgttggtgctggtattgactgagtgtctgttgggattttttggattgtggaggatctcaactcagctccatgtcttagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaaggtgagtttctcttggtacgttaaatgagaactgagctctctcaggtacacagcattgccctttggtggccattcaccagcatgtcagcctttgctttattttgagagatgcccggagcaaagaagacatgagtctgtacatgtgggtaaagttggcatgagtccatctgaatgaggaccaggcaggcagaatatgagaggaagctgtgccatcgttcaaagcatcctatattttgttctttttttgttggcttcaattaaaggtacagaatatttcaggaagtttagaaaatagaaggaaaaaataaccccaactctccctactctagcatagttcatcttttttcattttccagttttcgtccgtaatatcttgcatttagcctaagctgtggaacctggaaacatagaggccaaataggactgaccaggggccttggggttttctgttttgaagctgcaggtgg

SEQ ID NO: 95319 - DNA, 1050 bp, Homo sapiens
ttggttggctcctctctacactaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggtagtgtgagcagggagggagcgcttttgctggggaatcagcaccacagagttggttccttaatttcctggggatgcctctgtcttattagtgccatgggcctgtgagttcctacaaggggaattccagagggacatgctgactcatggtcagatcctagtaacattgtctcatctcttgaccttctcaccttactcaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaaggtataggcacttggccagtggctcctcttgggtctgtcttctgtagttcatgtcacatggcagttgcacagtattgatatctatggcttttttcagggggatgtgagaggcgccctttctcacatttctgtgcaggcaaaattcaaaattaattattgaaatgaatgccaaggcctctgagttagtggggctttgtgatcactagttatagctttgtcttgctgttctggggaggctaggctttatgaacatgtatattggcctaaacttttttctaccttgccagccactcctccagtcggggctctccaatcatatgtattgggtgattgattttattaatcagattctagggtaactcacctggcatcatgccctttctttgtttgacccttgaagcgttaagattctcacactgagactttcagtgaagtttatcagggttctctgcatacaggtttcagatgaa

SEQ ID NO: 95320 - DNA, 2432 bp, Homo sapiens
taaataaataaattcttgtaaatattcgaaaataatctttaatatccaattaggtagatagttgactaaactactcccttacatatgcacatatatattaaattgtttttactttattattattcatagttaatttgtctctgtgcataattgtccccatccttttgtgtgtgtttttgtttctgatacgttttctttggaaaggttctcagaagtagaaacatttggaaaagggatgggaatacatttaagtcccttgctgcatatccagactgctttccaaaggattgtacacattcacttttcatggtgggagcatacttttcacccgcttatttatatatattcttgatccttaggaggttttcagaggcttagttgaagtctgtctatggcttatagtggggctctgttcttctgcttgattgctggtggtggaaggtctcctgctttacactggagtcatctttgctctttcttctttgtagatcccaaccttgattgaccggatgcttgtgtcatccaacacaaagactggggctgcaggagctgaggccttgtctctcctactgaagaggccctgggaccctgctgtgggtgtgctttctcataacaaaccagtaagttggatggctcaggacttaacaatggtacataaaaattttagactcaagccttagaaccttggcaggaggataaatggcttctttaactatttattattattattattttttgagacagaatcttgctctgttacccaggctagagtgcagtggcacgatctcagcttactgcaacctccacctcctgggttcaggcaattctcctgcctcagactcctgaggagctgagattacaggcatgcaccaccatgcccagctaattttcagtagtgacaggatttcaccatgttggccaggctggtctcaaactcctaatctcaggtgatccacttgccttggcctcccaaagtgctgggattgcaggtgtgagccagcatgactggccagcttctttaactattattaataatttattttacatagtgcttaacataatttcacaagcaaaggagcattggttgggatgagaaaggtattgggatacttggaatttcatgaaaggacacttctcactcactggtttttgggtgggattcttcctctttagagcaaactccctggctctccgctgattctcatcgcctcctctggtccctccagctctgtgtttcccacttcacgccgccaccgcttctggcaatctcagctgtcctgcttgggcaaggtatgtgtgggggcaagaggaactccttcctggcagggaatatagtcttggaggattgaggagaagaatatgtgggaggaggtcaaaatgggtaacttgaatgtggagcctcctctaacccttctttcatgtggagcctcctctaatccttctttcatgtggaattccaaggttttgggtttaggttaggttaaacagaattgaaagatttgaaacttacctctgctggtgtgggggctacttctttccttcaggtcatccctgtagccacccatctgctgaacaatggcagtggggtaggagttctacagtgtctcgagcatatgattggggcagtgagaagcaaagtgctggaggtgagaatgcccgtatttcagtacattgtggcatacccagcattctggggttgttctgcacctatctttggcctcctgtcttactgtcttctttctcttcccatgaagattcacagccatttcccacacaaacccattatcttgattggctggaacacaggagctttggtggcctgtcatgtaagtaatttctatcttatttggaggttgtcctgggatggaataccactaatcatagctaccattgagtcctttactgtgtgtcaggctctgcgctagatactttacctatataattacattttaaactgtagaagacaaattttattaaaacaatttttaatttattttggaaaactttaagcagaaacaaaagcaggtgtagtataataaacccccggatcctcacccagctttaccagtgatcaactcttggctgggcttgtttcatctcaccctgctcattttctttctcccctagattgttttgaagaaaatcccaaatataatagcattttcacatacacacacacacacacacacacacacacacacacatatgggtatatatctgtggaaaaaaaaaaaagatccctttttttctctaaacataagtaccatactgttctcccacctaaaaaacaacagtaattgtagctggcaaatattaatagctctggaatttgatgctgtgttcatttcagtctttttccaagacatcaaggaatcttttcgtattttacatatatttgtatgtctgtcagtttgtgtaagtgtccctcatgt

SEQ ID NO: 95321 - DNA, 1041 bp, Homo sapiens
aggcctctcaaaaataaatttgctaattgtgtggcatatagaaaaaatacaaaaaatatatatggaaaagagagattagtgtggggtagaatattgaggagtggaagaatagcctctttattggttatatttctgctatatttttgttcttaagcctagtttaaatagaattcttacctcagtctgagattttagtacattaaaatgcttgctgatcctgtctgcctttttgtgtgaaatataaaacttatgaaattcaaatatgtcgtctgttcagtggtgctgtgcgtttatttatgattggaataattttagctactaagtaagtaattagctttgctagcctgaaagacttttttcatgactagtcttgacttgtactgtgtatattattgtgtgtatgtgtgtattattaatacaagtgtgtgctgtgacgatttgatttggtaggattgagaccagaagaatctaggtcttgtgttttaggtcagtggtcttagactaagctacttcgttttactgttccctagcagagacataaaactatggcataatcttctttatatggtgtacatacatggggagcgtccccagggtttgactataattcctcagagtttcccttataggactggctggacaatggcccagaacaagctattcaacaagatcctcaaagccctgcagtctgaccggcttgcccgcttggccaacgaaggggtaagacaccagcaatccgcccacagtgggctcttcgtagttcaggcctcactggctgactgacttgtccccctgcttgttaaccaggtagtcctcatgttttattacttccacttacatccttcaggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaaggtaaggct

SEQ ID NO: 95322 - DNA, 1246 bp, Homo sapiens
aagtgatcctcctgcttcagcctcccaagtgctgggattacaggtgtgaatcactgtgtctggctgtatttgtcatttatttatttatttttgagaccaggtcttgctctgtcacccaggctggagtgcagtgatgcaatcatggctcactgcagccttgacttcccgggttccagcagtcctcccaccttagcctccttagtagctgggatcacaggtgtgtgccacatgcccagctaatttttgtatttttggtagagacagggtttcctcatgttgcccaggctggtcttgaactcctgagttcaagcaatccacctgcctcggcttcccaaagtggtggtattacaggtgtgagccagtgcacctggcccatatttatcttaaaaaaaaaatagatgtttatcattttttatatagactcattgaaaaaatgactttgtgttcttccagtacataccatcatgtctgagagggcagagatctagacaagtgtgggaaagatgactttggatcaaaattttcttgtgaatataatgtgcttatgcgtaatttaaagctgactgtattaaagatacattttttgtcaaccagatgattgttaaatacctgtgaagtatgtgtggcccggtcctatttcctcacctgtttacagtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggtaggctgctcatcaggaggatgatcactgccctgtaattattttgtatcatcttcattgaaataacacttattaggaccttatttcatttgcagcaacacaagtcagagtgttctccaaagtctcacattataactctcagttcaccatgctgtgtgtgagctccttgagagtagggcttacatctcagccatctttgcatacttcacactaggacgttgtctggcacacagtaggcatataatgtttgttgaataaataagtgaattaaatttgatacatatgactagctctgtagtagcttctgttgtataagttatgatataggggttacccaaactgcaaaaaaatgaaatgtacatttgtaagatattgtgtttaaatggtttataactaggatgatggaagttgtgaagtcac

SEQ ID NO: 95323 - DNA, 1568 bp, Homo sapiens
aaagggcttccacggggatcattttgtcacaggctttgttgggggggcagttttcatttttatgtaaacaactctggaatattacgaagtacttaacagaacttttgtttcgcacaatacgagaggcttgaagaagtggagccctagctgggattcgcttttttgaggccggcgttgccctgccctttaggggtgcccacgctctagctgcggccccggctcccttcgcattgtcgttagaggatggtgtgaagcaacagagatccttagctttcaacgaattcatatttgtgatttcctgtttgtcaaaacccttcctgcccacctaggaagtggtgctggccaagcaagtttactgtctgtccacgcgaggtctttctgaaccttggggtcggtgagctctcccgttaggtaatttcagttcgctagaggttgagtatgggacaactcgtggcaccatagttttttttttctttttttttggtgttggtgtgggattccacgaaccgtccccaccagaggtctgccgtgaaatggatactcaataggaatgatagtaggttacaaaagtaagcatgttagatggtgtagattgggagaaatttaggatattggaattgacctaaactgaaacttttcactgcaggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatgtgagttggggcttctaagggctgctggtaacctcactgggcagtgatcagatgggaatttagagaggattttctcaggattgactgggggagattgtatgaggcatttggatgttaaattcaggcatctcttaagcagcataaggatagcaggcttgaatgtggctatctctgtgagacagctaacaagagttaggaaagcaagacgtgcaaatgaaaagcagacaacctattccacttagatagtaggacgtgtggaaaggggaaaatcgtagagggttatttaactggtgaagaaaaagactgaaaagttgattttaaaagattacccacaggatacgactcttttatcacattagtccagtgctctgggttgcttgacagtggcaacaatagcctttttatagtaatgcattttgcttttcttggtttcacacacgaaggttaggagccaattcccaagacgttgctttttctcttcccttgttacagagctgctatccataggttaatctaaacccttcttatgtctaatgatattttcacccagcctatgttatagggtaaggaagtttcataaattgactacctgatgagtgatacagttacatttggtctaaataaacctgtttgccagttcttttgcactttaaggca

SEQ ID NO: 95324 - DNA, 1031 bp, Homo sapiens
ccactccccaggttgatggttctgtgggcagatgcctcagatcctactcctctaccattctaggccttcacctcctgggaccccactggggcctgcaggggtcccgggctgccctgttggtgatgggtgaggcccctgcaagtcagagccttgctcacttcacgtgctgttgatgaactaggagaaagctcggaataaacctgcatcagggagagggggaccaggccccggaggtcacttagtcgccccctttgtctccacacgtgtatggagcatcaacaagagaccagagctggcagtgtccgagattgctttaatctctgcctcctccagcagactatctcctagccctcagtttcggtcaggaattttttcttcctcttcagtgcagggctactgcagctacaccctcccttctcacgccaaatcccctgcagggaggccatctcttccctacgaggccaccctacccccacccccgcgtgcctgccctggccttgggctgccgctcaccactcaccatctcggcgtacaccgctgtgtcaccctggcggagcagctgcaggtccttgctgtctgtgacattgccaagccacatgcagacccggaggtgagctgggagcacatccttctgtccttcaccctctgggtactgagccagaggccgatcggtcccacaggggcactaaacaccctgaacgccaccccggccaccccccaagtgggctgtacctgccccttcccccctgagccctgggagcggggccctcactgagctgagtgctggagctgtaagtgaatggcatggagttctgttctgccctccagagtggggtggctccaccctgggagccatgaagcagagagggtgggagtgcctcacagagggagtagcagggatgttgacaatgggactgatggacattccttgtgtgcttgttatgggctggcactgtgccagttgcccagtgtgcatcatagtcctggatcctcacaccccaccatgagagggcatggtgattgccaggccc

SEQ ID NO: 95325 - DNA, 1070 bp, Homo sapiens
tcctctcgtggactatgtcctgggtggacaggcatctctgtctcctgatctagctcctcctgtaggagccaggagtggcccctccagtctcatacctggtcgatgcctggctggctgtggctgtacagtgtgcgggtctccacgtgctcaggtaccagcccctgggtgtgcaggaggtacagtgcaaggcgttccttcttgggtcccaaaccatgaacagtaggggttttgggctctggattggagggggatggaaggaggggattgcgaggtcattagccttcctatctcctaggtaggctcttaccctcccgaccgcagcctgggtaggagtgaaggggaaagggatgggctgctctttggctccagggagctctttccttgtcctcccctttctcccccaagtctgcagctcttccattctggagcctcacagcttccagaggcctgtgtctgtgctttctgctagtgttctgcgctgctcaccaaagctttgcagcttgaactttttcccattatagaaaacagcatcttcctcaggactgaacagaggcggaggtagccctttccgcttggcatagcgttctaggaggtagcttgggggcatctgatcccgccatctaaagggccctgacctgtgggggatgtgagaggaagaggtctggaggtttgggtcctgaagaacactgctgtgagctgcaggttgaccacgggtggaagcttgggtggagactgggcaggtctgggccctggttcccgcccaggatgcaggcttctcccaagggagctgtaggctcactcttccaccccacctgactcccttcccccagacgggcccactctcactggcagtaggatttggagagcccacaatgagctccaaagccagataggagtcggttttcaaggtcgatgactgtggttcctatcttatcatcaggtgaaaataggtcgaagtcatagagctggatctctaggtccttctccaggggtatgttgcaggtgagttcaaacatcctaggggtgaggtgttggagactgcagaggatgtgggcaatgtctctgtgccc

SEQ ID NO: 95326 - DNA, 1049 bp, Homo sapiens
catgggtgagggggaggctgagtgcagacagcaggagccgggtagttttaggacctcttcccgggatcaagaaaggaaaagggatttagctaggtccctagatgtctgttagagccaggacatgtggcatagcagccctaatcagtagacactccccagctcctaccgacaagcgccatttgccaccatcgaggacctggcaaggccaccagccagtcacagtcttcttcttaaagagggagaagtgcttgtattggatgaaatagggccacttggggtcggcgtccatcatcctgatggagcactgcttggcgtgccgagccgggaggggcatgtcagacaaatccagctccaggacccctgagcccagaaaaatgacatcagcaagaaggagctccctgtcctgtggtcacaagccctgtgtcaggacctcacctaggaagtcgtcgggggagaagatgtcattgtcccagacctggatgataagtcgggctgggaacttcatggacgtggcatccaggctccatatgtaatcctggggaaatggcggaagggcgtgttaccggcctgtctcctggacgtttcccttgcacccctcagtggccctccacccagcagtgatagactatcaaggaagagggtttccacctgaggacatgtttctgatgttctgggacagattgcaagcctctggaggggtggggggaggagctccaggagcctgggtctgtttgttgtggcctgttgcccctcacgccccaggcctgttaccttctggctctggacacacgtgcgctccgccgccaggtagtccatggtaaagatgaaccgccagttgaagtcggcctccccagtcagcgagtggtagtggatgtctgtcttctgcatgtccttctccagcccgtataaccacctggggccagagtcctatcacctgtggctcatgtgcattggccccatcccccagctggagccccatgggaagggctgcccagccgacgccaggcagagctggatggagaggtgtcccattcaggactgggccgtgc

SEQ ID NO: 95327 - DNA, 1043 bp, Homo sapiens
agcatcttgcatatattctagaagatagaaacaaagaactggtagccagcccaaggggagggctgttggtagcaggaggaaagccaggcagcatggactaattagtctcctggggctggaagttctgggaaaatatcactcaggtgatttgtgggtcctgggtggagtttccactcatggtctattgtaggctttaggtttggatcctgggtgggaaggatggaagagctggcgttgctggtgtttagtgaattgatgatattgaatattttaatgggaggatacagctgaagttgaggtttgatccagctcatggccaaatagtgctagagagaacagacaacagttagcctggggtggcaagctgaagacgctgtccccagagtcatcccgagaccacctttgtccttgcccccatggctgccactcaccggagctgaatagatgaagttaaacagcataagtgctataatcgatatgaccataaaggctatgagtttgaagcgatagcgtttccagaaaatatagcagaagttttgaactggtgaccgcagccacgtgaaagaggtgttggtgcgtctgtccaggagccagggagatgtcagagaatggcagggagaaccttcaggtcaagtaatctgatgcaaagagctttcttttttaaaaaagcaactactgggccaggcacagtgtctcacgcctgtaatcccagcattttgggaggccgaggtgagtggatcacctgaggtcaggagtttgagaccagcctggccaacatggtgaaaccgcgtctctactaaaaatacaaaaattagccgggcatggtggcatgtgcctgttatcccagctactcaggaggctgaggcaggagaatcgcttgaacccaggaggcagaggttgcagtgagcagagattgtgccaccacactccagcctgggtgacagagtgagacaattatctcaaaaaaaaaaaaaaaaaaaaaaaggcaacttttgcttactccaaccctcaccccaagtctgttctttgctgattgtaactga

SEQ ID NO: 95328 - DNA, 1011 bp, Homo sapiens
agaacacacctgcgtttcactggccttcattaggtggccctagggagatggctttctgctttggatcactgttccctagcatgggtcttgggtctattggcatgtccatggccttcccaatcaagtctcttcaggccctcagtgaagtttggctaaaggttggtgtaaaaatcaagagaagcctggaagacatcatggatgccatggattagctgtgcaactgaccagctccaggtttgatcaaaccaaaagcaacatttgtcatgtggtctgaccatgtggagatgtttctggacttgctagagcctgcttagctgcatgttttgtagttacgatttttggaatcccactttgagtgctgaaagtgtaaggaagctttcttcttacaccttgggcttggatattgcccagagaagaaatttggctttttttttcttaatggacaagagacagttgctgttctcatgttccaagtctgagagcaacagaccctcatcatctgtgcctggaagagttcactgtcattgagcagcacagcctgagtgctggcctctgtcaacccttattccactgccttatttgacaaggggttacatgctgctcaccttactgccctgggattaaatcagttacaggccagagtctccttggagggcctggaactctgagtcctcctatgaacctctgtagcctaaatgaaattcttaaaatcaccgatggaaccaaacatgagcttctgactgtgttctttcttctaggagtgggtttggggaaagttcaggcctttattctgagcaggccttttttttgagcttcaagcccatcaaccgttgttttgccttctcctgggttggaaaagccctcagctcagctcagaaggaaagggggtcaccttggctaggcagaggtctctgtctcttcaggctttctttccttcccatgcacttaaacagcacaggctatagtgctctcctgcaggtgggattcaggtggaggcatcttcctcccacc

SEQ ID NO: 95329 - DNA, 1227 bp, Homo sapiens
cttgttccccatccttatttttagttgcaaaatggagaggtttcaattattttttcaaggtcactgctggttagctgtggatcagaggcttgaactaagatactgacttcaagaaacatacctctttttcaagtggcacaagtcatccttcttccatttttcttcagataatcatgatgtcatttccttgaagttgtttgaactgacagtggagagaaccccagaagaggaaaagctccatcgagatgtgttcttgccctcagtggacaatatgaagctgcctgagagtgagcacaggggcccgcgggaaatggtcccatagttggggaggagcttgcagtgctgtacccatagctcacagggcggtctctgctctgtgttcttcttctgaagggtagggagcactttcatctgcctttccccttcaagttacagatgagcagcaggagggccgctttgtttctcagttggaaagagggggtctaagctctggcttcccagaagtaggtgtcagaaactgggggccggacagcctatagtttgatccttccctattgggtgggctccctgttttctgacttgcttctctcttgcttcctcagtgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccacaaagaattaaaaactggtaacaccacaggctttctgaccatccattcgttgggttttgcatttgacccaaccctctgcctacctgaggagctttctttggaaa

SEQ ID NO: 95330 - DNA, 1316 bp, Homo sapiens
tttctaaatctgtcattctgcaatgcctccatggagcttcttccttgcctatgtgtggtaggttagaatgacaatagttatttgggaatatatgaccataaggctcagttagagggtaagtgatccctttggattagagttagtttcatagtctctcaagtggcaagattttggtcttctgggcaggagctgtttcctgagatcctggatagtaaaggatgtcttgaatttggaagaatttagccctgttgtctcctctttccccttgctatagaaatacagtaggctgggtacagacaaacttgagactgactcccagagacataagtgcggcgtgcctggacagcgtactgctatgtgttttataaagtgccttccaaaagcttcaggaccctctatgggttagagcggtcttcctaggggacccctttgagaatctgatatagtaacagaccctctcctcagaaaaatgtacaagcacccgtgcatatggttttgcctatcatcttgagggtgcaaagacttcacggatgcccttcagggaccctaaaattctgtttggggatttaagttggtttgttcatccatcacagctgggtcatagctcttctgtggctgtgtctttctgacttggtctcctgtcttctgtgccctctcttgtttttatcataacctgctggaccctctcaggcccagaagaggcgatattctccaggagtccaggtactcagttcttggctcatcatgagcatccctcattcccatgtgtccatccaacatttgttgctgtttcaagtccatgtggttgtctcaggagtccccggtctctggtctcgactgcatctccatcttgcatgttaaccatttgggacaaagggacaaatactccccaaaggagtggcatgcctcatgttaccccttcaccacctcactaccctgcctttttgcactgccttggcattgggcttgttctggaatgattagttcgccatttctaaggaagaattgctcctacaactctactggggagagagggcccctgaaatagatgggaaaatgagtggcttatgggaaaacttgcaattttctccctgttaagggagaaccttgccctcttattattattcggagaagttacgtgtggaggaggcttaagtgggctggaaagtcttttgactaaggacagtcattgtggctggctgagcccatccagcaaccccgttccatgttctgagttctaatccatttagccttatatgcttatagaattttagaattgaaaagagctatcctgaatggaaagattcccctgctca

SEQ ID NO: 95331 - DNA, 1034 bp, Homo sapiens
ccaggaggtcaaggctgtagtgagctatgattgccactgcactgtagcctgggcgatggagcaagactgtctcaaaaaaaaaacaaagtaggagtaattgccaggcacagtggcttacacttgtaattctagcactttaggagaccaaggtgagtggatcacttgagcccaggacctcgaggttgcaatgagccttgatcacaccactgcactccagcctgggtgacatagcaagaccctgtctcaaaaaaaaaaaaaaaaaaaaaaaagactgaaagaaattaagtatcgatatgtgctccaacatggatgacccatgaaaacactatgctaagtggaagaagccagtcacaaaagacccacacattgtatgatcccatgcatatgaaatgtccagaataggcaaatctgtagagacagaaagtagattagtggttgtctagggctggggtaatgtggggtggagatgaggagagtgactactagtgggcatgagatttttttttggggtgatgaaaatgttttaaaattggttgtggtaatcataatcttaactctgaatatactaaatgccattgaattatatactttaagtgaattgtgtggactgtgaattatatctcagtgttgtagttatttattttatttattttttttgagactgagtctcaccctgtcgcccaggttggagtgcagtggcgtgatcttggctcactgcaacgtccatctcccaggttcaagtgattctcctgcctcagcattccgagtagctgggattacaggtgcctgccaccacgcctggctaatttttgtatttttagtagagacgaggtttcaccatgttgcccaggctggtctcgaactcctgaccttgtgatttgcccgcctcagcctcccaaagcactgggattacaggcgtgagtcaccgcgcctggctgtattgtagttattttttaatgttgattaaaagatcaccagtgggcaggcacagtagctcgtgcctataatcccagcactttgggaagccaaggcag

SEQ ID NO: 95332 - DNA, 1849 bp, Homo sapiens
ttccaactttggagttctgtcctgtttctgttgggaaatgttgaagataatcgggaggtttattcattttcatattaaatctctaaacagttgaatggttcaatccgtttaattttatgacatgaacacatagcaagtcttagatttaagttttaacccttagtctagtgttacctgcatttgtgttttccaagtctgttgattgctgatgtgggcttgaggggttttgcatttcatgctcctcattgattctaatgtctttctcactttagccatgtttcctgagagactgggagttgcaggtgcacttcaaaatccatggacaaggaaagaagaatctgcatggggatggcttggcaatctggtacacaaaggatcggatgcagccaggtattgggagcctgtgttactcttgtgtgggtgtgacagcctgatttttcatgtgccctctttttgaaaaggttccttccccacagtgccagctgttttccctctcccttaatgtatgtggatgaacactggcccttctagtctctagaacgggtctgagtcctcataagcagctgaatttgactcatcctgaggcagttgcttgcttgttacttctttctgagtttccttgtgaaactacctggcctgttggctggatgaaagcactggctctcctgaacgctgacgattgggtgagctgatttcttctgaacatttacagtgaatgatctcagcactgctgagtcaagagaagagttatctattttccttgtgttagagctattattgctccatgtagatggcaggctcaacctgatttgacctgatctcttttgcaacaagaaggagaactagggaattcagttctctcttgggggcatagtctttaccaattgtttgtaaagcagaattctgtaggggcaccttagcaaccagtttggatcaggaagctgcctgagtgctaaataaggttgcagtggccttctctctttcccttgcctccaacaacaaacaattacagatatttactgggcacttgttacaggccatgcactttgctgggtacttttaaacatgtgttttctcatcttgagagaggcttgggagtcatttgaattttactttttcctccatcatagtgatatattattcctttatcaactcttagctttatttcattgttcatcatctgttctctctctctagggcctgtgtttggaaacatggacaaatttgtggggctgggagtatttgtagacacctaccccaatgaggagaagcagcaagaggtaatggcaagtgtcagagcctaggtcagctacactgacatcacagttctttgcctcaggaatgttgtacaggagggaacaaaggagatagaaagtgaggggttcttcatctgttgaactttgaaagttaatgtccttgtcagtgtttttttctaaagggactatttaggagtgcacagtcttttgggaatagctgtcttgaacaggggctttttctttagtgataatcatgttctctcttgtgcctattagatagccactaaaattgagcatgtttggttgattggtgatttggctgctagaccagcaccagagcaagctgaatttacgtaactcagcctcccctgacttttaatccatcagtgctgtgctctcttctgcaacttgcacacacttttcagcttctttttcttcttcttcttctcagacctgaagaacagttctcctcgcctatagaaaaggctataattggccaggtgtggtggctaacacctgtaagcccagcactttgggaggccgaggtgggcagatcacctgaggtcaggagttcgagaccagctttgccaaca

SEQ ID NO: 95333 - DNA, 1976 bp, Homo sapiens
ctatggttactgtaacatgcataaagtgagagttctgatgtgctttggggtccttacctgataaaggccttgtgaaagctgtagagatggtaagattcatgactgagagaagataggagattgagtgacattaaagggggaaaaagatgatggctcagctttcagaggctctgtggtggctgctttctgaatggattggtgttgaaaagtatgaactgatctacttccttcctgtaggtgtgggcacaggcagttcctcactgtggaatctgatgggcaatgccatggtgatgacccagtatatccgccttaccccagatatgcaaagtaaacagggtgccttgtggaaccgggtggtaagaatctttctccctcctgtgttggtgacccagaaaggcctaaaaagttcagcagtggcatactgatttaattttactgtctatccccctggtattctatcttctgtggatatcaaggatctttatttttgagattattctgaccttgataataaataaatcaggtatttaggaaaatgctctctatttaattatagcaaataattcatttttttttcctgaaatgtcgttaattcctgattggcccaatagtactacttcttagggtttaataataacttaactcctgcttaaccactttgtaagaagattataagaagaccagagtgcagtggcacaatcatagctcactgcagcctcaaactcctgggcttaagggctcctcctgcctcagcctcctgagtagctgagactacaggcatgtgccactgcacctggctaatttttaaaacgttttttgtagagatggggtcttgctatgttgcccaggctggtctcaaactcttggtctcaaacaatcctcctgccttggcctcccaaaggtcagggattataggtgtgagccaccggtcctggttgagagtactcttaaattgatcccaaaccttatcccagcatccccatcttgttatttcaatttgaagagtctgatataaaattttattttcatgtgaaagccactctgagctgttggtcattttatttgtccttctctggaccttttctagctgcattgtcttccttgaggtatggcgacaagaagtgaatgcagtattcctggtgtggctgcactgtgattttgtacaagtgtaagatgatgctttcttttctgtttccagggctttctaaatcttttacgaccagtttacttttgggcatgactctggcatcctttgatactttctctggaattctcttaaactaagaacttacttttttacgtggcttttctcattagttgtagataagcgaatctcagaaaagagaacgatttcttttccctgttcaggagggcaagagaaatttctacattagctatctgcacaaactggccccttaacctagatcatagtgccgagctcatttttggacagagtacagagcattgtgttttcgtagcagagataaaggacagttgaaagactgggattctcggtccagctctgtcacagtcctcctgtgagccctaggcagattatttaacttcttagttctgtttctctatctgataaatgagcttcagaatacctgttttacttgcccactggggttgtcgtgagaataaaataggacaatagacatgaaaagactgtggcaagttaaaatggttatagaaatatgtgttatgttattacacttctacaggtttgttgatggggctcttgtgggttaccggatgattatgttcaaggcttgatactctgctgctgtcttgctggctgtctgtctctacataacttgtagcagcagttctagtatagcctctagttcttccctttttcgacttctgatacctgtattcgctgttatctggctatcaccatgactatgggcttgtttctgagttatttgaataggatgcatttgtttcagcagtggttctcaaatttggctatc

SEQ ID NO: 95334 - DNA, 1104 bp, Homo sapiens
cgaacccggatggcatcatcttcgtgtccgagggcagcaccgtgaacctgaggctgtacggctacagcctgggcaacatctccagcaacctgatctccttcaccgaggtggacgatgccgagaccctccacaagtccaccagctgcctcgagctcaccaaggacctggtcgtccagcagctggtcaacgtgagccgcgggaacacgtccggcgtgctggtggtgctcaccaagttcctccggaggagcgagagcatgaagctgtatgcactgtgcacccgggcccagcccgacgggccctggctgaagtggacggacaaggactcactgctcttcatggtggaggagcctgggaggttcctgcctctctggctgcacattctcctaattacggtgctgctggtgctgtcgggcatattttctggcctcaacctcgggcttatggccctggaccccatggagctgcgcatcgtgcagaactgtggcaccgagaaggagaggcgctatgcccgcaagattgagcccatccggcgcaagggcaactaccttctctgctcgttgctcctagggaacgtgctggtcaacacctccctcacaatccttctagacaacctcatcgggtccggcctcatggcggtggcctcctccaccattggcattgtcatctttggggagatcctacctcaggccctgtgctcccgacatgggctggctgtgggtgccaacaccatccttctcaccaaattctttatgctactcaccttccccctcagttttcccattagcaagctcctggacttttttctgggccaggagattcgcactgtttacaaccgggagaagctgatggagatgttgaaggtgacggagccctataatgacctcgtgaaagaggagctcaatatgatccagggtgccctggaactacggaccaaaactgtagaggatatcatgacccagctccaggactgcttcatgatccgcagcgatgccatcctggacttcaacaccatgtcggagataatggaaagcggctatactcgcatcccggtgttcgaagacgagcagtccaatattgtagatattctctacgtcaaagacttgg

SEQ ID NO: 95335 - DNA, 1027 bp, Homo sapiens
gtaaacaacgagggtgagggtgaccccttctacgaggtcctgggcctggtcaccctggaggacgtgatcgaggagatcatcaagtcggagatcctggacgagtccgacatgtacagtgagtccagccttccacagggcccaggacccctttcctgcttggatcgaaacttggtgtccctagctggaagggccatagtgcagggacacaggaggcctagcatccagaggcccagtggctgggtgccctgcactggccggggtgagcagggagcaggttgctgagagcagtgcccggaggctgccttcaccctcggcctttgtgcctcggcgtcagcccaggaccctgccagccagagcctgctgctcctgcgtgggactaggggctggagagcaggagctgcggggcgggttccagtctcttcctaagtcctcaggggtctgtgttctcaattccacgctcttcttccggcagctgacaaccgaagccggaagcgggtgtctgagaagaacaagcgtgacttctctgccttcaaggatgcggacaatgagctcaaagtgaaaatctccccgcagctcctcctggccgctcatcgcttcctagccacaggtagcatgaggaggaccttccggtcttggtggaaatacggtcacgggggagaagtcctgggtttccggctgctttccccccataggacgagggctgcagcaggtgaggggtgcagagacaacacagccacccctggaaggggccgggtatctgctccacccctggggatctccctgcgattcatttgccattaatgggcggctactgcaaacttctaggaagcatccaagttactatatttaatagtttgggaaataatgactaggcactatggcttatacctgtaatcccagcactttgggaggccgaggcaggaggattgcatgagcccaggagttcgagaccagcctgagcaacatggcgagaccccatctctacaaaaaatacaaaagccaggcatggtggtgccctcctgtagtc

SEQ ID NO: 95336 - DNA, 1025 bp, Homo sapiens
agtgtgagtggttccactctggtggctcagcagatgagaggtgaccttgagtccctgcagctgcccttgctctgtccctctgctgtcatctttggctgccatctagacccctcagacattcttcttgggattcagtcacacgaccactgttccaggggatcttccagggcctgctttcttctgttcgtgatagaatcatcccagtgtggcaggccatggagaattgtgtgccttgttctagagaagtttgaaagcaaaggagtgagtccctttctgtaggaaacctgccaaaggggctggcttcctgggagaagggagccgagatgaggcctctctgcgccgaggtggccatttagatcctgggctttggtgctggaatccaagacattaaccaaaaccacatgtcgcacttggccttcctggcctggcctggcctgacaggtttgtactctggtggggcagccgtggcccatgtagagacggcacccagcacaagcactgagggttagaaggtgtctagaaacgcggttcagcagggctgagtggcaatctccaggggccctagccttcctcccggaaagcggggagacgattcatgtggccatttccagctttttgtccagggcaatgcaagcatcctggagaactgtgctttatttaatcaagcccatgggatgtaaagtatgatccacacaacaacacaaacttgactgtttgatttcccaggagagtcttgaagcagataccccctcacaggcaggtccaggccagttacccctcagcgtttccactagtgacaaacgagggcctggttgaatgagttgctcccatccccctgtcctggacctgtgccgcccaggccggcagccccctccacctggggctgtgctacctaaaggtggagtctgagttgagatgtgctgtgagcataaaacacaccagattcagagagtgcaacatagacaaaatgtctatgaatattttttgtattgattacgtattgaaatgctattttgactatattg

SEQ ID NO: 95337 - DNA, 1025 bp, Homo sapiens
ttttcccttctttatatatatatatctatatataaataattttttttttttttgagatggagtcttactctgttgctctgttgcccaggctggagtacaatggtgtgatctcggctcactgcaacctccggctcctgggttcaagcagttctcctgtctcagactcctgagtagctgggaatacaggcgcccacgaccacgcctggccaatttttgtatttttagtagagatggggtttcaccatgttggccaggctggtcttgaactcctgacctcagatgatccgcctgcctcaccttcccaaagtgctgggattacaggcatgaaccactgtgcccaacccccttcttgctttttttttttttaattcattattcaacttgaacttcttgctgtctttaatagcatggatgacaccaaactatagactaactggtatttagagtagagtatagtaagtcggtatttctctcaaggacgtcttagaatggattgacttaatcagagatttgttgggaagtgggaataagttttagttcagacactcttttggccatttaagattaagtttaggtcactttgagtcagcagtggccctggcttagagggtgtgtggctggcagacaccatcctagacactagaagggcatttgtgaagagtttggtcagttcatactaatatttaagcgtggcccatccagtgctccactgcgagcaggaagattgtgttggaagaaattttgcaaatcgaactaaaggttgtgggatatggaaccccatccccacactgcaaggagggaggtgaaagagtctgaagtgtaggctgtgggtaggagtggtgaagggtttcttgttcttgtttttcaagaagatactttaattctgattgcgttcctaaggttggggtcagagatatgcctgaacttgagattcctggaagagctggtggggctgtggagggagctgcaggcttgcctcctcccacccccacctgccccaccacgaggaagacaagctgttatca

SEQ ID NO: 95338 - DNA, 2748 bp, Homo sapiens
aagccgagagcacccattttggctgggggttcagatcgatggccttgtccatgttgtcctttctggcttccctgatggtgtcatgtttcagcgcatgcgccccagcctttcccatgtgccaaaccagaagctccactgcccgtaggctgtccctgtagccctgctccctccctggaggctgctcttctgattctgagagctggcctagtggtgctgagggcccctttctgcttctctgcccacctgctgagttgccactcgcagtgttgtcagttcccgtgttctgagaagaggtcatgcctgggaggaagggatcgtcatgctgcatcgaatcctctctccgccgtgtggcccccaggagagtagctgcctgttgcacctgctccacacctccccacagcctccctgcaggtgctgtgtggccgtgatgtgcagagagcagtgagggagggttcatgaaccaggtggatcctctttaaaaaaaaaaaagtttttgttatatctctagaacatttcaagtcttttcctttttttctgttcctagctatggggttttagagaagtgggaacaggaaggcatttgtctttttcttctagtttactacattttccttccgtagttcttcagctgtgtggaaacgggcatcacaaggacataggatcatagattgggtagggagggaggaggatttctggaacttttctcaaaggaatttggacccttataaatgggactgaaggtcaaaacaacagtgatatccttgcttagaaattgtcctcaaggaataaactctgagagcaagcccgggttggaaacagatgctttaaaatcctctctccagaacagtggttttttgtttgtttatttgagatggagtctcactctgtcacccaggctggagtgcagtggtgagatcttggctcactgcaacctccacctcccaggttcaagccattctcctgtctcagccccctgagtagctgggattacaggtgcccaccaccacacccggctaatttttgtatttttagtagagatggggtttcaccatgttggccaggctgatcttgaactcctgacctcaggtgatctgcctgccttggcctcccaaagtgctgggattataggtgtgagctaagatcagggattcttaaccttggctgcacaccagaatcacctggcaaattaaaaatacgtggacctgccaccagagcttgtgatttaatcagagtcggcatcagagttttcaattttttatttatttattattattattattattattattattattgagacaagatcttgctctgtcgcccagactggagtgcagtggtgtgatcacggcttgctgcagcctcgacctccctggttcaggccatcctgccacctcagcctcctgagtagtagggactacaggtaggcaccaccacacccagctaatacttttaatttttttttgtagagatagggtctcattatgttgcctggggtagtctcgaactcctaggctcaagcgatcctcctgcctcggcctcccaaagtgttgagattataggcgtgagccaccgtgcccagattcacagaagtttcatacacctttcacccaggttcccctaatgttaacagcttacatataaccttggtacatttatcaaaactaaaggtgcaatcatactaatagctagagtttatttggattttaccatttttcccaatgtcccttttctgctgcagcagccaatccaggatgccatactgcacttagagctgttgctttcttttttcctaactttatattttgaaataatttcagatgataggaagttgtaaaggtaagggccccacgcacccttcatctagtttccctccatggttacatcttatatggttgtaatgcagtattccaacaaagactctgacactggtgcgatgtgggtggacagtccaaatcatttgtcacatgtacatctgtgtaactaccactgcaatcaggataaagaagtcccatccccacaaggatctccctccccaccttccctaactcctggtaaccactaatcgttcatctcttcttattttgtcatttcaagaatgttgtataaatgggagcatagtgtgtaagcattcgggattgtcttttttcactcggcgtcattctcgggagatcatccaggcattgcatgtgtcaacagtttgctcctttttattgctgagtggtattccgtggtgtatgcattggccccctgaaggacacctgggatgtttccagtttggggctattccaaataaagctgctacgactattcatgtacaggtttctgtgtcaggattagttttcgaggagtgtaaatgcttggtcatagggttgttgcatgtttcgttttttaaacaatcaaactttttttttttttttttgagacggagtctcactcttttgcccaggctggagtgcagtggcgcagtctcggctcactgcaagctctgcctcccgggttcatgccattctcctgcctcagcctccccatagctgggactacaggcgcccgccaccacgcccggctagttttttgtatttttagtagagacggggtttcaccatgttagccaggatggtctcgatctcctgacttcgtgatctgcccgcctcagcctcccaaagttctgggattacaggcgtgagccaccgcacctggccacaaactgtcaaactcatgtcctcaccggcaacctaggatgatcagttt

SEQ ID NO: 95339 - DNA, 1011 bp, Homo sapiens
tatacaacattcttgaaatgacaaaataagaagagatgaacgattagtggttaccaggagttagggaaggtggggagggagatccttgtggggatgggacttctttatcctgattgcagtggtagttacacagatgtacatgtgacaaatgatttggactgtccacccacatcgcaccagtgtcagagtctttgttggaatactgcattacaaccatataagatgtaaccatggagggaaactagatgaagggtgcgtggggcccttacctttacaacttcctatcatctgaaattatttcaaaatataaagttaggaaaaaagaaagcaacagctctaagtgcagtatggcatcctggattggctgctgcagcagaaaagggacattgggaaaaatggtaaaatccaaataaactctagctattagtatgattgcacctttagttttgataaatgtaccaaggttatatgtaagctgttaacattaggggaacctgggtgaaaggtgtatgaaacttctgtgaatctgggcacggtggctcacgcctataatctcaacactttgggaggccgaggcaggaggatcgcttgagcctaggagttcgagactaccccaggcaacataatgagaccctatctctacaaaaaaaaattaaaagtattagctgggtgtggtggtgcctacctgtagtccctactactcaggaggctgaggtggcaggatggcctgaaccagggaggtcgaggctgcagcaagccgtgatcacaccactgcactccagtctgggcgacagagcaagatcttgtctcaataataataataataataataataataataaataaataaaaaattgaaaactctgatgccgactctgattaaatcacaagctctggtggcaggtccacgtatttttaatttgccaggtgattctggtgtgcagccaaggttaagaatccctgatcttagctcacacctataatcccagcactttgggaggccaaggcagg

SEQ ID NO: 95340 - DNA, 1146 bp, Homo sapiens
acatcctcagtgactctgtttccaaataaggtcacattctgaggtacctggggttagtacttcatacgaatcttggggagatacaagtcaatccataacacacacgctcacacacacacagtctattcaatctcctggcgtgggattagaataagaaactgcattagtacgagccagcagtgttccttggtgggctgcatgggacccgtgggccagactggtgaagctgtgacatcttgggcacctgcggccttcgggagtgatttggtcttgtcttcaactgaaccagccgcagtcccaggcccaggtggagcctgtgggcctggagatgttcctgaaggcagctgctgagaaccaggagtacctgattgacaagtacttgacagacggaggggaccccaatgcccatgacaaggtagcacaggttgggtgagtcggctggcagcagctgcagctgcaggagcgctgccttcagtgtgttcaagtcctggcctaggaggctgcagggattttcactcttatgggcatgaatccagtggcacctgcagacggaggagagggagcggcccatcgcgtggtgggggaagtggcaattccattcagggacctggccctgggaaggggaccgcgtggggtctctaggggtggctgcactccctctgcctaatcttccatctctgccctcagctccaccgcaccgccttgcactgggcctgtctgaagggtcacagccagctggtgaacaagctgctggtggcaggtgccacagtggacgcgcgagacttggtgaggatggggaaaggcccagcctctggtcgacgcccagcttcacatcccagcagctgagtgcttgggtgcttttgttttgcagctggacaggacacctgtgttctgggcctgccgcggaggacatctggtcatcctcaaacagctgcttaaccagggagcccgggtcaatgcccgggacaaggtgaggggcacggtgctttgggggcctgtcgggaacacgggagcagacgctgttcctggagaagagagcacgtagtcccatgggttagggaggcctcaccaatccagacccagcactgacccccacttgctctcagatcgggagcacccccctgcacgtggcagtgcgcacccggc

SEQ ID NO: 95341 - DNA, 1009 bp, Homo sapiens
gcctggagggtgtgaggcccagcaagcccatctgtgggctgctggccccagcctggtgcagcctctggcgggaggcaaatggcagggaggtgttaggttgctagagttctttagaaggaatatggttctacctgactagaaagtcctaggatctgttaccctatcattccaccctgttctttccccacaacaggctgattcctcagtgctccccagctcctgaactcctgaggtggggcccggtgggaggaagcatgggtgtttgctacggaggctttgccccaggcacaggtcccaataactcataaccttcacaactcctttaggcaattgccttaagtgtttgagcttaaatgtagcttcaaaaggagccgagaactgaacccaggcatttagaattttaccccggggggacttctctgtccctctgagcttggagtcaggtggcagtcagtatgatctggtaggaatcttaacaacatgggggaagctaaggtgtcatctgccctgaggctacctgggcaaatgcccagcagtataaataggttgtggcctcatgtccccccagctgtgttcctgctgacaggagcagggtaggcggggatccgttgtccccctgggtgtcagctgatgacacagttgcggagcctgcagcacccacagggtgagggagcttgccagcactctggactgcaggagctttgaggccggctcccatcccgggcaccagccttgtgacatctgcccttataagacagctccctgctactccacagctctgttttctaagggttcctccaattttcccaactcagtactcatatcctgttcctacaggtaagtggagaaagagttgaagggaaagtgttgggatttggacatggagttcctgaccctggagcctggcctagtgactggaggaggggcccccaagaggctgtggcccgggagaagctgaaattggaagaagagaagaagaagaaagtgagagaggggcgggggccggggt

SEQ ID NO: 95342 - DNA, 1022 bp, Homo sapiens
atttttagtagagatggggtttcaccatgtcaggctggtcttgaactcttgaccttgtgatccgcctgccttggcctcccaaagtgctgagattacaggcgtgagccactgcgcccagagaggcctcttttttagaaggaagaaccactgaaagtggaacaagagagagcagagcccagtgggggggtatgccctttgattccagcctttctctccacaggctgctgagaggggtcacggggacatctgctccctcctcctgcaacacagcccagccctgaaggccatccgggaccgaaaggcacggctagcatgtgacctgctgccttgcaacagtgacctgcgggacctgctatccagctgagccgccaccctatctccagctgcctttaaagggtacacagaccagttctccaagcccctgccttggtcagcatccatgctgctgggcagggaactgaggccagaccacccaggaagagccccagtctggtcactgtggaagcgagggagtagatttggtgtggctaaaagtgtttaagactggacagatgatcatattctaaattagttcatatgagacatctatttatttggaaaaaaataaagttatatccttacctcatcccacacccaaagataaattgcaagattaaagatctaaatataaaaacacaaaactatgtaagtattagaagaaagtagggactatgtgagaagctgctttctagctgaatgcccttggtaaaagtcactttagctgtctgcccctccatttcctcttctgtaatgagagtggttatcatagggcccgcctcagagtcattgtgggaggaggtcagtgtgcactgggagagccctcgagagagtgcctggcacgtggcaagcagcctgagggaggcccgcttcccgagctcctcatcagcactttgcgcataccatgatttcattgattgcaacggtccgatgggagaaaagtgctgtttcatctgtttcgtttttcattgctggttactagtgag

SEQ ID NO: 95343 - DNA, 1434 bp, Homo sapiens
ccgtcggtgaccttggaggcccgggcccccctggaaaacctggggctggtgtggctggcggtggtggccctgggggctgtgtgcctggtgctgctgctgctggtgctgtcattgcgccggcggctgcgggaagagctggagaaaggggccaaggctactgagaggaccttggtgtaccccctggagctgcccaaggagcccaccagtccccccttccggccctgtcctgaaccagatgagaaactttgggatcctgtcggttactactattcagatggctcccttaagatagtacctgggcatgcccggtgccagcccggtggggggcccccttcgccacctccaggcatcccaggccagcctctgccttctccaactcggcttcacctggggggtgggcggaactcaaatgccaatggttacgtgcgcttacaactaggaggggaggaccggggagggctcgggcaccccctgcctgagctcgcggatgaactgagacgcaaactgcagcaacgccagccactgcccgactccaaccccgaggagtcatcagtatgaggggaacccccaccgcgtcggcgggaagcgtgggaggtgtagctcctacttttgcacaggcaccagctacctcagggacatggcacgggcacctgctctgtctgggacagatactgcccagcacccacccggccatgaggacctgctctgctcagcacgggcactgccacttggtgtggctcaccagggcaccagcctcgcagaaggcatcttcctcctctctgtgaatcacagacacgcgggaccccagccgccaaaacttttcaaggcagaagtttcaagatgtgtgtttgtctgtatttgcacatgtgtttgtgtgtgtgtgtatgtgtgtgtgcacgcgcgtgcgcgcttgtggcatagccttcctgtttctgtcaagtcttcccttggcctgggtcctcctggtgagtcattggagctatgaaggggaaggggtcgtatcactttgtctctcctacccccactgccccgagtgtcgggcagcgatgtacatatggaggtggggtggacagggtgctgtgccccttcagagggagtgcagggcttggggtgggcctagtcctgctcctagggctgtgaatgttttcagggtggggggagggagatggagcctcctgtgtgtttggggggaagggtgggtggggcctcccacttggccccggggttcagtggtattttatacttgccttcttcctgtacagggctgggaaaggctgtgtgaggggagagaagggagagggtgggcctgctgtggacaatggcatactctcttccagccctaggaggagggctcctaacagtgtaacttattgtgtccccgcgtatttatttgttgtaaatatttgagtatttttatattgacaaataaaatgg

SEQ ID NO: 95344 - DNA, 1035 bp, Homo sapiens
attttttttttttttttttgagatggagtcttgccctgtcgcccaggctggcgtgcaatggcacgatctgggcttactgcaacctccgcctcctgggttcaagggattctcctgcctcagcctccagagtagctgggattacaggcgcacaccaccgcgcccggctaatttttttaatctttggtagagacgggtttcaccatgttggccaggctggtctcctgaccttgtgatccgcccgcctcagtctcccaaagtgctgggattacaggcgtgagctaccacgcccagcctttggcactggattcttgataagaatgatgaaggcccctcaaggcgtccccacccttcccccacatgcccactccacccatatccctgccaggagctcagcagctgcagcgggggtggatgtgctggtggctctggccagccctgcctgaccacttcccgcccctcccaggtctgggggctagagggggcaccacctggggctggcagtgggtcagcagctcctgccaacggatgtaggtctgggtagccaggtccttgagcatggtgcggtgcatggcctgggggctctcccggatctgcgtgctgatgtggcggtccaactgcatgcacagcagctgcagctcgccctgtggaggcggagggaggccaagaagcgggtgtagcacaagccaggcacatccaaagccgggcaggaggagaacaaattcagagaaaggaaggggcacatttgagtgactgttcagaagttgaggaggaaaaggaggatggggccagcacaactgttggggctcgggtcagtgtcccttgggaatggctcagctggtgggacactgtggggaggaagaggccctggctctcccacgctggcttccctctcagcctcccactctctgcagttcctaacagtgggctgggcgccatcccagccaacccccgccgcttgggggagaagacacagctgggcacccccaccacagccctgccccttgggagactcacccactggtctggagtgatgtc

SEQ ID NO: 95345 - DNA, 1011 bp, Homo sapiens
ggggcagagtcaggcaccaggagcctggtccccatctccccagctgccctctgggcatgtcctcctcccagccagatgatgtccccagtggataacagctaaggggcagtctgtgggttctgcacctgttatggtccctgcgggggcaccacccagatcaaggcccccgactgagcgcgagtggctctagtcagctttctcgaggtgcacaccacttaaggtccccagctcatgctcctgaggcctggggatgtgtggcttgtttattggagaagtgcatttgtacagaatggagttgttggcggggagggggggtgtgctccagggattgggtgatgctctgggataaactcagcccagctgtgccaactccactgcgttcatgctcattctgagtagctctgctcatgttctgcagagggtgtggcctctgctgtgtgtttgtgcataagtgcgtgctgtgcacatctcctgtatatccttgtggtgtgccgcgtgtgttgatagagttggcaaacaagttttactgcttcgctcccgctgctgtaactgcagttgtctgtccctgtgctgggtgaccctgccaagggccgccttaatgggaggttgtggagaaaggcctggctctcactgcagggctaggcagggagggggccgctgccctctggcagctgtgtgcttgcctctgccctctcttgctggcatgctcaactccagcaatgggacatgtgttcccctgggcacaggccacttaccctctgtccccctgaaaggcaggtggagcctctttctccattctcgccatgctctctgccttcccacctggaagtgtctgtctcttccttactgccccactgggctggggaccttggtcaggccaaggtcaggagggctgggaggaaaccgactggttttgaggaacagaaaatggatattcagaacttgtgagttcctctcctgtctaatctgtggttggttctgtcttacttcctccaaagtacagaacatcag

SEQ ID NO: 95346 - DNA, 1201 bp, Homo sapiens
ttgccttttcgtttcccttcagtgccatggggaaactgaggccagagtagggttgacctgaggcggcccagcctggaggaaatgcctactttcccagcgttggggctgctgagctgagcctctgccttttgacgcctacccatcccccaggccctctcactcctgtctgggagatttcctgccctgtgcggctgggtcacagccctcctccagccctgcaaataaacacttctgcccagctccttccccacctcctctggctgcctcaggccttggcccagcctctccctctgggaagaggctgagagagctgctgttggtgtccagggcacaactttctctcctcactgatcccttggcaagtaaagttgtccctttgcttgccccctgtccagctagactgtgggcacatgcagtgtctctagcactgcgtcccacatttggcactaggtgaacgaatgaatccagttttaattcctttgtccttctctgaactcccttcttccattctgttctggcattcgctgttcgctctcctgcccccattctggaaacctgctgcctcctgtgtgccatctgaccagcctctgcatcgtggtccccttgtctcttaaggtctttgtatcattaaggccacaagagcttatagcctggccttctcctgcaggaggctctggactaaagaagtattacctgcatgtggcagaaccaatcccagcacatcgtttgtaattataagctagtgaggtcctgcctgggaaagcaccaagtacttcagcaaaggaagccatgagctcctgctgcagctgtgcatgggggtcaggaactggagtgaatcaggggcaacatagatgcctgcactggccgtgtgtcctggctttgaccacagtcctagctgagcaggcagagcttatatggactataagagcttctgtggactatcccgcttagtgagctgataacgtttttagcattttgaagagcttctggataaagaaaacaaagctgagccgcttttggttatctatggccctgtgcatgcctggtttgatctgggctttattctcagagaagagtaaacatctggtttggagtgatgcttgggggtctggtacagccatgtgagaggcagagggcttatttggctgacagtggtagagggtgttttcctgtgggagagttaacacaggagagtttaata

SEQ ID NO: 95347 - DNA, 1045 bp, Homo sapiens
tatcaatcgattcactgtaaaagggggcacaggggtttagaattgactggtgtaggagcagaggacctggggctggatctgggcacagcaatttgcagggcactgctgggcaggagtccctgatggccaagctgctgggctctgtatctcccacaagctgcagcggaggccccatggagcaggagcagaagcacacgttggagaactgaacttgaaggacaggacttacagcattgaggtcacacaggcaagtggaggctcagttagccagagcctcaaggctacggtgagggttttgacttctgcgcagaagtggggagcccctgcaaggatttgggcagagaagaaacaaaatctgatttatacaacgtttaaaaattactctgcctgctgtgttgagaagagattactgggagtggagaggaaggaggtgattgcagtaatcctggcaagagatgacagtggtttggcctggagaaacagcagcgtgggcggtgagaagtggtcaggttgtaggtgcatttcccaagtacagacagtgggatgtgcgatgcaagagaacagagacaaggactctaggtcagtgcaacaggcgggatggagacgccctttgcctaccctaggcaagacgcagctggagcaggtttggggaggaaatcaggagtttgcttcttatcctggggcacttcttgcaacacagtaaacctcttgtcaaagtgtgtcttccagtttgggatttggaaaacgtgggcttcgggtggctcaaatcggggataaaggtttgcatctactcagaaaatgttagctgcagtcttgactgttcatttattcattcaatcatttgttcatttgacagatacttactagacatgtaccatgtgccaggcacggtgctaggttctggggactctgcagtgaaaaaactgccctcagagagtttacattccagggagtgggggggaataggtgataaaaagcaagtaaattgcaaaggggccaagcgctgtggctcactcctctaatcccagcgctttgggaggccaag

SEQ ID NO: 95348 - DNA, 1062 bp, Homo sapiens
cagcccgaccaacatggtgaaaccccgtctctactaaaaaaacaaaaaattagccgggcatgctggcaggcgcctgtaatcccagctactcgggagactgagacaggagaattgcttgaacctgggaggcggaggttgcagtgagccgagatcgcgccactgcactccagcctgggcgacagggcaagactctaaaaaaaaaaaaaaaaaaagaaaaaagaattcagccttcctgtcctgttcctcttctctccaaaaagctctgactgcaggctcctggcagctcagaggacgtcacttcacggggtgatgaaggggtcactggcagcccaaggatggatggaagggaggttgagcgcgcccgcacctccgcagtaatcttcctggaatcctgggagaagagctgctgggtacaactgacccttccagctcagctacactaggggtgctctggctagaggctgtgcatctctagccactgaggcagcataaccccttgcccagagggctgagacaatgttccagcacatccctgggtgaggtggaccatatgtctgagtcccaggtgctgtgactgcaaggagggagttcagagaggtgaccggtggggttgggttgtctgagcggcttcggcctggcttttgcctcagatgcctcctttgccttgaatgcttcccccaggccttagtagaactggagcttcttgtcattcccactccagccaaaatgtcacctctgcaaggggccttcctgaccacccaatccagagtgccccagcactggctgtcatcttgtcctaagtcactcctggtggccaccccctgatcttttcctatttgtttgctcagcatctgtgttttccatcccctacccccaagcagaaaataagcccctgaagaacagggaacacgtagtttctggcccctgctgcccctcggcacctggcggtgcctggcacaccccgggaaggcagtgcacgcttgtggaagggacaggcacccaggtgggtcgtcggggtgcatggggagaacgtgccccagctgagaccttgggaggggcagt

SEQ ID NO: 95349 - DNA, 1055 bp, Homo sapiens
caggtatgagccaccccatgcccagccacctgttctcttgtttgtttggaagttgctggactcaggctgtatcccatgtgtagggaattacagaacaaccacacacccccgcctgaggatctgagtatcacaccaggaaggaatttccttgctcccagcctcagggagatgggaagcccccaggatggatgagcctgtttttggcacttcctgactcagcccccgctgcccccactctctggtgaaacccagacttcacagcctggttagtatccttgcagacacgtcccagtcccttgagtctcttcaagccgcttgtttggcccgttacctaatatccactcaggaacagcagggcatgcttttatgttcccacaaccctcagttttgtgtcatgagtgcccccgttgagccccgggctgacttgctcgtggacagtcatgatcatttgcctatgcctggtccctgcctgtggggaggagtgccacgtgatgcataaatagctctggtgggcggatggcgacttagcttaaggtcgtaaaagtgttatatatcgtcatcttgttctacaaattttagcacatccaaactctcttgagaacccttgaagaaggtgatttgagatggaacagagtgttttgaagcctggaggggctgttgtataggacttccccccatgcttcccgctgacaatccgtcagcgccaggaggtgccaggccccccttccctcgcctcggcgggcagatgttcctctgcatggaaagtgggagctctcctaagaacctgttccacgactgtgtttagcaattgtctgccaagccaaaccacactcagctctgctataaataccccacacatgtgccagcctgccgtgctcctgcccctttccctcccggagctcgcagctccatgtctggtgtaatgagccacttgcctcctcctggcacagagctgcaatcgcacaccgtcttggatgagcgggggagagaattacactcagaaagacaaatgaacgtctgaggcaggcaggggccgtggagtccagaagagccac

SEQ ID NO: 95350 - DNA, 1097 bp, Homo sapiens
agtagagacagggtttcgccatattggccaggctggtctccaactcctgacctcaagtgatccacccacctcagcctcccaggtgctgggattacaggtgtgagccaccacacccggcctgactttcttcttaactccatctcttcctctctgttatggacttctctggcatcacctgctcaaggaggcctgccctgcgggcgtgtgccgcctccttgcttctacgcttggctcccttttccactcgtggctttagtcatagttgatggtgggttctttgattaatattgtctctcccaatgggccgtgagctccaaagtacggggaccatgtttttgttttgcttttagttttagttatctgttgggttcctggcagctgtgtgagcagggacactgtaggacccaggtggtttttgttgaatgagtgggtgggtctccagaaacactgcgtctcccggtggacagcagcatcttttccagatagctgctctgatcctgtggccagtcagctgtggagctgggtgtaccagagaagctctgatgtgctctctggtcctccagcttcaagccctgaggtctgttggccctgtgggggcaggcatgcatgctttaccccagctcagcaggcatctccagagtctccctgcctgtggcgcactcagctcctgtccccaccactacattccaccacctatacaaggggaccctcaggtactgcgccattagtagctcgtgaggcccaggtgagttcgttcccttaggacagtacctgtcatcaggaatttttaaagctctcaggtgatttttatgtggagctggggctgagatgctccaggttttgagaactttggccaagtgcacagacctcttgcaggagaggtggccaggcaatagtgggggttttgcccaccactttagctcaggactctcaacccccacttttaaaatgaggtgcaaaataaatttaagtgacttaaactcggagagcacttttttgttgttgttgagacaaggtctcactctgtcacccaggctggagtgcagtggtggcatcagggctcactgcaaccatgaccttgacctctcgggctcagg

SEQ ID NO: 95351 - DNA, 1288 bp, Homo sapiens
acaatgtgttgtaattttcagtgtacatgtcttacatttctttggtcaaatttattcctaagtattttattcttttggtgctgttataagtagagatgttttcttaattccttttcaaattgttcattgctcatgtgtagaaatacagatttgtatatattaacctgctgaacttgtttattagctgtgatagtttttttgtggtagaatttggtttcgaaggcaaacatactcttgtgcaactagttgattaagagaaatgaaatgacctcaagtttctttaacaaaaatgttttagctgagctggtatatgactgtccgttaacctagtgccagtcttgaagcaatgtcttcggaaaaggagctctatcagcgagatcaaaacgctttagaaaggagtagagcttgcgtaggttcttttccatttgcttccaagacaattgtccatttttacctacccatttcattctctgttggcttctataatatttgtgtaggaggagggggatataataaaatagaatgaccctggccagtacattctttggatattttgaaagtgggcgagacgttcagctccaagaacagaattcatttcacgttcttgagcagggtcttaggacactttgttcttcctcacttgatcatgcttttccctttgttctcctcgagctctggcctcgtggccactggggccttgggtttccgtacaggcctcattttgtgggttactttcttttctgccgttgcctgttgcattctctttccttcatctctcccttcctttctttattcctccttcccactcctcctctcagaaagcattcataaagttgcttcttgtaaaaggaataaaatggaaacaagatggccagcaatcttaccacccaggtaacccctgttgttattttttaaactactctctgtaccaagtttagcaaatttaaataatagagaaagatgcaaaataaagagtgaaagtcttcttgccagccactccccacaaccacttcctcctcccaagtactcattagtacagtttcttgtgattatttcccggcacaaaatgaatacacaatacacatttcatctatatttgtatgtttatatgtttatctataccgtatttctttcgccacattagtatccatctgaaattacctccagtgccgattgctcttcccagagtttcccagttctccccactggtgtctggagaggccacagcctgcacaaggcaggtcaggtggggctttctagaccacaggtccgccgagtgagggtcctg

SEQ ID NO: 95352 - DNA, 1045 bp, Homo sapiens
actcacccttttaaaatgtaagattcagtagtttttagtatactcagagttgttgaatcatcaccactgtctacttccagaacattttcatctccccaaaaagaaacctcttaaaatgtgctatatccataaaatggaatactattcagccataaaaaaggaaggagtgacatatgctataacatgcatgaaccttgaaagcgctgataagaaaatggatacgaaaatttcatgcctattctgaaatgtccagaataggcaaatccatagagaccaaaagttgattaacagttgccaggagataggggaagaaggaatggggagtgactgctgatgggtaagaggtctcttttttaccagatatgtgatttgcaaatgttttctctcattttgtgggttttctttgtaatctcttgataatgtcctttgatgtacaaaattttaaaattttggtgaagtccaacatatctatttttttcttttgtggtgtcaaaattactgacatcattgtctaatctcaggtcatgaaaattttcacctatggtttcttctaagagttttatacttttagctcataaatttaggtctttgatccattttgagttcatttttgtatgtggtttgagacaggagtctagcttggttcttttgcctatggatatccagttgtctcagcaccatttgttgaaaagactgttctttccctattgaattctgttggcacccttgttgaaaatcatttgaccataaatgtaagggtttatttttgaactctcaattttattccattggtttatatgtctacccttatgctagtactctaaatttgttattactatagcttgtagtaagttttaaagttgggaagtatgagtcctctaactatactttttaaaaatttgttggccaggctcagtggctcatgcctgtaatcccagcactttgggaggccgaggcaggcggatcatgaggtcgggagatcaagaccatcctggctaacacagtgaaaccccgtctctactaaaaatacaaaaaaaaattagcc

SEQ ID NO: 95353 - DNA, 2218 bp, Homo sapiens
tagacactttggcaccaaaaaatatcatgtaaccagttgaaagttgcttaagcagacagtaagagggactcccaggtggtcagaccccgcctctgccccagctgtaggctgctcaccccagagcaagaaagcacatggccctgaaggccaaggccaaggatgtaccatgagcccccagccctttaagtttctgcttttgtgcctcttctgcttcaggagttggctgagctggagccatctgtcaaattagagcattccagactcctccgcccctgccctccatggagccctctaagcgaggtcttctgagtagcaccagtctcagtgccctctcccttttcgtaacctctgcccctgtagcccccgatgcactttggagccccaggggccgcctctgcggcatgcctgccctttaggggaacagaggcttcccttgtcctgctccctgcagtggtatgtgtctcctccgctgaggcagaggggatgccccactctcctttgcttcttgccacgttgtctctgatgcgctccccattaggaaggatcagaaacaagctcttgagtcccctgtcagcttagctctggctcttctaactccagagcatctcctgtggccactacctgagagcccagcctgggattgtgtttccctgcccaggggaccagggactggcctacagaattccatgcctggggtcgggatctcaactggtatggggaaagtgagaggcccggtccattagagaactgaatgcagggacttgagcagatagttgcgtacccaggttcttagcagcattgttcacaatagctaagaggtggaagcaacccaagtgtccacccgtgaatggataaaccaaatgtggtacatacatacagtggaatattacttggccttaaaaaaggaaggaaattctttgaatgtccatgatgtattattttaaaaaaagaggaaggaaattctgacacatgctacaagatggatgaacattgaaaacattacgctgagtgaaataacatacaaaagaacaaacacgtatatgagttacccagggtagtcaaattcatattccatgtatatgaggtacccagggtagtcaaattcatagagacagaaagtggaatggtggttaccgggggctaggggaaggagagagtggggagttactgtttaatgagtacagagtttcagttttgcaagaaaaaagagttcggagatggatggtagtggtgattgtactacagcgtgaatgtacttactaccactgaactgtgcacttagaaatggttaagatggtaaattttatgttatgtgtattttaccacaacttaaaaaaaagctaggtcaagagcaaaagggccaggtgcccagagagaatctgccaggagtcaggactaaagatcaactgccatttcaggaagcatttctaaggttaaattagatccaggattgatgcagaaggaagtcatttcctcagggtttcactaatagcctagggctctgagtgtctgagaggacagcaggcctctggggcacagagctcaggatagactggggctgcctcccttcacccgtatctatgatttgtgtgtgcgcgcgcacgtgtgtgtttgtgtgtgtgtgttcaagccgcttctcatatgtaaacaggagatttgtttgtgtgtaaacttccatcctttcctggagtttgtggtgaccagcagttcttcccagactatcctagggagattcttacgcacttgcctttatcccaacctgctgagtaaggaaagagttgaggggaccaggacttaagagcattgactattacgggtgtgctctagtgactggggctgagggcccgagtgtcccagggcactctagtgtgtgtgtggggggtggggcggtaacggagaattgtattcctggattgagaagcaacacgtgtacatgtcagctgtgcagagagctcagtgcactcagagaagggatactctggcacattgccatgcctcattgcagtgagcattcatttattcagcaaagacacattgagcacctccttcctcaagcacttcgctagatggcaaagagaggatcagggattaataaagtcctgttctcaggaggctaataggtgggaggggattaaatgagcagcgaccatcagagacagaaaggaggcaacgggaagaggaattacttgtagtcaggtaggtttgggatgtggggagg

SEQ ID NO: 95354 - DNA, 1048 bp, Homo sapiens
tagctgggattacaggtgccggctaccacgcccagctaatttttgtatttttagtagagacggggtttcaccatgttggccaggctggtcttgaactcccgacctcaggtgatccgcccacctcagcctcccatagtgctgagccaccgcacctggcctaggcttttaataatttgttcattttttcaaactaaaaaacaatttaagcaatagatacaaaactaatggcaaagacatgaaccaaacaggaaattgttttaccgtttgtgtggtggtttggtgagatgcttcctgaagcccgcagggtcagagtcctcccgggtctgcagcatcgttcccatttgttgtgccatttcattctcaggaccaccctgtgatgtgggtcagggccgtaccttgggtcacttggccagaaagtgagacaggttccatgtgctaggttggtgggctgcaggcgacgccacaccacacccagtgccagttgctcatgtccagatcctaagggggcccctgggctgttctgcccctgggtttgctgtcccaaacagtgggcctagccggaaaccagggaatgggccgtctcctgattagaggaagagaggcagtgtccagagcttgttttattttattgttcctgttgttaaatttgtgttatattgctataaaatgaagcagaacatagttatatgaagtaaagaggaagttgccctcttttcctctcccctccctctgattctgctccctgggatgaccctcagttgtagtgggatatgtcatatgctgggggtgggcgttgcacgtgtctgagcatgtctgtgtccgtgcatatgtgtgtaggcttgtgtgtgtgtacacacacacacacacacacacacacaccctctgctgctgttttcacccaagaacttgggctcagccacgttgccagtccttctttatgtagatttagctcattcttgggaaacatcttcgctgcctcccttttccccatcctcatttcaatgggtcattaagtcctgacagttttcacctctctccgatactgttg

SEQ ID NO: 95355 - DNA, 1686 bp, Homo sapiens
gagccaccgtgcccagcctgataatcatctcttgactaaatcaaggatcagcaaactttgtgaaaagtttgtaaatagcaaatattttaggccttgaggaccaggtggtctctgtcaactctgctgctgcagcaggaggctcctgcagatgctgggtgaatgaaggcgcatggctgtgctgcagtgagcccttgttgcagaaacaggccccacacaggactcggcctgcaggctgtactttgcctggcccaaattagaaggacccctgcctcctgactggtgccagtttttatggtgaaagtttaggaatgtgttgggatttgagcagccgtcccaggtggacaaagagagctcctcacacactgcccagagttccagggaaaggcagccggccatgacgtcccacatggactcccacgaggcaggtgctgcttcctgtctgatgttgcaggaagcatgtggatgggcatggtggggcatgtagactgaatttaattagcgtgtttagggccaaaggccttcctcggcaagagcactttggcagcattatatttgatgaaagcaactttctctctgagctgaggtgcatggatttggtttccaggttctccactcactagctacatagccatggaatcaaaccttttaaaacctttttaaaaatctctgcagcaagagtaattcttccagctctgtatctttctactgagtacctccagcattccggaagtcatggcttggatgttttgaaactcctcacagaaaggaagttatctgtgcaaccagcttaacgcagaaggtagtcctggctttgaaaacactggtaatttgctgggcgcatgacgttttctagtggtgctttgagaaagcctctttgacagcagccactttgaggtggtggttttgatgtgggatcatctggatgggactgttcagctttctgctttacaaaagtcattcaccagtgtacaaagccagcagcctcttcatccctgaatagggccagggaagggggtgcaggtcaggaagggatgcttagggtgggggctgaccactgcctgccagacaaggcgtcatctaattgccacaactgcccgtcacagaaaggacccctgacagtcccgagcaagcatctgtgcatgctctaacaatcggcttgcatcttgaatgggtgacatcctcaattctccatttcttaaagttaaaagaccttgcgtgtgtgctgagcctggggcagaggcagatatttaaaccacaacatcatcctttattctcagctctaggctgcacaggaaatccccaattagatgtataagagtcgcctcaggactcttaataatgcacatacattacagccagcatcacagaagtccctttaaaagatggttttagggacagggacaggacccctttgtagattagcctagttcttataggcttttttttctttctttctttctttctttttttttttttcttgagacgaagtcttgcactgttgccagggctggagtgcaatggcacagtcttggttcactgcaacctctacctcccaggttcaagcaattctcctgcctcagcctcccttttgtattttcttccctttgagatggagtcttgctctgtcacccaggcaggagtgcagcggtgcaatctcggcttaccgcaacatccacctcccagatt

SEQ ID NO: 95356 - DNA, 1055 bp, Homo sapiens
atgatgtcagatcattgagattgaaaagtgtgtggtgcaggatagagcctggtgcaggataagctgtgtggtgtggtgtgctggcgcctgtgatgtggtgttgtttgctgtctctgtgtgaagtgtctctgaaagcacatgaggaatgcctatcccatgggcacctgtggggagggaacaggtggctgggggtggggatgggggcagggagacattttaccctgcgcctttatactttttgattttttaatcctgtaaacatagtatcttttcagaaaagcaaacaaaataaataaagggcttaatttagttttttttcttttttctcctctatctttgtacttctctgtcgtcctcattcccatgtcctgtttctccagttttcctgggggggctcaggaagctacttcaacaacctggactacttactgcaggagaagaggtgagcacagggcgtggcctgtcatggggtgcttatttctgcagggttggcagcagtcccgggactcactgcagagtctggtcggagtacagcggcctcccacccagactcagcctgccctgtgtgctctgatcagtaacaggcaggtcgccagggcagggggtggcatcaccaaggcagagagcccccagactcccaccacgaacagagccctccttctgggtcccctctccaccttggctccattctgcccaactcctgccagtttgagggtgtctcctcccactcaagggttatgtgagagggaagtggaaaagcagactgttttgtggctgagggttacagcctggctgtggctggagggtcatgctgggcagacgggacttcctaacatttctgccgctgctttctaccccagtgtgcaggcacgcgttgcccattttcccatcctctctgagtttcacacctgccttctcccagcatattagcttctaactagctctctccctgtctgccataagtagtttccacggaccgctgaaggcaacagtcacgtctgatgagattggaaatccctagggaggtgcaggtggctggggacagacaggggtcg

SEQ ID NO: 95357 - DNA, 1050 bp, Homo sapiens
agagagcactcgacttccctgggactcctggctggtccaggccttgcaggtcagccccggtgcggccgccgggctactctggcgcttttcaggttcctgcgaccccgcgtggttcgggttccgacgtgagccgggccctcctctccacaggccactgcgcggccggccttggtggggtggaaccttagattggtttgagaactggtttatgttttggttgatgtggcatgttttgttttgatttttaatgttccccagggtgcaaagggtagctggtgttttctttccagaaaggctttctattcccagcccctgcccggtttgatggatgtggagtttatgatgctggagaccgttttctttgtgggtagaacgcatctcctttcatctttcaaattgtgagctcagtccttgctgacaggagccgctgctctcgccagcattcccaagctattaaatatttgtttaaaaggatggatataaaacatgatgttaggaataaggcgtcttgaaaaagcagtattcgcagaaacagcaccattgtaatattctgaattcatcttggctcttttgacatcagggcccaaagcacttgggattccgtaattatttggcctcatgctacactttaagacagattattttatttttcttgtagtcaggaaagtaaaagaacaaaaaaactgagatgacatgttgaaatctcactgcgaggacgcgagggaggatgagggaagcggggagggcggctgaacgctaaaggctggggctggggtttgcaggattcggggagacaagagcccaggcagagggatgtgctgggcagagggggcgccatccatgggctgcattgtagagtgagcatggccaagtcaaggagctgaacaagacgacttcagtcctgaacctggaaagaatgtgagatggaggagaaacaggtcctggctggcgggtattgggccccaggagggaaagagataacaaagttaagtttggagactaacgctgtctcctgtttgactggggggccttcatatcccctcccacgct

SEQ ID NO: 95358 - DNA, 1050 bp, Homo sapiens
tacaaaagttgttcctgaatgagatcattaagttggaatcacacacccacatatttccagaattccatccaataaattcacaaacacttgaaaatcacaatacgtattttaggtaatgggccataagggattattttaattgtaagaaaatgtacaaaaaatttgctttttacaaattttctatttaatagcaataaaatgaagtgacactaaagtacaaaaaagcctgaacagtatgatttctttgtatcaacagtgaagggctcccttgtatatggagttcccaaacagtaagttttcttaatcctgatcatctgtggccagtgtaaaagaaaggcctgacaggaaaagttaaggagccagctgggtaactccatatgagggaactcttggtgacattcaaaaaactcacacttccactttcaaaatcaagaaacacaccaacccggcccagaggtttctctatatagtgaggaaactctggggaggtggtcaagagactgaaatgattatccaccttcagacacaaaagaagaaatatgtcctcagagttaaccattgtgctattcttccttatccaggagtcgttacagactcccagagcccagtcacaagagttgtccacatccagctcccagtagtgtttcccaaaggagaagaccctggctccccatgcagcaaaatagtcagatctgtcagaattcaaaggtccacgtctaaacatccaacttctcacatcctcaaagagcctgatattgtgattggttacttcacaatggaaggaaatttccactgtagaaaaaagagaatattccagtgaaaagcagtttacaaattcttatgttcagataagaaagagattctcactagaaaacacaggtcaagattagaaagaaacttctgtctggaaaaatgttggaatcaaagggtgttaggagatctgcacaagtaaatggctaaactaggatgatcacaatttccataaactcaaaaagtataaaggggaggaaggtcatgtctatgtctcgttagcgacctttcataacaact

SEQ ID NO: 95359 - DNA, 1028 bp, Homo sapiens
tacttaatcagtctctttttgggtgcaagctccatgaaggaaggtagagttgcacattttattcaaaatgtcatcattggtacctagaacagcacctggcactcagtaaagaatggagtaatcaccgtgattctcatcatccttctaatctctttaactctgccaccctccagctttcaggtgatcacagagctatctcttacccggtgttcctcagctgcctcttcgatgggatagtgtttgtgagccccgtgctcctgagagttggagcacagcaagcagaggagactcttgtccatgtcacagaacatcttctttgtttgcctatgggtcccacatatttgtttctcagagctcaggaattgccagagactggcttttctggcaatggtcactaaattcttcagaagaatattggttttgaagtcctttttctgtgatggttccctgcatgcacggcagttggcaggactttgggcttcctcccaggaaaggcagagagggcctgcagaagctgtgcccacagcagatggtgacagggtctaccaggtagttcaaacagatgacacaggcgagttccttctggaaggcatgtgagaagtctgagtccattttcctaaggaaagaaaaccacaagaatttaatcttctaccctggagagacaaagatccaaacaaagtttgaatcggattgtgatagaataatatcctttctttctagagaagtataggctttaatttgcaatgacagaaataggaaaaatagaaaactaaggcacaaagagacatcaacctctagaaaaagtgactgttctccaattaacacatgaccagctttccaaactctactttcttgcatggaagaatgttggattttttgaggtgttagtatccaccaaattgcttgggcttcaagggtttcatcaacctgtaaactcaaggtttgagtcttgaatggtctgaaagtcagtaacactcttaattgccagtgattggtttagagaaggaaagctaactaagctcttctac

SEQ ID NO: 95360 - DNA, 1054 bp, Homo sapiens
aagggagcttcaggcaccagggaagaccctaatttagtcccctccatctccaacaagagaatagtaggctgcatctgtaagtacctcacctctattttttatccacttgcttaatatatcctacaatagtgtgtaagctgcctcaaatcttcagtgtgtgagtgcatgttggtaagtttgtctaagggtcttgacactctcaagcctcattatgcctgatagttcatccttactggaaagaagcgcagcacagcggtaagactggctcactgggagtgcggcatgaaggagtacccacccagcaaatatttattgttatactgcttctatgccaggcatcattttagacactagggatacataccagaacggaccctgctttgcgttctacataggcaagggaattgttagaatttacagtgaccttgatacaaggtcagtttactcataggtgaactcagagcctcaatttcttcatctgaagaatgggaggagggcttgaactgatctcttaagatatcaaccatagtcttacttgtgtatcagagatgtctgaggaaaagaaattcatgttgaaagtctccctttctaggttggatgaccataaaccaccttttttcccttttaggtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccatagatggctggtcttatttcttacccgtattctttggtaggcatggaatatgcttattttgggaaaagctgtctgttaatgctagcttgccatccacttactgaaagtgtataaccagtgtatagtgcttagattaataataagaatagatcgacaacccgtaatgcaatgaatgggaccacctggtatgagagaaaggggcgggctgaggagtcaggctgacaggact

SEQ ID NO: 95361 - DNA, 1943 bp, Homo sapiens
ttccctgctccgactctcagggctgcctccctgagctccagggccagaatgcctggatgcctgggtagccagtttggggagtgggctgcaaggggcagccagcagctcccactggtgtgtcactgcatccattgccacctcctgttcgtgacctgacagggtgacacagcccctttcacactctgtcctcctatcttcctgggtagatgccctggtgtagggctgagtactgaatggtcttccatccccagcaagggggtgcagcccagggtcaggcccttcagagccagggcagaggatgcacggtggctagagccgctgcactatccttttcagagcacttcatccacttgctcctccctctaccctcggcaccctgggtgggaaagggttgatgctcatcatttattgaggggaagccacttaataaggagtcagacctaaaagggggtgggggacattttcttacctcacccaagaaagaggtcgtcacttttgctgtggccagggccccacctccctctctcagatatgtacaataatttaacacggttgcctgaaaaaaacttttgtaaatcattatagtaataattatggacaaggcccagtgtgtggctctgttttcttgtggctctctgtgctatcgtttgttcttccatccctggggactttcagagaaaggaccagagagaatgcagcaaggcactggctctagcttagcggcatgaaggtttcagtggttggcccgccaacgtggcacaaaaagcctcaggaggctgggctctcaccctgtagcataattccctcgcctgttacctcccctgctgcagtccaccaggggaagtagaaccaggctaccttctttgcccccggaccctggacaggcctatttgagcacctctgctcaccccattcagccagggctaaggctggtggacaccagcaatgatgcaagctcacgccttcagacaagtcaggatggggaaggcagggagaggcagagaggctgtgagcttagccaggccctagaggaataggcagaagagcagtgaggaattagggtttggagaatgtctgctctttactttcttaagtgtttgagaacctacagtgtttccaggatggtgccgtgtgtttggggccaatggtcaacaagttatatccttgccctaacaaatacacacgtcaagggagaaagacagatgagccattttagtacagagttgtgggggccgaggcgttagtcatctggcccgacaggtggggcaggccgacttgcaaggatccagaggttatccagggatggggaaggcattctatgcagatgtgagagcccaaagaagcacctgggaccagtgggtctggagaggaaggcagggacccaatgcccagtcagcagggaaaggtcagtggtctgtggtcattgtgtgagatgaacaaaaaaggtgggttgagctggcacatggaggattgttagctgtgtcctgggagatgggtggccagccatagaaagatggtgaccagagcagtgtgttgtaggcagttggggtttgtggggggtgagggcagccccaggactgaggagatgaggtaggagtgaggagagtactgaggcctgtctgccaaggcgttttgtgaggctttgtggtcacaaggcagttatgcttgcactggccctcaaagggaaagcagaatttgcacggagaactccatattagggcaccctccagaccagttcttcccacagtgctctgttcatggcaccactggctccctgcctcccaggttagagccttatccatcgacgctttcctcttccctgtctctcccactctgtcagtcaccaggttgtgtggttcttctgtagtacctttcccactggtccgttcttttccagcacagccactgccaccatagctatgaccacagctccattccctggc

SEQ ID NO: 95362 - DNA, 1046 bp, Homo sapiens
gccgcgacgtctcccgctacctccgactcctgctgcgcaaggaaggggttgacttccatacctcggctgagtttgaggttgtccggacaatcaaagaggtgacaaggggcgagagggtgtggacacgacctggggtgaggaaagggtggcaccaaggcacaggtgtcccaggtgcagccttctgagggctgtgtccctgtccccgcagcgagcgtgctacctgtccatcaacccacagaaggatgaggctctggagacggagaaggtgcagtacacgttgccagacggcagcacgcttgatgtaagtggccgggcctggcactggagtggcagccgatgcccagcctgggggaaggggtagcccgcttctccaggaagcctgtctgcctcaatcttgtacactaaaggtggggcctgcacgattccgggcccccgagctgctgttccagccggaccttgtcggggatgagagtgaggggctccatgaggtggtggccttcgccatacacaagtccgacatggacctgcgccggacgctgttcgccaacatcgtgctctcaggtggctcaacgcttttcaaaggtactgtggcttgagagttggtggtggtgagacgaggcccagggcagctggaccctcagagagtatacccctacccagagccatattctgttggctttttggtggtgctcaatgaacattttttttaacagaccaaaatttaaaattaaattttgtttactctgtgaatagaggagaagtttacacaagctctaaagtgtattgtgagagtcgagcaaggagcatgtgcggcttcatctcacgctgcctctgtgaggacgcagggcccgcaggcagccatggggctggatcatttctcagccttgcccttcatcctgggaagagctgctgatagaggaccagcagtagctgggggccctgaaggctgggtgcgggagctagcagcgaggaggccgggtgcagaccccaggctcagccagctttgtgttcacaggcttcggagaccgattactcagtgaagtgaa

SEQ ID NO: 95363 - DNA, 1071 bp, Homo sapiens
cttatcccttcgctgggtgggaggtttctaattgccccgttctttgggggatccttaagtccagcttccaggtgggggcagcgataggaccaagttctcctagtagtctctgggaagccacttgagggaagctgccggtcatcccatgcacccattggtcttctccagcaggccctgtaggtcgtccatgttccatgccttctgggttcttgggggagaaggaagctgttgaaaaaaaaaaaaaaagacccacacagaggggtttcttctagcttttgggagtagcatgtgctatggaatcctgctggagccaaccattagttgtgcagaggaaggtgcccttcgtggtttctctatctctatattattgacattctgggctagctccttgttggtagtgcaggctcgcctgtgcatcgtaggatgttgagcagcatccttggcctctgcccactagatgccaatagcatcccccactgcatgtcccctctccccagctgccagacattgccaaatgttgccagagcagggggatacaaaattgcccccaatcttgaaccataggtgtacttgtaaatgatcctggcagggtccctggcttcctccttggcctgccttgacggggcagccagctctctccattgcgggggactggcttcatctggtggtgcatgtgggcagctcaactttgtttttccttgcagggttcgggggtgattaaagctggctttgcaggagaccagattcccaaatactgtttcccaaactagtaagtgtggctcaggcagcagccttagtccttttgtttaccttctgtaagaacattggccttctgtcacagggctctttgaagacaatttgtgccctgacctgtatggaaaacaccaaatttgtgaggttgacactcttgagagagcactgaaagaacaagacaagcgttctagggttcccctttgtcttgggagtctctcgttttggtcttgttgagccagcaaggaggaaaagcaaccagcatttccctggggatggggtgtggtagcagcagcaagaataaagggagacatctccgag

SEQ ID NO: 95364 - DNA, 1039 bp, Homo sapiens
cttcttgctgcgtccccagggacatgtattcctgaccacagaaggaagagcagctccccacagcccttcagtcctgcctgacactgcactgaatgctcagcttgcccctagagcaatggggtggaggtgtgtgttgaggggaagtgtccatccccacccctacccaccctctgactccagaggtagcagtgtttgaatttccccacaagagtggcattgctttctctccatgccaaggctcctggaactggtgacttattcaggccacctcccccaacccccacctccagcatcctcttcctaccaaggctcatccattggacctgccattttccctccatgccccttgagatgccagcagaagtggtcagaactgtggcccctcccatagggaccagtcaaagttgtgggtggcctgagttagttaagagaaactggggggaagagagtatcccagaggctctgtgctgcccagaggcaaaaagaatttcacagatgacaaaccttactgatgggaagcagaatcctcacgctgggaagcgtcagcctccaccactgcccagcgagtagacagcaggactcctgtgcgctgagctgagcactgtggtttttgttattttgttttagatctcctctggcaaacacgacatataatatttttataatggatggaaagacatggtggcacaattctgaagaaaaaaatttcacaaaacttgcaaaaaaacagaaacagttgaagagcagctcctgtgtctaagccaggtcgtggggccgtcaaaccaggacttgaaaccacaatgcgaggacattctccatctgcgcaccacagggaggcaattccatttctgcccgggaggtgtattctacaaaaacgtctgcttcccatcccaatttgaatggaccaagaaaaactgctttaccataggacacttgtggcaatatggcaccgatggctggcgtcggtgaacccgacagactatggatttatcatttaataaagcattgattcattttttcagtcattcattgaacagat

SEQ ID NO: 95365 - DNA, 1690 bp, Homo sapiens
cagctgtgttccaatacaactctctttacaaaagtaggcagagctggatttggtccacaagctgtcttttttaaaatatcacaactagccggcatgatggctagtgcctgtaatcccagcactttgggaggctgaggtgggaagatcacttgagcccaggagtttgaggctgcagtgaggcatgatcacaccactgcactccagcctgagtgatggagcaagaccctgtctcaaaaaaatcagaaacatctgctcaaatacatatatataacatttgttctaaagtaaacaaagtaagaggaatgcgtgccccagcctcatcttttctgtagccttacccccttacccacttgaccctctgcctgccgggctcagtgctggacgctttctgttttgtcgcagtcggtcctcggtaacaccagcggcctgtggtccaccactccattcagcagctccatttggtccagcaaccttagcagcgcccttcccttcaccactccagcaaacacgctggcaagcatcggcctcatgggcacagaaaactcccctgctcctcacgctccctccacctccagtccagctgacgacttgggacagacctacaacccgtggcggatatggagccccacgattggaagaagaagctcggacccttggtctaattcgcactttcctcacgagaattaaattaagcaaaaaacaaacaaacatagtgggccctcgtctagatcatgatgtgccagtttctgagacatctttttaaggctcttactgcagctcccctccccaccctcctcttctttgcaaaacagacccaagcagggcaggctcagaccactcgcttctttcagatctttcttgcaattatgataacatgagatttgctgttgtgcttttagagaaaagtctggactcagccacaaactctaataagacctgtacatctgagaacctttcccgttactgcgttttcaccacctgtcttccccatgctttatttatctgtatgaacacagatttgacattacagctaaggaaataatttgagttgattcagaaatcctggcatgtgacaattttgttaaattaccaagtttggtttttaataatttctcaatattatgcgccaagatctaattttaaaactgtatgaggactttgtgctgaaaatagagtatttttttaaagtaaggctgtcttggtttaaaagcagattacagaaatgtaagtcaacttaagaacggtgaatgaatgtaaaaacattcagttgagaccatatgcattttctgtgctgtttgtacttgaggtatgtaacatttgtatacctgaacttattttaaagatgaactgaaatgcacatagccaagtcttgagatacaagattgaatgtgtatttcttaaaaatacaactttgtgttgtactttgaaataaatgatgcttttttcaaaagccttgttttgtggttttttttacacacaaggtgtatttattaggattttctcacaccaaagtaaaccaccttatccttgccttactctgtggagctgacaggttaagacggggtttgccttctcattgctggaacttcctgcagtctaatggagttctgtgtgttcccatggcaatcatggagggtccttgatcgaaaacaacttgaaagcctgtttggattcatccagtaagcgtttt

SEQ ID NO: 95366 - DNA, 1018 bp, Homo sapiens
atttgagtacccccagttgaagcagtgtctcctgtttgtgaagctgtgcactatggatccgtttgcactaaccaccatacatttttgtgtgttgcgttttcctcttgtaacatttagctcgggtttgtggagtcccgtcagcaacccaagcagccctgacttcactcccctcaattcgttctccgcctttggaaactcttttaatctaactggtggtgagtgtttaacactagatgtgtaactaataagcctgtggacagaggaagggagaggaggtgtggttttgtgtgctggagaacacagcacagcagcactgtggaagaggccccgcaggaagctccctgggaagggtcccctcccctcttcctccctcatccacaccagcagcccagaggggcagtggaccaggctcgacacggtgtgcgcacaccagttggtgtgagttccatggcgggtattgaagggcttcacagaagggttctggtctgaaatgggacccctgagtgtgccaggggtcctcttcttgctgtccagaactagaggtcaccatggaagcttcccattagctatcatgtgagagtggggaaagtttgcatttggatgtcattggtggcatatcagctcgtgcactatgcgtttgagttctggaggacactcctgcccctacttcctctgggctgtggtgggctggtgaagtgggtgtggtggctccaggagcagtggttggaggtatgccattgagtgaagccccatatgctatagtgatcatggcaaaaccaaatatggacttgatgactgttgctttatttccagaagttttcagcaaactcggattatctcgatcgtgcaatcaggcctcacagaggagctggaacgagtttaatagtggcccttcatacctttgggagtcgccagcgacagatcccagtccttcctggccagccagttccggctccccgacccacacagccacagtgagtacttggggctggggctggggcctggacctggcccaccc

SEQ ID NO: 95367 - DNA, 1003 bp, Homo sapiens
ggatacagaaaagcaaaagggaaaacaagccatgcctgaaaaacatgaaagtgaaatgtctcaagtgaagcaaaaaagcaaaaaactcttaaatattaagaaagaaatcccaacagatgtgaaacccaggtgagagaaataagtgtacagagaaataaggtctataaagaagttgctggcgaaaaccaggtgctgttttgatttggccatttggctggctggttggcttttaggggagttgatagcaaaatccaggtgctacgtcacattcctcttgggatttttctgtcacctgatatgtactgttgttgactcggaatagccatatgcttctcaagtcagatatgcagagggcagagctcacgatctgttataaaaatttaggaggaaaatttctgttggtgattcagtcccaggctgagatccattttacttctgcacaaagatgaccttgacgattgaaccacaggtacaagcataactttcctccaaaagatctctgagtctgtcgaattgttaacccagttgggatctagagttccatgccataaaacttggaaaagtttattcttaccttaaaaatggttcagagcaggtgtcaccagtcagacggttctaccattaaataactccagttcctccccatggaatgggattcagtggcccccggggagggcttgtgcaggctgtttccccagggagatgagtgagttgaactgttgggttattaactgaagttacttcacattttcattaaaccttggctcagcatctacctgataattttagtgttggtgcatcagtaatacctttcctggttcattgtatagaactgtcatcagcacgggagctgctgtctacccgcttgtgggttgtgatcagtagaaagtgacagaggaagtcgaataaattaggtgtaaatttaaaaggaagacatggcttgtctgtcatcataagtgtgggccatagatttgtggaaggtctattcttactctgatcctgg

SEQ ID NO: 95368 - DNA, 2122 bp, Homo sapiens
gctcactgcaagctccgcctcccgggttcatgccattctcctgcctcagcctcccgactagctgggactacaggcgcccgccaccacggccggctaattttttgtatttttagtagagacggggtttcaccatgttagccaggatggtgtcgatctcctgacctcgtgatccacccgcctcggcctcccaaagtgctgggattataggcatgagctaccgtgcccagccaaaactgtgggttttgtctgttaaaagttgtcacagacaacttggttttctattacatcatattgtactttaccaagaaactctgcctttaacatcgaattttgttgcttgtctactaacaaatgaatcctgattttccaattttttttacccctgcagtgcactgtttcttttggtcattggaacagcctatttggaagctcaaggaatatgggagccatttcgaaggcggctatcctttgaggcctcgaacccgcccttcgatgtgggaaggccatttgatctcaggagaatcgttggtatttcatctgaaggaaagtatgttcacatgctggcaataaattccctagtgtacatagatttggctgataaaattacaataaaaaataagtttcttttcatctttgctcaggagaaaaaaaatcttaattctgattacttaataacaccctgtatggaactctgagtgacttagagctcatgctggatactgtgtttttattatattggtaagggttaaaatacttttagttagatcactgatggtaaattataaatgttcagatagaacagatgttagagagttgtagaaatttccctatttcttgctattttttccctagtgtagtttatatttatggtggctgtactgatgaagttgaagtttttttttaatattagattttgtaggttgctatttactgatctgcagttggtccctttttcagcttgaacacactcagctgtgaccccggtcacagtagggggttctgtggagcaggcggttcatcatcccgacccagtgccgggagtcataagcagtgtggcccatcggtccacccacacagcagtcacagcaatagaaactcagctgacgtggaaaacgtcagagccaaaaacagttcaagtacctctagtaggacttctgctcaagcagcttcttcacagtctgctaacaaaacaagcccccttgtcttagattcgaacacagtgactcaaggtcatacagcgggcagaaagtccaaaggggcaaagcagagccagcacggcagccagcaccatgcccacagcccgctggagcagcaccctcagcctcctctgccaccgccagtgcctcagccccaggagccgcagcctgaaaggctgtctcccgcccccctcgcacacccttcccacccagaacgtgccagcagcgcgaggcacagttccgaggactcggacatcaccagtctcatagaagccatggacaaagacttcgaccaccatgactccccagccctagaagtgtttacagagcagcctccatcgccattgccaaaaagcaaaggtaatcatctcccactgccggagatccgtgatgtgtgagggaaaagccagtgcgtgcttaaggagctattaagattatagttgtggtaaacaactaattcagtaggttcctctggctcagatttatctccagtgttggacttcaacttttccataaaaatgcaattagaggtatctgtcataaaagatatatttgtatttcttagattgtttaccaaaatcagaaattctgtggacatctgcttttcttttcagctgcctgagattgtgttattgtgatagatttagcttttgttttattgttaaaataattttgagcacaggagtaaaatggagatcatctgccttttaactccaaattaggatttctttactttagagcaggggttggcagactacagttagcgggccaaatcaccacctggttttataaataaagttttattggaatagaaccatgctcatttgttggtatatcctcagctttcatgcttctatggcacagttaagtaattgtgaccaaaacaatatggcccacagagctgaaaatatttgctatctggccct

SEQ ID NO: 95369 - DNA, 4576 bp, Homo sapiens
tggcatgtacagagacaaccgtatttacctcagaagcaagaattaaaagtaatgtgcttcataaagtctgttgactctgagttaatgtttgtggaatcatgctgaagcaagtagctagatctctatgtgtgaaacacacaccgatctatgccagggggagtagaaaacaatacaaaatgcaccctccttccatgatagcagaagccatgaagaactggtggatgtttatagccaagcgttgacaacccttccctcaaaaaagtttacacttaatgttgcttaaaaaccagaacggtatatccttatatgtgacctgtgactgtttttgtaataaaaaagcaaatgtttttcaaccttaactataactggctgtcaaaaagtcatattttgaatattaaactaagctatgctttaaactttaaatcattgggtgtttatgaaacagtaagcgtgtgtaaccttcaaaataagattcaaggagaaatgtataggaattggaaatctttttacatttaaacattcggtgcagcctgaagacccttcagctggtccccttcagaggggaggagtggcgtggcagtggcaggaggcctgaggtgttggccctggtccccttcagaggggagcagtggcgggaagcatcaggaggcctggggtgctggcattggttccacaagtgtttgctttgtgctaatgtgtctagctgatcatcttaggtttgtgtccttttctgtgtgtggaatatttcaaatttttaggttaaaaacaaaaaagatatgtatccaaaaacaaatgccttgtgcaaacattgaggactttatttggtgacctggggaagaaagcccctttttggacttaatgtagaatatgaatctcatcgttggttactctgtgctgctttccagctaacccatatctaaacatgacagataaaattgtttatgcatttaatcagtttgagaaactatactgggctctagatggggtgtaagcgaagaaacattcttccagagaatatattcatgactcctctctgtttacccaatgattcaaggctcatccactgcagagttcaacaggatttatggagggcctctctcgacatttaattttaaacctaattttaaaacctggagaaaagaaatctgtcaaagtaaagtttactccagttcacaacagaactgtttcttcacttatcatagtcaggtaggttctgtgatataggtgtgggttcatttttactacttacttagaagtcctcacttgttttaagatgaatttgcatgtctaacttatgaaatagtttgaattcactttgtccaaaacatgcacacactccatgcctgatgaaacatacctttgttatcaaatgcatagttcaaaaacatgaatggtgtcttaatgtgtgtctcttaaaaataaaaacttgctcttctctgtgtatttttgaattcttaaagtataaattctcaccattaaatttaatttctatgtggtgctctgtaaaataacagtagaaattgcaaatcaaaagattgtgcagatttaatgagagaaaaatctgtaattctcattcttgcatagaaataacctgactgtgatggatgctgtgatggtccaaggacaaggaacaactgagaacttgagggtggcaggcaagcttccaggtccaggaagctccttacgctttaaaatcacggaagcattgttaaaagattgtacagatagtaagtcttcctaacagtttcaaggacactaatttcagcatttgctttcaacagtaaataatttcaaaaacaacattatttctgtatgtgcacctgtgtatattagttatgaatgcttaagagcttaaggaaattccatgttgtgtttagagttgtttgatttggatcttaaaagatttaaagtgtttgcactcattgcataccttagctgatttactctcagtatgaaatgtgaagtatagtcaacttttgccatctaaaatgatttatcaaagtagattacctcatgatgaaatctgaggaacagctgatctctctgacatgcagggatggtttataacctgtgacatatagtaattcatgaataatgtatttatcatttggactgggagcacatgatggcaagatttagtcttattcctgattttttatcctttaggtttaaaactaagagaaccaaatttcacattgaaaagaacatttaaggtagagaatacaggacaacttcaaattcacatagaaaccattgaaatcagtggatactcatgtgaaggatatggctttaaagttgttaattgtcaagagtttactctaagtgccaatgcttctagagatataatcatattgtaagtattttattttaaggtgtaatgaatcactaactttcctcaaactctgtgcaaagatatgttttcatatttaccaaaggtctttatccacaaatgcattcatttgtttttttttcacttaatctttggctaaggtatttcttcatatcttagttttcaaagttgtaaattttttttcacttaatctttggttaaggcatttcttcatatctcagttttcaaaagttataaaactttatctccgaagtggatcagataatcttagaaatcaatttcaaaattattttcagggttacgttaaagcaaaagatgttgatgtaaattcacagtccctcagcaacagagatttgtttcatacatgtacagttttttcacgttttgcagtatacggatatgtaatattttggtcagaagacagttttaatacctatctcagtaatagctgcagcatattttaacaattaattgataacttgttctgttataaagtttatgcaataaaatgcaacttctgtcccttaattgaatatttaatttagtgatctttaatgaatatttacttaataagtagctacattattgcatataaggcataatgtttgacacctaaagatgcaatgaggaataagacacctttcctcaaggtacatacaattagcaaaaaataaaaatagaataattgcaacagtaatccatactgcaggagatgatggaaaaatcactaggccccagccagttggtttgtttttttaaaaaagacattattgggattgtagcctgggaaaagagcatggatttagataaagaagaaagaaggagagaaggacatgaagctcaggaccattttctgaattaataattatgagaatttgattattgttattttttagtgtaatttctctaattattcacagaatacagttgttcctattactgaccatgggacaatacttttttcatcttaaaatacggaagttgagtaaaagtatcaaacgcaaattctgtgttatatttcaaaggcttataggaccagtattatatgcagactgcttgtgagatatttttaaaacttagccttactaccatcattctgttttaggtttactcctgattttacagcttctagagttattcgggaactgaagtttataacaaccagtggctctgagtttgtatttatattgaatgcatcccttccttaccatatgttagcaacctgtgcagaagccctacccagacctaactgggaactggctctgtatatcatcatctcaggaataatgaggtattgtgtcttgtttcaaggttcatattcattcaacatttaacactgttgatcgagtgcccactgtgtgccagccactgttctgagtgctaggatatgccagcaaacaagacagaactctgcctttatcaatctcacagactggtgggaacagttaaaacagagcccttcttgggtggcatatataataaacagtgttctttacctctgaaatttgttatacaaattaagtacattttaacatctttttaaaatgctcagataaagttacttgacttgggcatatatataatatacttaacacaatagtacctaggccacttgaaactgattagaaatattttttaaattctcagtgtcttcatctgttctcaatatattactttgtgtttcaagagtcagataaattcacctctaaactaatttacatatttatatcacacatcctttagaggaaacgggttggagagttgaaactaaaattcttcttagtaaaagaaaaatcaaattccaggcatttcttctaatacacataattattgcctccatataaaacctccatgtgagatggcattctataaaaattcatgagcaggccgggcacggtggctcacacctgtattcccagcactttgggaggccgaggcgggcagatcacctgaggtcaggaattcaagaccagccttgccaacatggtgaaaccccgtctctactaaaaatacaaaaaattagccggatgtggtgatgcatccctataatcccagctactggggaggctgaggttgcagtgagctgagatcgccccattgcactccagcctgggcaataagagcgaaactttgtctcaggaaaaaaaagaaagaaagagaaaaactgatgtgcaaacttttatccataaaactgtgggttttttgttttttttttttttttttttt

SEQ ID NO: 95370 - DNA, 1100 bp, Homo sapiens
ttagacagtcttgtattccagcctcatgcgcggctctgggaatcttttcgtgctttgcttttcccatctgtaagatgccaaagtaacaaatgttattggaagttatctagaaggctcagtaaccagaacttcctttcattctgcttttctttttctttttttttttcttctgagacagtctggctctgtcacccaggctggagtgcaatggtgtaatctcagctcattgcaacctctgctgcccgggtttgtgcaattctcctgcctcagcctcccgagtagcgggattacaggcacgtgccaccacacctggctaatttttttttttttgtatttttagtagagccggggtttcaccatgttggccaggctagtttcaaactcctgacctcaggtgatccacccaccttggcctcctaaagtactgggattacaggcgtgagccacagtgcccggcccactctgcttttataatagggagaaatttcacataagtattaagtgagctaatatttaactttcttattttattaactacaagccatatttacaagatgtagaacactgaactaagcactgtgagagataggaaaataagtaagagtactctagacgtcagaaatgtattctaaataagaaattcaggaggaggtcctagagtgagcttagagtaaattctatctcaggcatctctacagtgctatagaatgtggttctcaaaatacttggtctcaggactcccttgcagtcttaaaattattaaggaccccagagaggtttctggtttacatccatcagtgttttgccatattagaaactgaaactgaggccgggcatggaagatctttaaaatagtgatttaatttgtttaaaataataataaacctattccattcaacataggtaacatcaaaaatgaaaactacctatattttaaaaaatcatttagcaaggagaatggattttttttaatttttacaactctctttaatggctggctccctgacttaatagacaggtagattctcatatctgcctctacattcagtctctcttgatatattgttttgatcgaagtatgtaatgaaaatctaacctgc

SEQ ID NO: 95371 - DNA, 2996 bp, Homo sapiens
ggtttacccccacctaggcacttggtacaagaccagagtgtctgttttcttattgtgaaaagaatacctccttccttttttttttttttttttttttgagacggagtctcactctgtcaccaagctggagtgcagtggcgtgattctcctgcatcagcctcccaagtagctgggaccacaggtacatgccaccatgcttggctaatttttgtatttttggtagagatagggtttcaccatgttggccaggatggtctccatctcttgacctcgtgatccacccacctcagcctcccaaagtgctgagattacaggcgtgacccactgtgcccagcccacccccttcctttctaagtgctgagctattcgggagcacacagggctccattcagacaggccccacagtgtttctttggcaggtaggaaatgtgcatctaatgacaaatcaatactgcacccagattcaaaaacaaaaaatgtattgatttggtagtatagaaatctgatcttttcatgtacttcagaaaagaatttgactagaataatgatagtatggcagctgatggaaactgctcttctcaagctgctaatttgaaatatatttgttagtatcaggatattcccatttaagagtactgtaaattctcaaaccattaataattggagggtttgtttatctgaactctctgctatgaaaagttttcttaaggcaaaagaaagtcgaatgtttactttaaaaagatggttaaaatgaatacaaaagagacttcctctaatggacttgctaagagaacactaattaaaactctcctttgtaccctgtatttccacagtggacattataaaggacaagcaagccccaaatgttaatgtccagttatgaacaaataacttacagtgttgtcctatgctcagctgctaaggggcctcttcacctcctacccacaaaaagcctgccctcctctctgtgtccccagcaccccattgctaagaccttggctccctgtctatcttgagtgcacagtagatgtgatattctccctgatcctgcctttgtgttactttgttatgtgtgtgttacagaggatttctgctactagtcatataaacttgtactcttaccagtattagagtatcataacactacaacaatagagttaggggttaaaatatgcttcagcgtttagtcccaggaatcttagctccatttataatattgtgtctttgggaatgtgttctgagttctaagcaactggcttatacacacttataagtagggagatattcagatgaggtcttgaatattgctgaaaactttacatgtgtctgcacaaaaccctcgtaggttttacctctgttgtcaactgatgtcttcattgaatctgaggactctgttttgtctttatatcaagggggaaaaaagccatatgccaagcaatgtactgccttctcattagtcctactgaaaatgtttttagcaccctgcttgtagatgtctagatctttcctctaggcacataagatcctttaggatctgcgtaacatcatgtattatctttatatgcctgccttttctaaataggttatctactataggccagcttttcttactgaatttatacttggaaaggtttttcgaaacttacgcgggattacattaatgccattggtattattcctaagatttatcatcctttctatattcagtacagaaacagaggatctgtgacagatattttggcaactctttgcaccaatatagagacatcatatagcattacaagcatagtaaaatattagaatgaataaatgtgttttttcagggccagcaaaaaatttctcaagtacataagcctaattgaatttcttatgttcagaagactcaaatatttcattttgatacagtgacttacaaattgtttttctagattgagtgctatatttgaagtaaatacagaccttcaaaaaaatataatatcaaaaatcactgctgagctctcctggccttccatacttagctcaccccggcacttgaaatttccacttactaatacaaactgctcctcagtaagtattcaaagtgacattggtttttggaaatacatactaggattataaagtatttactcttagctttaactatagaaatctttcatttaatgtttcattattttgtttaaggaagaagagattactttagaaaatcctgcagatgttcctgtctatgttcagtttattcctctggctttatattccaacccttcagtgtttgtagataagttagtatcaaggtaagtattgcttgggatcatcacagtgtttctatgtagtattgaattagtattttattcacttaaaaagccttatttgcagctcatacagattaatagatttgacgagaagttctggatctataaggttgagagaaggttttagggaggtttaggttgatactgtgcaaagcatccagaaaaactttcaatataaggcaagaaaaagtaatatggaactcccttctaaaaatgtgtaaagagaaagtagatgaaacctttcaaatattctagttttgaaaagtgaacaaaatattaattacaagttgtggcctttaattttcttaaggctataaatctggtcatattgatctcaaaacctgacagacaataatttgaaaataaagcacacacctgataatcactccataactcccttaactgtgatgttgcttatgaataaatatgtgtacattttttgttttaggtttaacttgagtaaggtggcaaagatagatttgagaacactagaatttcaagtcttcagaaacagtgtaagtattcaaacttcatactattccaaagaaattattttataatatgatcaatataaatatgaaagaaaattattggctactcttaaatttggctgaagggtaagttactgaagaagtcagagcagtccagtaattatttcagaggcaaaataaatcaggaagagtaggt

SEQ ID NO: 95372 - DNA, 1067 bp, Homo sapiens
gtttgtttgtttgtttgagatggagtctcactctgtcacccaggctggagtgccgtggtacgatctcggctcactgcagcctccgcttcccgagttcaagtgattctcctgcctcagcctccccagtagctgggactacaggtgtgtgccaccatgcctgctaatttttcgtgtgtatttttagcaggaacagggtttcaccatgttggcctggctggtctcgaactcctggcctcaagtgatccacccaccttagcctcccaaagtgctgggattacaggcatgagccactgtgcccagcttgtgtactgttttaataagatacttgacaacccataatttcaaaagatgtgtaatttctctttgatacaaatgacatatatttttcctaatgaagagactttcttttaaaaaaaattgtgattttgtcccctttggctttagattttagaattcagtgatttcagggcattcttgcctgggtgtaaacaaaccttgcttaccaaactgaaagtaaccattccctttatctaaagctatctctgtttgtacctttgttggcatcctcagtatcttaacatgaaagtgtgaatgttaacgtcaatcagttgtcacaagattgcaaagatttgtcctcctgatttttctgtaacatgccacagcaagaaaaaaaagttttttggtgaggttttttggctgttgattacaatttaaagattatcaattgatgaacattctaagatgtcttttgggctttggtttcctagaagtatgcttgtctactctgaaacttgtgatcttaagaaaatttaaccatatacaaatgagtttgttctttgctttcttccttcaggggaaaatagttcatcaaagtttaaatattatgaattccttctcacagaaggtaaaaatacagcaaatacgatctttgtcagaagatgtgcgattttactataaacgattacggggcaataaggaagacttggagccaggaaaaaaatcaaaggtttgaagatattatatttgagaattcccattggttaacattttgttttatgacctcctgt

SEQ ID NO: 95373 - DNA, 1084 bp, Homo sapiens
gtaacaatagagtgcctggaggccaacccgcagactggccagagtccatgtgaaaagtgccaaggggagtttgagcgcatggctgtggctgaggcagtaaagtcccttcatacctccaagcctttgttgtttctttgcctcgaatgcccttcctcctgtccttccttcaaagaactcctgcgtgtctttcaagattcaattccattgtcatctcctctctgaagatttcttgactcctctagacaatactggttgtttcatgtgtgatcctagaatactttgaaattacccctcttgctgcaagcctcgtattgtgctataaatatttccttataagttggcctccccagtgagagtctgagatcctctaggaaacggatgagagatcgtttcttcccaatagcaggcacttagtacataatgtatggatgaaggaacaaatgatggagagggaacataggcaagagacattgcaggtgaatcatttgaactgtgcttatatcctaaagaggtcatacaaactgaaacaagtatggggaggagggtgggtagaggaggcaggaatatggcttagagtttgagcctggagaacaaagacaaaacaaatgagaaaaccaggagaagatgctgccttttgcaagaagatggtgcagtccattcaggaataccagggcagatgtaaaagtgtctcacatcctagtggtaggagacagtagtgggttaagagaaacaagacattgcaaaatcttaatgctgtatgcaagttgagcatccctaacccaaaaatctgaaatccaaaatgttcccaaatctgaaacattttgagaccacaagtggaaaattctacacctgacctcttgtaacaggttccagtcaaaactttgcttcatgcacaaaattattttaaatgttgtataaaattaccttcaggctatgcatataaatgtatatgaaacataaatgaatttcatgtttagacttgggttctgtccccaagatatctcattatatatatgtaaatattccaaaaaaaaaatctaaaacacttctggccccaagcattttaaataagggatactcaacc

SEQ ID NO: 95374 - DNA, 2394 bp, Homo sapiens
tattaacattacagagtgacatccacagcttgaagcagagccagctgtgtatacaattgtggctccagtgtgcctgaaaggttggtggaaggctgtgtccctctgctccagcccctttggccatacaggtccatgggtaaagagtgaggagctttattagcaagaggaccacacccctccctctttcaggaaccagctttttcagtggcccatggaacaagtgtagtagagaaatatcaagggatggacactattttgagatatttgtacacagtgatatggtaattcagtgtcatactggtatatgttaggatttgttagtcattttatcgctacacccttcatgtccattttaataggaaacttcaactaacaaggctaatgaatgataccatttctactatctacaggtaacattagcttcaggctattttgcagtcttcagagtcaaacttactgcaaaaaaattagaggggattcatgatggagccatccagatcacaacagactatgaggtaaggactttatggggattcatggcagtggggtttttctgaataagtcagtcctttcttgtctttatgaaaccaaagaattaagtttactcagagttacagtttaccagtttcataccttaaaaactgagctttcgagaatagtttatagaatattgatgttcataggctcatagttttttgataaaacccaaccctcctaacctaaaaagcaacttcagaagaatgcctttagcacgtttagaattgctttgttagaaacctgcttaaacagatggttatatcattgcacagaccccagctgagtgtcctgagttagatacctctgattgttcctacaatcataaatagcagtcagggtctaacatttctgaaaaggaagataaaatcaggagatcatgtcctaatctgagtgctcacatttatattttcatgagtcattcaaagtcaagggactaaaggttactaagcttttaattaaaatattctgtgtggagcttattttgcattcagtaagattttgaatggatgtatttctgccagacctaaatgtttttaattgtatatctaaaagctcttaggaaagtcaagcactgttaaattcaacaacttaccacctttgccctcatagatgttttcagtggacacaactcccacgtggaaaaaaaatgtaattataaaataaacagaattggccatttaataataaatgatttgttgagagtatgtcaggtgaggaattcatggttatcactcatgacagaaataagtacatttcagaattcagataaatttttgttaatatgggtgaaaataagaattaagaaaaataccctagagaagtagctttgagagttactaacagtatgggatgggattctaactctagaatgttcagtgcatttttaaaaattaggttgatgtctatttctgtatcaaaaaaaaagctatataactctagatatgctggattttacatacattgttttaggagtacagtttgactttcttttttaaaataatctatttttatagattatttgtattttgaaatacaaaaatatttgtatttttaaaaaatctgtcttcattgcttccccgttgtttagtcttttttacgtgttttcaatgaatcactgagaaatctgtggaaatgtgttatatttcattacattttatggagtacattggacagattaaacagtatctatgggtgattttaatattggtatggagctggttattgtcaatattagtcccaaaattaggttaaccccaaaatataatgcaatagttatcaagatcaggctaagtcttaactacttatctatcatcatcttcttgacttcacagatcctgacaatccctgtgaaggctgtgattgcagtaggctcactgacctgcttccctaagcacgtggttcttccaccttcctttccagtaagaccattaatacacacatttttctattgctcgttttttgcctttgcctttagctctgtgttcctagaatcttagagtaaagtcagttattctttattagtcatttattttaaagacattataccaggttctttagaagatgtaaagagatacagtccttttcctcaaaaagttttctatctagaaagggaaatggacccacaattcagagctataaagcggaatgtagaagttgccctaagaggagtgaaaataaagtgctgtgagggaaatacacgtctcactgatgcaggggctatgggagccagcttagaatttcttccaacagagatggagaaggggtggcagagacgtgaatctagggccagggcgcaagctcaacagggatgcagaggcagtaaagtctgaagttggttcaggcaatagtgagttgtcc

SEQ ID NO: 95375 - DNA, 1770 bp, Homo sapiens
actattgtaataatggggaatatagaaaagaactaaatagaaaaatgataggtagaaaaagaataatacaaggaaggtgaagagggatatacgtagggaagagatgatcaaaaccaagaaatatcgggacaaagaagagaatcagatagtaaagaagaaaataaggtagtaaagacgcaaagttggaagattatatatgacacagaaggaaacaatgaaggtactcctggtacagaaaataagcagggggaaaaattccaaacaaagctatcttgagagtgatcaatgaaagaagcttagataagagagaaaactgttaggaaagataaaaagaaagctaggacatctagaaatgtagccctttaaatagttggcatcgattagaattttagagctggagggaccttcagtaatgtctcgctcctgcttcagttattttgtttcagtgatcattggtgatgcttgctgagaccacatgctttttgcccgatcccctagggttccactaaacctctcttagtagtttagcttcctgcctctttcatgtgccctcagaggaagaatagcaactcagcagaagccatggctgttttcatttctgattactcaaaagactttcgtcatacaaagccctcaactatgtcgtataaatgtgtggttttatgcatatatacaaaagcataggaaagcatagaactgtaattttttttttttttagatggagtctcgctgtgtttcccaagctggagtgcagtggtgcaatcttggcttgcgggttcaagcgattctcctgcctgagctcagccttccgagtagctgggattataggtgcacaccaccatgcccagctaattttggggggaactttaatacatctttaatatagttactttctcttcataatattgttagatcaatgtgacttttttttaatctggttcttttatatctttccagtactttgtattgccccccaaaatagaggaacgtttcatagattttggagtactgagtgctacagaagcaagtaatattttatttgcaattataaacagcaatccaattgaggtaaaaacctgtttttattctaaatcacatttaaggattttatgcttgtgttgtgataatcattttcatatctttttttaaagttggctataaaaagttggcatatcataggagacggtttatcaatagaacttgtagctgtggaaagaggcaatagaactacaataatttcaagcctgccagagtttgaaaaatcctctttatcagatcaatcatcggtaagtaaactttctattgtctccttaaagtaagatggatgtctaaactgcaagtggaagatcattgctatgctacatgtatcactattatttttatgcagttcataatagtgttggttacttgctattaaaaggaccttataggtaatgtaattcaaccccctatttttatgatgagggcactgaaacccaaaggggtttaattctgccttgtcataaaaagttctataacacacaaatttttaattatctttttgtaacacaagtgtcattacaggagagattcccatgggtactaaactaaccttgtgttcattgagtttactgggaaaaagagatggccctgaacattggtagaaaatattttcaattatgcaataatacgtctgtccagatactgcctcagtatcagtgaggcaaacattgtttgatcactgtgagtctgcccacatatttttacctgtctaataaacatgttacagtt

SEQ ID NO: 95376 - DNA, 1597 bp, Homo sapiens
atttggaagctcaactttttttttttttaagattttgtcaatttacataaattcactaattctctttggtagtaaaaggtaacagagattattttttatgcttcctttcagcatcgaaggcaaaaaagccatctcagttttctgggaaaataacagttaaagcaaaggaaaagagttattctaaacttgaaataccatatcaagcagaagttttagatgggtgagtttctttttaaaataaattctattactttttactaatcagtaaattatattttcctgctaaatgacctgcagaaatactagccacgttcacataaacttgatggaattattttttgaaagaacagccccaactataaaagagaaaacctcctatattttgtttatattttacttttttagaagaaaagggtaagtgggatgataggatttgggcttaaatgaagacttaatgattcaaaaatctgattttttaaatattatttaaatcatttgaaccatttcctttctgacatttgtttgtaatatgtaagtgattgtggcctattattaaagtattttgacactcgaaacagaattctttatattcctttataaattcataaacacttctagaattacaactttttataaatgggaagtgacatgttcattttctattgtactttaaccaatagtagtttaatactcaacttggcaaagattcattttagcaaagctccttgtaattcagtgataagcatgatttttttcaaagtaaagctttttttgttgatatgtctttgattctaattgtatgattcatataattcattagagaatggttgtttgtattaatttcagtattttgcaagctaaattttgttttaaatcatatagtcaatcactaaaatattatagttctaaatctttaatacaatccctaatgctaaatgtaaattattacttacaacagaagaacttggattttaaattaacacatggaaataaaaatgatttattttgttcttgttgttttttttaatagttatttgggatttgatcatgctgcaacattatttcacatccgagacagccctgctgatcctgtggaaaggccaatttaccttactaacactttcagttttgcgatcctcattcacgatgtgttgctaccagaagaagccaaaacaatgtttaaagtatgtccaggagccctcatacttttaattttcctggtctaccaactaggtgatgctgacactttgttttttttctcttctgtcatttctcaggttcacaacttcagcaaaccagtcttaattcttcctaatgaatcaggatacatttttaccctgctttttatgccttccacatcatccatgcacattgataacaacattttacttattaccaatgcttctaaatttcatttacccgtgcgggtatacacaggctttttagatgtaagtatattatccatctttaacatttaaactccctgcccacctttaatgttttcagatcttattaggcagtcgtgttacatacggtttgccattatttgtgctctgcaaattgatctaattctcctagtcagtttttacctttccag

SEQ ID NO: 95377 - DNA, 1012 bp, Homo sapiens
gccctgcaccaacccagggattcttgtttcattcctacctgttgatgcctagctattaaaacatcaatattggaaatttcattagtaaaacagagaaggaggttggaatcttttacgtcccttccaattgaaagggctttgtgtcagtgaggaaataaaaaataactgtaccttaaaatgtatttttaaaaagcatgctctccaagtacaaggttttcctgtttgttgttatttaagcattctggcttcaagctgaacatccctgtgggctgcctcagtgctcaatcccatagccagcagtatagccctctctctggatagcagcatgcctcactcgcagagccatgtctagagagaaagagaaaatgccattagaaatgaagtgtgcagaactaccttggcactgacacaccagcttccaagttcatgtttattcttcaccgtcatatggttcagatatttcctcagtattgtgaatttctttaagagggatccataagtctttttcatgtcgcctccactggtgtgtgaattaggcattcatttggaaaataagtaccttttttaaatgctttatgtactcacaccaaatgtaatagattcttacacttacaaatctgtcatgcttattctctggtcattttcttttataaagatattctgatgaaattaatttgaagttttccagtgtggcctactccatttaaagggacaacataagttaaacttttcaaatttagagtccactttacttttccagtatactttccagtataagtataaggcaactgaaccattagtctgaaataatgccatgtatgtatttttgttctctttgcagagtgttcgacctacaccacaaaatgatgctataacggtacactttaaaccaattacattaaaagcatcagaaagtaaatacaccaaggttgcaagcattagttttgatggcaagtattcaccattttctctctgatagagtgatgttattttgataaactagaaagcatct

SEQ ID NO: 95378 - DNA, 1648 bp, Homo sapiens
gagaaatcctttgagagtttgtggtagtaggataatgatgtagataaacctgctattctggttcctgtagcagtggccatctctaaccctataagtaggggtgttagttgtatggccctgtgctgagacacttgagctttgaggggcacagaccctatgtctgatttccataagattagaagttaggataatatatgttacactttttttttttcataattgagatttcattggttgaggatcgtacagacatttcaatttgtacacaaatcttaacatacataacgaaattctaaaaagccatgtattgtaattattttttaaagttattccagtgactttccagcttaaaatttggaagcaaattttccttaagaggctatcaagtaccagtatcttcacatgttggtcagctgttacatacagcccaccagttcacaactcaatagcacgtacactacatattcaaatttgtaatctttcacagcacagtaacaaagttattaggaaaacaggactaccacaaccaaagatgttacagagtgcacacaattctggcagagagagccatgatcaaagagtggttttctttaggaaacaattctactaaaaaacaacatggtaatagaagtaatttaaaatgttcaagacattaaatgcaggactgactccatattgccatttaatatgctttgtattataggatataaaaactaaccccccatctatggaatgttaagctgacacccgagacaatcagagcctcccataattcaatatcccacactattttctggttgtaccaaaaaataaacaaccagcaaatgatttcacctcttaaaaaaaagcatttacacttaaaaaatgggatgaggtgggattccctccttcttaaaaatgtttctagagctactaaaaaacttgcatttacaaaatagttgataaaaatattcctctggattgtacaagaagggagacagggaccactgataagacatggtatatggttattaatcagacttggcttctttctctcctgcttcatcagaggctggactctcctcagttttcgtttccccattttctgcaggtaaatcttctttagtttcttggttagccacttcggcctgttttccctttgctccccttttcccttttgtttgcacgtttttgtctgaagatttatccttcgctgctgcctttttcggctttgcttccacttttgcaggaggtttagctgacaaccgcgccgatctcctcttgggctcttccttggcagcggcttcagcggagctgaccttcctcttgggcatcctggcggcggggaaggcgcgtgccaggtgcctgcgggccgcggcgcgccaagagccttcacgaaactgggctgccttgccgctgccactcctccccaacactgttaacttttagcaaacttttgttgaaaaccttgtaagtttgggattttaaaatttttttttttttttttttttttgcttatcacttactgaatacccattgtgtctttttcccttaattgcttgggaggaaccatctatcgtcctgtcctgaagggagttcctcctaggtctggtcggacctttgtatagtaattagttaagatttagatcccctgttaggaaacctgctg

SEQ ID NO: 95379 - DNA, 1619 bp, Homo sapiens
ccagactggccaacatggcgaaaccctgtctctaccaaaaatacaaaaattagctgggcatggtggcatgtgcctgtagtaccagctactcaagctgaagcaggagaattgcctgaacctcagaggtggaggctgcagtgagccaagatcacgccgctgtgctccagcctgggcaacagaccgagactgtctcaaaaaaaaaaaaaaaaaaaaaaaaagaggtatgtgaaacatgaaagtatattatacagtgtcacttagcaatcacatctttatgaatatatcattttaattgcatagtctatttctgttaaaaacctatatatctgttaatataatacatctgtacctacatctgtacctacctatgtgtgtatcttttataatatccaaagcccaaactctgccagtgttttggtagttttctcttattcccgccttcattcacccattcaataaatatttaatgaacatcaactgtatgctagctgctatgctgactgagaatacagcagtgaatcagaccactggggttccctaccccatcaagctcactgtttatcagggctctctggaactctgggagatatttagattttattctaagtgtaatgggaaattattacaggattttaaacgagagtgacatcatctgatttatgtgttgtaaaaggtcactgtagctactttgtggagagtgaacttacagacatggaagggcagaaagcaaaggagaccacttgggatctgatttagcaatcagcctgagaaatgatggtggcttagatttcccaccttatcagctatggggcaagcccacctaccgtggaaactgagttttcagagctcttcttaaggttttccctgtgtgtttcagcattttctgcataattcaccaggcttagagactatagatatttagaaaggttcctgtctccttttgtttcacaaacatagaattttcaggatttgctaagcagtgctagaagctggagatcttttttttaaattccccttcagggaattcattctctttctaaatataggattactaaagcaagcaattccaaatagaagttcctcaactgctaacagacaggatgcgcaggtccaaactctcctaatatgtctataatgcaactttgagaaaatggctttcctcagcatttacaaaacattagtgctgtataaatgatggagtaagtttgcctgagatgccttcagaggaatgtttgcatgaggtttcccttggtaattaacaaatcggaatcataatatcagcttaacatatgctttagtgaactcatacacaaattattagaaatacaatgttaaatgctgaaagtgcttttttccttatttgctcaagtgcttttataagcagttttagaatgttccggaccgttgaatttcacttgagggttactgagcattagttgggtctgaatgttgtgagaaaagcctagaactatatttagaacatatgcaagcttgcgaactgcctttcctgggaaacttgcaatagttttatacttcttgattatctttgagttagcaatagtcactaacaggttgttgtataaatatgcttactacaaggtgttgattgtgtatgagtt

SEQ ID NO: 95380 - DNA, 1269 bp, Homo sapiens
gcaaaaaaagatatggtagttcttattcctacaaacctagactgagaaaaaagccaatgggctgtgacctcacctccagcctatttcggtgtataggtgaaaaccccagagaccaagtcaactccctagagctggggagtggatggtccatccctccaatcttaggagggtcccaatcacctgttttctactttgggactaaaaaagagagtagggataagtgaaggccactaagctgtagaacacaagaatctcctaaaatatgctgaaaggtttgtgcagagaagaaattcaggcagtcccagggagccatattgttctgaaaccaggaaagagattactcctcaaaattttttttccagtaagtcttccttttagtatataaatgttctctcattacgggactgaaaatgtatgctgtcttacatgaatgcagttggtaaactgtggatttacttgagaagctttgcattgttaagttttccatgaaagagcagtgtaagccctgctggttatcatttatgaaggttcttgtggacttctagaaaagtatttacctctgatggtgacatttctgttggttaaatttcaagactgagttatatacccaaacaccactaactagcatattaaaaaataactgattttgtagattagttttaccttttaatggtgattttgtaactgacaatttgttttcagatcatttgacttcttttgctttgcctaccttacatatcgtatttcatcaattctaaacagcacatttttcacattttaaagttctccagaaatggagtgtgtgttacatattggtttaattagcaatgcattttttttattaataggtatatagaatactcatctttcagtcagtgtcatccagttcaataaaaaatggtggttttgctacattacaaaagctgtgctacattatggtctgttaacttgtcaggaaattcctccttatgaaaccaagggagtgatgagagccagtttttcatctagagaagcagataatcacacagccttcataagaataaagactaatgcttcagacagcacagagtttatcattcttcctgttgaggttgaagttacaacaggttagtggaaaactgatgaaatcgaaagttgttttgttttcagtatagcttactctggcaaagtgaaaaataattgttgacttttcttttttccaagctcctggaatttattcctcaactgaaatgttagattttggtacactaagaacacaaggtaaaaaaa

SEQ ID NO: 95381 - DNA, 1048 bp, Homo sapiens
cagagggattttttttttaaatctttttattggtatccagtctgtctccaatactacgatgtaagtttcatgagacccagcacattatctgtttttttactgttgaattgttcactattgtatatgtgcctagcacctcatagacacttaataaatagcaatatattaataatatcatttgaattactggtttaccctgcttagtcaacctagggccatcccatgtgggaatgacctggggctgggcttggtatttgagaggttgtctgggccgtagatccatcttctgatggttggggtcaggaaatcttttgactccctattttcttcttttgtctattgcatggcttcttgaaggactgttattcaatttctaatatattaaagaaatcattctaaattcacatacatagtcaatcaaatatgtagccaaatcatgtacagaaacaacatttgtgggggttttttttaaataaagggattgttaattttttatacataaattagatttgccagtctccctagatcagtcagttataactaaaaatattaattataaaagcaactaaaattgcatttttttcctccactgaaacaggtatttggtgttggagttccaaatccatatcgattgaggccgttccttggggccagagtccctgtgaatagcagtttctcacctataataaacatccacaatcctcacagtgagcctttacaggtgagtttatgatggtaattttgaataagcttcattttggtgggaattaatgcttagcatgaaatctcagtttgttacagtttccaagactatttaaaataatagggttttatagtgtattgagaggggtattacttttagtacagcttgctgcagtctgaattttggaatacagcagtctgaattttggaatacagcagtctggattttgaattttttgaatcatttttaaaacgactgtgtcttctctggtgttatagtttaggcagctctgcatttaaagaagagtttttagctacacaaggctgctttttttcttgcctgtaa

SEQ ID NO: 95382 - DNA, 2296 bp, Homo sapiens
actgtcaaagaatgtgtccatttctcctagctgttaaatttgtgggcatggagttgcttgtaatactcctttatcattctttttgtgtgtaaagtgtatgcaatgatgtccacattttagttccttatatttttgacttctccctttttatcacagtcactctctgtagagttttatccattttatggactttttgaggcaccagcttcggttttattgatttttttttttttttgctactttctgttttctatttcattaatttttactctttattttccttccttttgcttactctgggtttaatttattctttttctagtgtctcaaaacagaaatgtagattattgatgtgaaacatttctgttcaaaataagcatgtaatgctataaattttcttccaagtattgctttacctgcagcctacagattttaatattgtgctttcatttccaatcaattcaaaatattttataatttctcttgttactactcatttcacccgtggcttattttagaagtatgttgttgaatttcagactttttgagggtttgccgggtatctttctgttgctaatttctggctcaggtgtgaatagcaccagtgtctacagcttccagggcttttgtgctcccgtgcaagttcacacagtcaacctctagcaatgtgtaaacatgttagctgcatttctagctgacactcctgtatgatagcctcatcttcttcccttctctgccatgggtgagccagtattcccattctatctgtccttggaggtgcttgtcttttctacgatttcaggctagttgataatctcactctgtgatgggttcaagaaaagttgtgaattattgtaattattcttttgttgcactacattaccgtaatataatgcaacaaaagaataattacaataattcacaacttgtaagttactcttttgttggtggtaatgtaggagacatactctcgctttcttcagactaaggtgaagccagagtcttactaccatgtattttgagctatcatttaggtagcattttagagttctagccatagaggcagaatgagagaggttgatggctttacatattaaaatgcactttaaggctttgtttcagggcagaaccgcaatttcagtctcttgaacatgggagtagccctattgttttgtggtaataacattttattttactaactatagtgacattcttaatctgcagaaagtaacaggagtgagttcctgcacatacattcacccctgccttctttcctatttaagttgctgggacattttgttccttgtgtggatggaaggcagatttcataaggttgaggcctgggcttattctttggactaaaacaagtcactgcttagtagtacagcagtatatctatatgaaaactcagcctcaacgcaactcctatctgattgtctcatcgtggaacagcctgtaattaggtacttcatgccagcctagtgattgttaaatgaacagaatccaggaaaccatctgttgtacaaggctgtggctggtaattgacaaagatatgtgactgtagacattcaatatggaagacatctttttaattattttccactgctaacttaaagcttaaacttttaaaggaaaaactagtttatggaagtgattctaagaaacttgtttaaggaacttgagctgtataattttttttcttgttacaaatttaactttattttctgtttcagaaaattcttccaggaggaaatacatcatttgatgtagtttttcttgcaagagtagtaggaaatgtagaaaatactttatttattaatacatctaatcatggggtatttacttaccaggtaagaaccagaattaaaacttattttatacaatataatcattacctctgccttatcatatgacagccttttaagaactcaggaactcaaaggataatagaaaatgtaggagtttagacttagagcatttttatacttacagtgaatatctctattcaatatctctattcaaatcagactgaacaggtgattttaaagcaacagctaaagtgttaatttaagattgacaaaagaatagtgaaaaaatattttcatgctgacttataaaattttgtttaatttttacttttacacacttatgaagcatacttgataatagtgtcaagattaaaacattcatgtctactttcctttagtaggtattttttgataaacttatttttacatagaattttggtttaggtcattaaagaaagttaatgtatataggagtcatatagtaaatc

SEQ ID NO: 95383 - DNA, 1481 bp, Homo sapiens
ttttggggggatctttgtggaaatatcccttttctaaattatttcttaaaatagctttcccttgagttattctttgttatctaaaagatatttccacactttttataaatgtgctattaataatagcctccaacaatataattctaatgctgtgagagacctgtgtatacacaggccgagctccagagaggcctgttccagtcatgcagtgagtgacaggtgccaaggtgaaggtgtcggtgttctattatcatccccagtgatttatatcatattacacttcagtgagtggcctgtacctaatagcttctatagagagatgtatttatgtgtaatgaaaccatccagctttcaggcattgtcagtatgcagagacaggttaggttaaagggcaaaattgtgaagtaaaaatggaatcagttaaaaaatagttcacaattgcactatacattttatttctaacttgttaactttttgctaagtcaagcaatattttgttgtttctgaacacttcaagcttcacctgtgttaaaggccagggtttttatttttttcattgctaccgtaatacagagactagaacaagagttgcaaacagattcttaaactgggctaggtaaacaatataaatgagggaagcaagccaagtgggatgtgggggtgtcctagagaacatgtgacccattcgaagagatcagcccccaccgggctccagcccagtggttaccatgttgggagtctaagcccatgtgcagttctgctgattcccaagaagagtcagaaataagaagtttcatgtatctgccagtctttacacattgaaaatcagttcaattttagaaagacagtatgggccaaacaacataggctaaaggctactaacttgacgtttctgaactagactctcccagggactatttctatatatgaatgttaggcaaagagaatagtttctctggaaattttttaaaagataaactaaatgtgtaggtaatcaaggaacaagttaaccaatctgttttgtgctgtcagatgatggaattaaacaataaaaataattacacctatcaaaatccacatttaaatagtcaagatttagctcaaaggagatagccaaaatctttactctctcctcttatccttttttcttcttcttgctttgcatctttttttccctacaataagacactgacttaagctcgagacgtagaggggagagatagaatgaactcttgggggaagaaataacctatttcctctccacttcagctttatgccaacaataagagccttggggaaagatgaatagagtttcttatgtcgaggagagcaaaatctttctgtatgtttactctaattgcctttgtcatgctcggaattcctggtcaggtcttatttctttgacaataaaacattgtctataactcagagtttttagttattaactgttatctgtacgttaaccaaaaagtaggaaatac

SEQ ID NO: 95384 - DNA, 2062 bp, Homo sapiens
tggagtggggtaggtgggaaagggtggcatcagcgattcaagattttcttccctaccctcttcattgcctctttcagtgatatgaagttaaaaccaaaccaagtactgtgagtgctcacctgatttttggttcttatgaaggtgatttttttggcatagagagttgttaaatttagtatttctgtggggagaagggacaatgaaggtggagccttctatttggccatcatgccctgcccttccacctgcattccattttcttaaactattgaaaattatcagctgttcactgtttatcaactttcccaagtcttgaattagaggtgagcaactaaattgaagaaaaggtagagacagaacttcttgaagaacaaaagcatggtggacagttgaacgaaatataaaatgaagttctggctctgcgttttcaactgcttgggatttgaggtttatatgcatactttaaatgtgaattacaaaatgtaaaatttcgaaaaccatggaccaaaatgattgcatgaggagaggaccttgtgaaagaagggtgtatatttgaattagaaatgagggtttggattggtataggaggatagggaaaaaaaacacagggcaggcagattagcagagccgtgggggacttgcccatggaactagcctggctcaggtggaaggtctggattgaaaacagggttacttgtttaggttgggtcatgtgagattaggaaggaacctagtaactagtgggtgtgtataggtagttagaaaaagcaaggaagctatagaagttaggaggcctgtaccaataagattagctacagaagtagtaagtggactatagaataaagtttcacttctaaggcaaaccatggcatggatgccaagggagtcattaaaatggatttgtggatttcagaccattgagtgtgtttaggtttgacaagaggcagttcagtactggcggttaaagcgcagactagacccagaagacttagattcacatccaggttccaagtgtgcctttgacaagttaattaacttttctgtgccccagtattctcatctatgaaatgagtatagtaaaagcccctaactcacaagatttcctcacacaactttgctactcagtttctgctcctaaaatgaagagcacgtatctgtggaatttgagaagaggacacaattggtaggaggccgggtggtggtacagaaagaaagaaaaggaactgaccattttgtgccccgtccgccgcctcactgggttctgagcctcagggatgaaacttgcttcactgtatcccagcacctggcactgtacgtgacataattggcactcaggaaatatttattgaaagactaaatgcatttttatgtgtaattttaaatataaattcagaaagcattttaatatatttagctatgtatttgtctaacaattttgattaattttttaacaactagaaataatcagaattatctgtgaaatatttgtgataattttctttttgttttacagaccagttggaatgccaaaaatggaaaaagtctacttacataatcctagttctgaagaaacgattactttagtatcaatatctgctacaacatcacattttcatgcatcattttttcaaaatagggtaagtttctctgctatacatgatctttcctgagtttgaagttgaaatgtctagatttttattgattaataacttgctgtgattagaattgggtttgaatatttcaaatctgttcctagatttgtttcacttcctaagaatgattacttctacccttaaccatattgtttttctcaacatgcaacagcttaacaaatcagcagtgaaccttaaatactctgaaaaaggtagcattcttacattcagtacattttattttccttcctaataataggtaattcctttgcattgtgttagttgtttcttgctacataataaattaccacaaacttgagacttgtggcaacagccacttagcacacagttctgtaaactgtaagcacactgggttgtttgttcagtgtatcaggctgaattaagatgtc

SEQ ID NO: 95385 - DNA, 1659 bp, Homo sapiens
atagactattgctaaaaatagatgtctttattgtcaagataaatttagtttatgaaaggcatttttctctgatgactttttggtattccaagaaaatcaaataggccccctaaagggatacttggtgcctcttagcttttcaattcctacctacccaatctttccataaaagattttacatcaactccccagctcagccttcaatctaaaatgtttttgaaaggaggatagtagtattttgcggtaattgagtggtacaaagtactgcatattgatttgacccgacttcctgcccaaaactatgcttaacagagtgctgtgtcactgtcattcataaggtctgcctcagggcagttgctaagccatttcttcagctgtttcctggcactgcagtgtcatctttctgtggtgtaggaaacttgcccttgaccacaaaattgcagtttactttccaagctagtctctaattcatagctgctgctttctaattcttttgagcctcagactattcgaaaatatggacagttcgtagttctgctgcagcagcacagagaacagctgtatgcctgcttcagcttggtttataaatacctcacactgtcccttttggccctacttctgtctttggacagccagtaatggaaacaaacaggaccagcactggcaggcatttggaaatctttgttttatttttaaattttacctgttcagccaagtagtcatatatcctgcttatgataggcagaattctaagatagaccagaattctaaaaatttctggcctctaatgtacctgtacatacattctcccaattattcaatcaaacaccaatctaggtgttgctatagaggattttgaaactgtaactaaggccccaaatcaattgacctttgagatagattttttttgggtgagcctgacctaatccacgaacctttaaaatctggctttagcaatcagaaacagaaatgtcaggtatttgaggtaagggagatattggatgcaagagagtttcttcgtgctgcttttgaaaatggtagggtcatatggcaaaagactgaaagcaacccgaattttatcaacaaccagaatgaacttaaaagaactttgagcttcagatgaggacacatcttgctgacacctgcatttccttgtgagacctcgagcagataaaccaggcattcttacagaattgtaagataatgaacgggcattgctttaagcctcaaagtttgtggtaatttgttacatagtatagaaaagcaacacattgtgagtttacaaatggtcatgtactttccatggtctagattctgctcatgtcaccaaaggaacggaggatggtgaggaggaaggcaagctgttcacagacctatgaggtctgtgagcaagtctgtccaaggagtgcccgctccctttgcttcctgtggtgtggactgcccagagctagaggcagcctgccctgtttgagcacgcaacgactaaaatagcctgctgatgtccttcctgacagcttccctctgttcttgttactccaagctactttgaacaacataagtagatgactcatctcctctgagcaagggttcattcatttctatgggatgtggcccatgcctttcctctttgatccctggaagaaagggcagggccagcct

SEQ ID NO: 95386 - DNA, 1021 bp, Homo sapiens
cctcaggttcagtccctgacagcttcctttgggtagaagagaaaattccctgaccccttgtgcttcacagatgaggtgatgccccaccctgcttcggctcgccctccgtgggctgtacccactgtctaaccagtcccagttggaaatgtagaagtcacccgccttctgcatccatctcgctgggagccgcagactggagctgttcctgttcggccatcttgccagcaattggtttttattgcggttggggagcaaggctggagtgggtttgcatgattggaacttctcactagctccgagagagaagggctttttgattggcttgcccaggtttggggctaaaggtaaaggggcatcattggggcttgaaaactatcaacagttgaatatcaaaaatggagttagagtctttctaactcatggcatcttctaaaaagtatcaggcccttcaggaagggtgcatctagaatttcccttgcttctttcttgaccccagtgctgactcctgtcattaccctgatcattcctactctcctgtagaatttgtttcacaataaacagatcaaattagctttctttgttttcagactttttgtttaaatttattctttaagcctacctgtattctctctgcccttcctccctttccctccccctcttttcttttccccctttctctcctcttctctccttgtaacaatcccatggggcaatctagacaccactggctcccctcccattctccactccccccccgaccccatttttatgccagtgctgttaaatgtttttctgtttccatagcaactcctataattacctgatggattcttcctgcctgctatacagacaaaaccagttcactgagaccatggtattgcaataaagagttttactaacatgaggccagccacacaggagatagagttattactcaaatcagtctccctgaaggcttggagattagggttttacaaggatagttttgtgggcagggggctagggaatgaggaatgttgat

SEQ ID NO: 95387 - DNA, 1744 bp, Homo sapiens
tattatctcaatataccatttttataacaatatattgtgcatacttcaaaaaattccattgaattttctgttattttataataaagaacatcaaaatttatgggtatattatatttgttaaattcacttatttttaattgttttaaactttttattttgtgatcagtgctgaaactgatgatttaaacacaaccatgactatttcctttcctcaagagagagtcctaatggaaggatatacagaatattaaagattttaattaacctttagcctagagaacagttcggtgtcatgaacaaggagcaacttaaagaaataaaagaatcagtctatgacaagtgaggaaataaatgggatttctcatagagactgttactagtcatagagaacctgaaatctcatgagctgagagaaattgtggaagatttgtggaagaagtgtgaatgggtagatgaactccagtacaagcaagggtcagttgacacagtaaagaaaatttatttgaagcatagcaaaggagtatagttatataagactgttccccaaagcagcggatttacatgctgctccaaaatagtggaaacagacaaacaaacttcgctatagtctgaatgtgtcctcccaaaattcatacattgaaacctaatctctgatgtgattgtgttcagaggtggagctttaggaggtgtttaggtcaggagcgcagacctaatctcacaaatgggattagtgaccttacaagagaggccccatagagctactgtcccctttctgccatgtgaggacccagctagaaggtgtcacctgtgacccagaaagaaggctccacaccagaacccaaccatgccgacaccccgatctcagatttcccagcctctagatctatgaaaaataaatttgtcatttattgtgctatagcagtccaaaaggactgagccaccattctactattatttaaaactttctggatcaagtcagagaacactgagcggagtttgttatatctcgcaagtgtagaagtggatctgtagaagtaggggttgcaggcaggtgtgaaccaacatgtgtaagggttcaatcagaggcagaaccagtcagattttaaatgaatgtatatgtatatatacacgcacatgggtttataataaggaattggcttatgcatttgagagagctggttaagcaagctcaaagcccacagggccagggagtcagtaagggaggatagcgggctggaaccccaagggcacagactgaagtttcttgtccacagataagtatccagggaagatcctgaggagaggagagaaattgcaggtctagctgctgtttgaagcctcttggctcagacagggcctaagctttctttgaaagtgcttcccagtgacaaagtcacagactcacctagaataatcgtttttattaacttgaaatcagcctattagggactttaattatgttggcaaaatctctcccagcagcacttaggttagtgtttgaataactgggaaaaggtatattatgctacaaaatagctgctgtctcacttttctcttctgtctctaaggagataatattacttttaactcaccctaaccagaaacatactagaaagggagttctggggactttagttcaagtcaagttgatatcacaaagctaccccatagatacaaacaaagaggttcctaaattttgaacttctgactctagaaaatgaagagagatatggttgaaagaatt

SEQ ID NO: 95388 - DNA, 2022 bp, Homo sapiens
atttttggtttggttaacataggattgtacctgtgtcaacttgtatcgtactcactcggatattaaactgttccttagatatagatctggtatggttttgaaaatatgcttttatttatgagggaatcatatttgatgtactgtttcttctatatcattctgtgagcactttgtaaatatcacagtaacagttgctggacatcacatctttgaagcattttacaggagatcttagcacaagacataaaaaataaaacttatctaaggatttgaaaggaagaatcaaattgttacttgcagatgatttgtctacagtgatcatccaagatagtgctcattttggcagcacatatagcagcagtggaaaatcatgagagaatctagacagactgttggaattaaactcaccaaggtgactaggtataagatcagtacgtgaaaattagtaactttttaatatgaacagtatccatgtatagttactttatgacatctccatctagataagacatctaaatttaaatgtctaaaacaatgctcttgaaaatctacctcttcccacttccaacccactcctcccatgtcatgactgtgtatccagtgaaaatcttagaatgagttatccttgatccctcaaaatcaatccatcagcacaacctgttttctcaagcttccaaatatattcagaaaccagccactgctcgctactctcccttgcagccaccctagattgtatctgccgtcaccagttgcctggagcactccaggacttccctgcttcccactgttgggctcctacaggaacttccttggtacttcacaaagtagccagaattaaccttatgatatgtgtcagatcatgctactccttgctcaaaaacactgtagtttgttacactttgaataatctatactcctacaaggagacctggctcttgtacctctgagctcagctcctacctcctactcctccctcactgcacagtggtcacttcagcctccttgttcaactcgccaaatacattactactttcttcccctagatctctgtcgttcaggtcttggcagcagtgtccctcctcagagaggcattttcggttctaaacacagccccgccgtgtttgatttttctttatacacacattttcacctaacatattcaacttttgttccccctactaggaggttagtgccatgagagcaggtgcttttctttattccccactgtagccccagccaatagacggtaactggcatatagtaaacattcatacatttgtattgaatggatggggtatatacttttttaccccacctggccactttagacatttccatttgtaatttgcagaacagcctcttggctctgtgagagaaaaacactgtatcttaatttcctttttctccaacatctaaacagtccatggaattaatatataggaattatatattatatataggaatatatattacattataggaatatatattatatataggaatataatattatataggaattaatgacatacagttatgccttatactttatttttccttgatttgattaagatttatgtaaatttgagtttcatactaatgaaactaatgagctgaggagcatctcttgttttaaaggcgccaaagaatgtttttgttacataacatctaagaaacagacagggcagaaagcaggaaggaatagatgccaacactgtgttgcaaggaattgtgccttcatgtcccggtgtctttagtttcatgctttagtaaaatataatcttacttttggtgcttgctttctttttttgtttgtcatcttttctgttcaacatatgcagagggattcttaagctacacaaaagaatgttctaaattggtagggctaaaaacatgtttggattttattaccttcagctaaattattccactactcagattatttaatctttatagaattgaattaaagccaaatttcctccatattatgaatgtccttgtctatttctaattatttcttgt

SEQ ID NO: 95389 - DNA, 1035 bp, Homo sapiens
agacaggccttccttcatgatgtgtttaagtatggcaactatttattcctgttcacagcaccttttcaatattttgataatcctatttcagtatataaatatgtatttttaaatgactatctccctcacacacaccacccactgtaccttgagttccatgacagtgggaatcattaccaccagcacctggcaagcagttagtgagcagggaacagtccgaggcacagcagcctcacaaagtgattgtcaaaggggctgttctcaggatgtgtcggtttggcacacttttaaaaatccatcgcattactttctgttacttcatgtgtgtttacaatttgatctagtcattgtatgtgatttggagaccaggtttaaccttaaaatccaaatgggtataaaatgaatgttgaaactaaaatagaatattttggatattccatatgtctgtaatataaatatttggcttcagttttttaatcattattttattccttttacagaccgagacaacacttggactcagttcatatcagcagaaaaggtaagtatatttaataagataattaacatactttcggttccttctgggggattcctgtggttctccctcctctttccccttgctcattttggtgaagaaggaatagcaaattgtaaatcacattatatgattatttctaagtgttgtgtgtgggaaaccaggtttaagtttgaatgtgcacatcatgcaattgtgtagcatgcctcccctgtcgtgtacgaagggctgttactcagctgaaactccccttgctttgtgagatgatcagctgtgtaactccttagaggcttctcttgtggctatccctgcttttgatgtactgaccactgctgcccccagttaccaggggtctgcccgcaggcccccagagaaggatctcagacctgcgaaacccagtcttgtgacttggagagaccgcttttaaatacagcttccctgtgataacagggggatggttttacctcaggtgttaaggaaaataggtacatgcatgt

SEQ ID NO: 95390 - DNA, 1026 bp, Homo sapiens
tagacttcatgtgagaccatagcttctcatgctctagaattctgtcataaccattattgatgtataaatgacatacaataaactgcatgtgtttaaattatgtaatttaaaaagttggcataattatgtacctgtgaaattattactacaatcaagataatggacatacgtgtcacccttaaaagtctacttgtgccccttggtaatccctttacgctccttatctttaggcaaccaccagtctgctttctgtcactgtcaggaagtttacattttaaaacactttatataaatggagtcatacagaatgtacttttttgagggtctgggttgttccactcagcataattattttgagattaatctgtgttgttttgtatatcaatagcttattctttttattgctgagtcgtattccattgtacggatataacacaactcatgtgtctgttcacctggatacgtggaagtttgggctggtggaaatttgggctgttccaatactgagctgtaacaaagctgctacgaacatttatgtacaagccattcattgtacggacaaatgcttttgtttctcttgggcatatatctaggagtggagtgatttggtcatatggtaggtgtatgtttaactttgtaagaaattggcttcaaactatactacaaggctatagtaaccaaaacaacatggtactggtaccaaaacaggtatgtagaccaatggaacagaacaaaggcctcagaaataatgacatttatgcagccaacaaacataagaaaaaaaaactcatcatcactggtcattagagaaatgcaaatcaaaaccacaatgagataccatctcacaccggttagaatggcaatcattaaaaagtcaggaaacgacagatgctggggaggatgtggagaaataggaacgcttttacattgttgtggcatgtgtcagaattttcttcctctttaagactggatcgtattcccttgtatgtataaatcacattttgtttatctgttcacctgtcaatg

SEQ ID NO: 95391 - DNA, 2111 bp, Homo sapiens
ggccatcttaaaatttgttagcaataatatagccaacttcagctcatgtaagctaaaagttggttttaggcatatgcagttctgtcaaggataggttattgtatgaatgcagtactagaccagatcgaaggatttgaattctaactcttaccatttgctaatttagaacatttagaggcttagtttctttatctgtaaaatgaattctgtatttatctccagtgtgttaagaactgcaaggaccactggaaatacaaacacagttaagacagtaacgcactttgaattaaaaggcaaggagatgttattacaaatgaacatctaaattattgatatctctataaaattgaggttgtagtacgatgttcagtcttggcctgtgtacgttttggaccagataattggttgtagggtagaagaaagagcgtcctgtgcattaccgggtgtttagcagcaggccggactctacacacttaatgttagtggccccctgatttgcgacaaacaaaaatgcctcttagttttttaactcttttagaatttgtccagcatgttttttggtgttaataaaaacccgcacacagagaaatgcttctggacgttgccaaattcccccagggaaacaaaattgccctcggttgagaaccactgagttacagggataaaattatcagatgtgttcgttttataaaagaatttaataatattttaaagcatatcacatatatttttgccgaggctggtctatttgattggaagaagagtccattttcctcccgcatatccccttttggagttgggagtgcattctgagagaagctgtgctcagattatttggaatctgcaccctagtgaggagcgaggttgaagctgaagtccttaagtatgacagaagcatgggtgggaaggtaccgaaagaccaaagaatttggggatggggaggtaggaaaggtgtctccaaactcacatgcatatacatattttccttaacacctgaggtgaaagaacacccctgttatatcttgtctgttctaaagagatgtggtgaagagaatttgcagtgagttaagaatcactaaagtttctgtgattcagtgaaattgcctttgaaacattgtaggagtgtcttatatttgatagaagattaaaaaaatgcatggcatgggcattttctagggctctgagtactcttaatagacccttatctctggatgtgaattcatgaggttcaaaggtccctgccagtcaaatggcaaactatggaatttccctgtcctctagagattgctttactgtctactgaggttgatcatctttttcatatggttattggccatttatttttctttagtgaattgtcttcttgccctttgcttacatttcagtcacaacattggttttcccatttccttttttccttttcactgtcgaattataacagtttttatgtatctttacattgtaaagttattaatgttgtaatccttatttgcctgtttttatccttattcagtgtttatttttgcccattctctgacctttgacatttctgcattttgtattaaattgttatagttaggttccagttgtttgatgcaatccttttgtctttatataaacagttgagtttatcttatttagtctcactgtagatgtgtttaatcttttccatctgctttttatgcattcatattggcttttgttttgtttttaatctcttgataatggggctcaattttcagatatacttttaagatatgtttatgcctttatttctcaaattgcttcagaaacaaaatagtgtctattgtgatcttccttattctcataacacttaaggatgtgttggcatgttctgagatttttattcttgtttattacagttaaatgattatttttctgttttgtggcatatacttcaaaaacaatatttattttctgattttctaactttatttccacagatcctttgcattgagtatctgcttatctttcacaagacagcttcctcatttgtgagtcttcgtatgagtaatttcagtggtcagattctgtcttcatgataatttttttctcctcaagaaagtgcacatgagtgatacacgtcctga

SEQ ID NO: 95392 - DNA, 1060 bp, Homo sapiens
tttattagcagtgtgagaacagactaatgcagatggttagcatcagaattgtactgcagttcactagtgggactgtacattgtctgtatttttcttgaggacatgctatgccagattgccttagatttttaggtcacagattttcttatgtagggacttaatgattctggaaataagatattgtggcattatttctgttgatctaagccagatgttggcaaactttttcggtaaaggaccagatattaactacttcagggtttgtgtcccgaatggtctctatcacaactattcaactttggtcatcgtagtgtgaaagctgccgtaacagtatgtgagaaatgggcataaaactttatttgcaaaagctggcagaagactggatttggctcatgggctaatagattaccaacttcttttctaaattgtcttggaaatgggctttaatgttctcccaggagaaaaggaaatggagaaggagctgtgattttgacttgtaaggaggcctagaagtactcatcttttgttttaaattaaaggacttctattataaaagaaatataagcttgtagaaaatttgaaaaatgtgaaaaaataataaatataagtcatatttattgggtgttgacaagtcaggtactcttctaaattcttaaatacatgagatggtattcattttatgatcattttacaggtgagcatattaaagtgcagggagtttaacctaaccaaataaatgattattaagtgataaagctagaattgaaaaccaagcatttgactctgaggcctaagtttttaaccgctctgcaataacaggggtcattacccttgtatcccactgcctaaatgtactacaaggtagtgctttttgttttttcagttatttttctctctgcaaacaaagctagattttctcactctacattatcagttttacaatattacaactaattttgtactcaaaacagccacttcatgtcatgtcaagttgattacctgtggctgaagagagaagtgggtgggacactagaaagccgtcatcagaggccaacagctc

SEQ ID NO: 95393 - DNA, 1296 bp, Homo sapiens
aatcttttgctattttccctgcccacttcctcaccaaatccctttgactgtggatcccaggtcatatcatcactacaaaaaagcagatgataccgaatttcagctgatcatttcttgggggaaatataatactgtagtgatcttttctatatgcttttgatattttcaattaatctatcagggaaaataattagttgcatcttgttgaatttgactattttgtgctttctcataatataacagtaatggatattttgaagttgatgcatatagcctgtaggttgttgaagttactttattatttgttttattttaaagtatttcttagtttgtaaaattctgaagtattagtcatatttttcttttcaaccatcaccattaagcagtccatttttagatataaaattatattaattaactttaaagtcaaagatgttatgaaaatcaaatttatgttcctgtaagtgatggtatgttttgttttcttcacagcattcgttcagtcagagagcataatagaagtactgcgttttgatgatggagggctactacaggtaatttttttttaagtagacaagttattgttaagccttgaataatatctggttattatttttcttttaaaaatgtaattggtttatctgaaatatatttatattttatgagctttgaagataggtcagtagagtctttagtaatataaaaacctctgtagttacgtgagttttcttttagattaaatatttctttaaaatgcaaactcattgtggtattaaaaccttgtaaataagtacattatcattcttatctttacgtaagaggtgttgagaaatgtaatagagagtggttgcatagtatttgcctagagtcagctttgtatgttttaaaactgaataaaaactgaacataatgagctctaattttataaagccttcctactaaaaaatgatcttaagtctcttttttctagttctttaatctgtttcaaggtgagaacttggagaacctatgggaacaaatgttttaaatatctccctttaggtggttgtttataggatctggatggcagacaaatcaggactgaatttctggaaaattccctaagtgtgtttgctctgtattgattgaggaaggatttgtgtctgttaggaactggacatctaggttgcaggttgataatccattctaaaaattctggagcatgatttgtatttttgctgagggaggctgctaatttgtatctagatggagttggctatggaaaagcttgtgaactgggatgtgattcactaatag

SEQ ID NO: 95394 - DNA, 4372 bp, Homo sapiens
aacattacatggtacatgactgcatttaaatactttgttttaacagtcagcctatttaggtttatcatataggtcctgactagggcctgctgttttgggctatagttccagtaatagcttagtttttagagcatttgcagtgcgagcttcagagttttagtgattttctgatactgaagctgctaagagtagttggtggttcttgagcattagttctacattttataactgaagtttacagatctttttagatgacttagattctttaggataaggtgaaaattaattatggtattttgtctttagctataaaattaattttgaaaaacctttctggctcatctttttagatgtatggtatatatcctgcacatctgaattacataggattatattttgagttttagtaaacaacatgggcattagcttctttaggaagttgatgatattgagtggtcttgataaaattaaaatatggtttatatgagttcccttgtacttctaatgtggcaagaagacaagtatatgttacatttttcagataataaaactaatgagggaagaaacaaagctttgatcataaaatgtctttaagctcgaagggacccatgtggacctagtccaggatgttttaaaattgctattgagccctttgttgaaacaaaatattgagcaagtgtaactgtaaaagagatattgatgtatttaacaatgttgaattctaaaatagcagtgtcttttttttttttttttttaagacagggtcttgttctgtcacccaagctggagtgcattggcactatctcagcccactgcaacctctgccccctgggctcaagcacaatgtcattatcctaaccagaatttcttatcttatgtttttcagacttgcttctaggcacagattattgacaagcaaaccaggaacttttacagattgtgataagaattaagatagggaatataatagaggataactgggctgctctgagaagccaaggagggccacactgtgagtggggtcaaggctgagacttgaaggaggagaagatgccagccataacaacagcatgctaggcaaggtgactctgtaacacagctttggggaccctcctgaggcctgcctgtgtggccctttcttctgttcctagtttttgtagaagaaagtttaaaaatcgctgatttgactagtccagccttctccttttgtgggtgaggagattgtgaaggctagaaggtaaagatatgcaatgacaacctaggttcctaatgcctgataccaccccccacaatatggcataaatttttctactagttatttacagcatttgtttttttcatgagttattttagatgtattaaaattgcaaattatatttattcatcagttgtaatattcagaaaaataccttcacctaaaagaaaaacaaaaacttagtagacaaagatttgtctttaaagtgaaagatatttttaatcttaactaaatgaaatagggaagtaaacagtttgtgaacttctgttttgaaagcaagtgttcctattttgaaacaactgacacattgacatttttacactgattataaatggctttgttactcacagacagcttagagatgtgggtcggtgtgaggagcttaaagtagatcttactgagcccagcttcagagtaaatatgagtagaatcgtaaaagccagaaatgtaaatccttttctttcctttgtaaatcttcctttcctcacttattgtcagaaatatatgcccaattaaaaaaatttggttgctaaaaggtgctgttagtcatgagcattctgtaaagtttattttgaaaataaatagggatgggtttagaagcacagattcacattgccagaattcatacttttctctagccactttcttgctaagtatatctctctgtgtgtatttctttaccttaaaatggatcataatgtctgtgtcatagggttagtttgaatattaacaacagtgatcagtaattattagtttatttttatttcaattacagttgtttgatgcttgaactagggaacatcaggaaagtttgggattcattaacagcataaaattaggggaaatatttttgggagaggaagctgttactagttctggttttgaatctggagatgtgataacttgactgacttttgttacattttatattttatagcttaataactgcatgtgaaatgattaagtctgtatctagtgttctgttttttgaggcatataattgaaaggtattataattggctgtttaaagcaaaatacgttaatttgttttatgccagagttgaatcctatttatctctacatcttttaaggaaagccagtgatgtgtaacatagtattttccttttgagactttataatcagctgctgttattaatttttttaactaacattcatatttttaacataactcatactttttaaaatatgaattcataattcataatagaatttttatatatttttaaagcttctgatttaaaaagcagtatacccaaactactgcctttatgtagttctcttcagttagatcagcatttcttctggctcaatggtgggaactcattcagtggtcgttctattggaactcttaatagcagccacctatagctcgtttccagttgtttcttgttggtttcctctgccaattagacataaagcttctaattagaggccttgactttatgtcttttacattgtgaacatctggctgttcagttatttcttgttagttcattgtgttcttatgttaataaatttgtcttcagtagggaataaccaaaaaattctctggatcctgtgaaatttcagtttgtgttaaaaagtggggggaacaggtgaggaatgggatgggtgagctgagcagagccttttatattcatagtcctttattgtaatgagtttatcactttacttagagacattctaagtatactgtgtcagtaattctgttggagccattagctctgatcttgatattgaaattccactataagccaggactagagataacataaccagaaaaaggtcatttgcatcagtaagtacaaatgccagtgcttattgtacctgagcaaaaaggtgggacatcattcatgctttcagtatttattgaatattctctatatgccacagactggttaggggatgaatagaagtggagcaggttggcactgtcattgaagagaaacacaggaaatggaggacaggagttttcccaaaataaaatcaggatgtgactgctagactaaggagaaaaggatgcttggcaggcagaaaaaacatccaacgaggtaatgtaatctaattaactagtatcttattctgctgcttgactgtccacttttgtcataccggaacagccaggtacatatgtgggacagtgagtgtcttccctgatttccaaaagaccaacaaatgggagtcagtgaattccatattaagccaaatgaaatatcacatagttgaaattctgcatgtgaaagttgtcccttttctcccatttattcagcaatttatagcaatatgggtttatggatatttattttatactttgggctacatctagtacttcttcattttgttgctcagattgtttcagctttggtcatttgggagctctttctgttgattcttaccttcctttctctatccccatcagtgtaggatttgggtggttttctctattttttactttccggcactataggatgctccattctcatctcgtgtatttcctgcccctgtcctcaaatcggccattgctccaggaagccctggtttcttttattggaaaataatattagaacacaagatctgagttccaggtgtgttctttgctattggcatgtcattgctttaggctcttagagctgacagagcaaggaaatacatgtatgtatactaacctatgaatatacacatctataaatattcttatatgtatgtaataatgtatatgtttcactaaacatgaattcttactgatatcactgactcttaaccattaccacctggatcattttggcctcccccgccttgtttctgtataaattgctcttccaacagtgagacacctggctcccagtatccaccatctgtgtacttaattgttcgatttcagtgtacatgtatagtggcatcagaatggttaacccaaactcccatgggaaaaagcattattaactagaatacattgcgtgtgtatggtttcttttgcctttagtcttacagattctattcatttccagaattacttaggtgagcactctcccctctccccccacttcagtaaggttgattcattcatttgtaatacagttaaattgttttgtcatt

SEQ ID NO: 95395 - DNA, 1053 bp, Homo sapiens
tttaatgttgatttttgcatattcattgttagtatatagaaatgtactggattttaggatttagaccttgtattctgcaactttgctatatgtacttattacctttaagaaggacttttctttttgagtccttggggtttttacatagacaagtatgtagcctgcaattagggagttttatttcctttccagtgtgttcgtcttttttttttccttgccttgttaaagtggccagaacttctagcacatgttgaatagagtgagagccacatccttgacatgttcccagtctcagggcctatatattcagtcttttactggtaagaaggatattacctagaggttgagattgaggtagttctacatttctcctatcttcttgagagtttttatcatgaagaggtgttcggttttgtcaaatactttttctgtgtcagttgatatgatcatgtgtttttcctctttagcctgttgatggggtgaattacaatgatcagtttttgaattttgggtgagtcttgcataccttgagtaaaagtcacttggtcgtgatgcataattttatacattgctgggttcaatttgtaattttttttttgtctaagttaatgagttttgtagtttttaaaataacatgtatgtagcataaaattcagcatttataactattttaagtgtacaattcagtagcattaatcacaatgttatacaaacaccaccattcttttttcattaccctagagactcagtaaccattaagccacaactcctcacttccccctaccctgttgcccagtaacctctaatctactttctgtccccgtgaatttgcttattctacatttttcatgtgagtagaagcacagtatttgcccttttttgtctagcttatttcacttactataatattttcaaggtccatccatgttgtagcatatatcagaatttcattcttttttgtggctgaataatatttcattatgtaactgccatgttgatccattcatctgtgatggacacttggtgtttctgtttggagactttgggtactat

SEQ ID NO: 95396 - DNA, 1317 bp, Homo sapiens
catacctcaaattcctttgcactgttgtgctttctggtaggaatgccctaccttaacctccgtgttcacctgactcttccttcagacgtaaccactccataaacccttgtggctgaatttggtggtttcagtgcacctggagcacccagtacttgatttattcgtctgtgtctcatctcagtgtatgagttccttgaggaggtccagccttagccgttagcactgtggttatgtgcagtagcttttagttaaaagttatctttttttttttggaataatcaaggcacctactatgacattagctaattgtatttcagaggcctagttttgaaactttcattatttgtcaacatacttggcagccatgccagcaggtataagctttcccgcatgttttcaaaacaggaaacttttgtcctttggaatagaagttctaacacttgagcacatttttttttttaaactaatgtcttgaagaggtaacttgtttctttttttaagtttaggtttgcctcatcccacaatgagatcatgaaataaccttgcctctccccatcctatgagttagctggtactttctgtttatagtcagtggtcagcaccaaaatagtatcccttgaatttcaaagcaagccaggacagactagaagtacattaaaatttgtgcctggttactagagggggaaaaataaaatatataatgttgtttcatatgtatgtagtcaaaagtaaaacatgtgactaaataaattttaaaaataataaactaaaattcatagtaatgctaaaatttagtttatgtaaatcattaagtaccaggcacaacaaaatttttgtttctttgctttttgtttttatgtaaacattattgtgcttagaagttgccaaatttggtgtctttcaatttttttccttttggaataaatgtgaacaaagtctcacatttattcaaacatttaacttcattttaaaaattattgctgtaggataacttttttttttttttttgagacggagtctcacgctgtcgcccagcctggagtgcagtggcgcgatctcggcttactgcaacctccgcctcccgggttcaagctattctcctgcctctgcctcctgaatagctgggactacaggcacatgccaccacaccggctaatttttgtatttttagtacagatggggtttcaccatgttggccaggctggtctcaaactcctgacctcaggtgattgcctgcctcggcctcccaaactgctgggattacagccgtgagccaccgtgcccagccgctgttggataattttttaacttaaaatt

SEQ ID NO: 95397 - DNA, 1366 bp, Homo sapiens
gtataaacatctgatttataagtgaagataaaattattctagcttatatataacaacaacaacaaagggaaattattctagcaatctcaaaaattcttattgtatttatttattttttgagatggagttttcactcttgtcacccaggctggaatgcagtggcgcgatctccgcttactgcaacctccgtctccctggttcaagcggttctcctgcctcagcctcctgagtagctgggattacaggtgcccaccactaagcacagctaatttttgtaattttagtagagacagggtttagccatgttggccaggctggtcacaaacttctgacctccagtgatctgctcacctcagcctcccaaaattctgggattacaggcatgagccaccatacctggcctgcaatctcaaaaattcttaaagctgactggttcctgagaccttaaggaaacaaaaaagctatcaaaaattagtaaagctccttttctcccacttttaacatacaagaaattaataaaagacagaaatgaggtgacatctatgtgccttcagggtattaagagcccagggtaataacctactttaaaacaatgctgtaaggttgaacatgactaaacttgtgccagctttctttttctttcctttatgttttagccaactctattgaggtataatttgcatacagtaatattcactagtttgaagtgtgcattttgattagtttcataaacatacagttgtgaaaatggcaccatcttaatgtaggacatttccatcatctcagaaagttcccctgtgcctgttagcaatcagtgccttttcctcatcactggtctcaggcaacaactattgctctgctttttgtcactttctgtagctgctgcgtggtctagaattgtaaataaatggaatcatactacatgcagtcttttgttttgacttgtttcagtttgcataatgcttttgaaattcacgttacatttatcatgtttgtttctttttattgctaagtaaactacaatttagttttttacctgttaatagatttctgggttgtttcaagtttagggctattatgattaaagcttttatgaaggtttaagtaaaagtttttttgtggacaaatattttcatttctcgcaagtaatacctgggagtagattgatgagttgtatggtaagattatgtttaacttcagaagaaactgtcaaaccattaccagcaggatgtgagagttccagttgattttacagtatgtctttccccaacacttgatgttgtcagtcatttcagtgggtacttagtggtatttcattatagtttttttttgagacggagtctcactctgttgcccaggctggagt

SEQ ID NO: 95398 - DNA, 1022 bp, Homo sapiens
tctctccccccactatcaaccctcttgaaaaattttccattgcaccgttcgaattagttgagtatacagttttttattataagcagtttgttacttattaaatttcttatttccatgtgatctttatactcttttttttttctctttcctttctgacaatttgtctgtacccagggaatttaaataaataaacatttcattttgtagtcacatatgaataaatttacacactgtactgttttatgttacacttcctgttttctgtcagtgtgcatctttcatgcaaccagtatatttttcagtacactgctgggtccttggatatgtttatgagtaagatagtaattagcttccaagaatttttttgttagagacaggcataaacaattacagtgtaagattaaaggtacatattaatatgtgtgtgccacaggagagagctaggttgactgtatacacagacctgtgtatcagtcagcttatgaaattagagaggacagttctaatggggcattaggtctggatctgagtaactcccttttatggtgagtcaaaacaatactccataagttccatctgactcaccgcccccatctaagaagtgtgccgtttgtttgtttgtttgtttgtttgttttaggtggtgggcaggtgtggttgaattcacacctgtgaacacccctggaacaagtttggtcaaagcaagggcttgtcttcgtaagtgattagtcttgtcatcttatatgagggacctgcctggctacctttctcagtggtgtagagagtaaacagactgctgacttggaatatgggcttgactgtgaccttgagcaagttaactagtcctcatgtgtcagcttcctaatttgtttaatggggataataggaatacctgtcttctagggttggtgtgagtattgaatcatctgtagggcttggtatgtagtaagtgctggattagtgctagctcttgttgcatattcatgttatgtttgactctggactacttgtgtaatcccaggt

SEQ ID NO: 95399 - DNA, 1224 bp, Homo sapiens
ggcggctggccttatgatatgtactgtgtacagggtaacttctcttttgtacaattgaagataaaaggcttaatttatacatgtctagtggtcataatacatcaacaaattgctcttaaatgagttagtttgtcagctgaattaactaacataaatgttgtcatatccttttcctttttttttttttgaaacagagtctgtctctgtcacccatactcaagtgcagtgagtggcacaattatggctcactgcagcctcgatctcctaggctcatgtgatcctcccatcttagcctcccaagtagctaagactagaggtgcgcctccaggcccagctaatttttttttttctttagtagagatgaggtttcactctgttgcccaggctggtctcgaactccagacctctaaccatcctcccactttggcctcccaaggtgctgggattacaggcaagaaccagtgcgcctgcccgatatccttattctgatgggaaggatgtgccttagcaaactggttcaaatgagaagttggggaaggagtataatcttctggataatgggagccaggaaacttgccaggtctcgtcttcactacgcacagatgagtgggagatgttgggagtcactcttgctttgtgcaggcttccctacaaacatgtcagcactgcttggcatacttcctgaaacttatgtttttgtctgaacattgcccctccaaagggagaactcattttccgagaccctactgcagggagataggagtgcccactgtgttgtctgaaatgtgtgtggtacacagcaagtgctcagtaagtctcaattcagttgaaagttgaattacacactgacaggcaggttcatgactattcccatgtttacgtccgaagttcatgttggtgtctcaaagtgttaacacttaaaatattaaaacaccacattgagatatacataatatataatatatatataataaaggaaacatagaccctctgcgcccttatctggtagtcactcctcggttcttatctggtcactaggctagacagaacaccagcaaattaattcgttaatttttattcagtaggtgccatgtcttaggctgggtgtagaaagataatgacacaattctggctttgcaagagctttcagtgtggtggagtgaacaggcctacagatggatgctgagttataagtggttgccaggataggtcgggtgctgggga

SEQ ID NO: 95400 - DNA, 2901 bp, Homo sapiens
aataggcactgtttctgaccttgtgtttctgtttctgaaatggcagatctcggctcactgcagccttcacctcccaggttcaagggattctcctgcctcagcctcccgagtagctgggattacaggcatgtggcaccactcccggctaatttttgtagttttagtagagatggggtttcaccatgttggccatgctggtctcaaactcctgacctcaagtgatccacccagcttggcctctcaaagtgctgggattataggtgtgagccactgtgcccgctcctttcttttgatgacagtgaagaattgtctatataggattttattttattttgcttatttttttaagacagggtcttgctctgtcacccaggctggaatgtagtggtgtgatggcagctcactgcagcctcgacctctggggctcaagcaatcctcctgcctcagccccctgagtagctgggactataggcatgcaccaccatgcccagctaattaggattttctttttaacctacacacagtaagacattattagaaacaatgagactacaaacctatactttaaaaatgtgttggttatatatagcctgtctgtcatacatagcatttagaagtagcttattttaatttcaggtatgattcagaaaactttatggattatttcacaaagttttgatttgagaatttctcagcccattgcatttggcaacgtatagaaactttcaagcttgggaaattgattgatagccacaaatgtaattttagatcagtatcaactgtcttatatttcagtattttttttcttttaaaattgaagaatggtatattttccccccttcctccacttatcacagctaatgccttatgttctttgttgcttttgtcacgtggaacacctccttgtgtgctattttcctgtcaggacttcagtgtgtcatcccccacattgtcagcaatttcagtgatctctgaaaaagcccaggattttctccctgacctttacccagtgccctttgtaaagggttatgtatacctgatttgatggaataatttatgtatagcagctctgagctgaagttagcacttttgcttccataactgtcttcatattgtatttgactcccatcttcttcatatgtttaaataattattgatagaattctaaagtagtagtttatttaagccagaagttaatgtgcaaggtgaataataattttaatcattctttatactccccccaccataggctacattaaaaacaaacccggcttttatttgtccaagaatggttgagtgtcagtaggtcagtagagccagttccagagcacatagtcaagccagcaggtatttgtaataccttctcttctgctgcgttctgcttgcttctacttgcacactcctgggtaaaagtgaatgagatatgtccagcatggcagaccaccagaagttggccatagcactcagcactttgtccttgcttcaggaataggcccagatggttactcttctctggccacaatcctgggaccagaagcccagtcagcagagcacctgctcttccaccaggctggtttgtgcctggagtgagtggtgaatagatgaggtcaaggctttgcaaatggatggcttttcttcacgtattggtttatcatttacttgttgtgtgtgtccttgggcaaattatttgtggacctttctcaactgtacagtgggcataaacatgcttaatagagttgctaggcactttgccataggtcttgaaatgttagttttcagatatgtttgcagattaggcgtgctatcttttgtctcctctctctgtactgtttcttttggcctatgtctctatttacctcctcccgcaccttgcctccagtgaaagaaaccaggcatggagcatttgtctcttggatcagccttgatacccttatgctccctactgagcagttccttggggccaaggggagtctaaggccatccccaaaagaggtagccatttctttaaggtactgtgttttatttattcaaattttgcattccgtttcagtatccatgctggttccagtagaaaaacagattttcccaagtggatacaccttaagatgtgtctcatgctttgtacttagggctcacaatagcacgtttctggaaacatttctgtgtttcagcagtactataacagtcattcttcatcaacaaggagaatggaatggaatggaatgttgccagggtcttggttcacagaggtagactaactttgaccttcctgggaccctgaacaactccacatcagacagatcgttgtgaaaggcactgagtaacatttagataagtggatgattttgcattttttacagtaacatcagaaagtccagtgttgtatgaaacactgcttattaataaagtaagagcatgtggttagatatcagctacttgtaggagaatatgcgtggctttcagtttcatagttctattcctgcagatttttattgcatcaacttgttttatttgagcagtttgtgtacagtgatgtatggaataatcttcaccaaatagtgtgtagatatgtttttgactcatagcagaataagtactctaaggccttagaatagtagcctgggaagacaaatgttagcacagaaagatacatcattcttagatagccaagaagacctgcaggtgtcattaattagcatctgaaaaggaaatattttggaaaacataaataatacaggcagttaggtgtctgcagccagagagttagagaaggaaagaagtaacagactaatggaggggagttgtcagggaaggaggtgttggggcagaagggcccaaacatggggagcttggtggagggcctggaagaaactggtgattaaagcaacaattgtctgtcta

SEQ ID NO: 95401 - DNA, 1036 bp, Homo sapiens
cccccttgccgccatgtgatctgcacactcctttgccttctaggagtggaagcagcctgaggccctcagcagaagcagatgttggtaccacacttcctgtacagcctgcagaaccatgagtcaagtaaacctcttttctttataaattacccagcctccagtactcctttaaagcaactcaaatggactgagacatcagtttgctgtcaattaatttgatatttaaaaaaaaaataccaagaaaacttcttatggaattaggaaagttgctgttaaattttctatgaaaaaatgaaaatgtagaaatactgggaaaattctggaaaagttatgaggaatgactagcacaagcagttattaaaacttgctcttaaactattatgtaattggtataattagaataagtactggtatataaatagacaaattaatggaatagaatagaaattctagtaatagacctaagtatatatggtttatgttaacctacttttcttctgggagtctggaactttggtatgtgttaggcagaggggtaccgtgtggctagccccaagtaaaaaccttgggactctgtgttagtttcctattgtgcctgtagctaattatcacaagttgagtgggttaaaacacaagtctattctcttatcattccaaagggcagaagtctaaagtcagggtgtgtggctgactgccacagttatggtttgagacaatcattacagcagttaactcctgttattgcttgagactgtcattactgcagttactactggagaccatcattacaagactgaacgaagggacgaacatagaaatgaaaaaagacaaaagaaactgttttaaggaaaggcaacatggggagaagaggagagctccctgcttctagtgatcaaaggcagcccccttgagcttctacagtcctttcgtatttattgggtaaagagcaaggaggaggaggtaaccattggtcagctgcttaattgatcacaggttcatgttgttactgacaggcttcagttatgcctaatcatga

SEQ ID NO: 95402 - DNA, 1007 bp, Homo sapiens
attctgttatgtactgggatctatttcttgattttttttttcccagggtatttttttttctcatgtatatgtctatgcatttgtacatttctgttttaactttattttaggtaatatagcttatttatacatttcattagctggcttggcaggtcatcccctctccctaaatgattattcttcaaaaagcagtttcttatctatcttgtttttattccctatgaatcctcaaatcattttgtaaagaaaatttaaagttgctatttgctttttggttacaattacattaaaacgttagataaatttggaatttgacatctttatagggttttccattttgtttgtctttctcctaagtctgtgtgtgtgtgtgtatatatatatatgtattaagtaaaactgtatgaaattataatttttgtcagtccaacataattaacaacttattcaatctaatattaatatgtatgtttttatgcattattgctttggctagagcttcagaacattgttaaataagagtgatgaaaaagcaggcatccttatgtttttctgtttttttaagagaaaaataccttaagtgtttcattgtgtagtatgattggggtagttggttgaagttagatgttcttaataataggaaatttcttatatttttaaagagttttagttttaagagttattagggacagctactacattttatcccatggagttattttatgacctttttaccttaagctgtaggagcagtcctcttagctgcactgaactctcttggtgaatttatacccatgtctgttttccctctagtaaactcgtccagggatacccattggacttgggctgcctgcagctgccaggctatactcacacacttccacatttgctccatttagttaatgtgcatatttttatattgtggttttgtttttaactaaaactctttttaaaaagctattatatcgatatgatccctcatgagtattgatgtatcaatatatagt

SEQ ID NO: 95403 - DNA, 5466 bp, Homo sapiens
attccatttaactctttagtaagctgttgaaagcctgtttacatttcttattttaaaatacgtgattcggtgcctttatctttgatgtgaaagcctttaaaaataaacgtgaagttgccagcttgcaagcatttatctataatttacagttaagggctggcccctattttaaaaatctcattagtattgtactgctgcaaaacgggtacttggacagggtcaaaaattattttgtaatcttgaagaccaaatcagtgtaatttcatctacactacctctttttgagccaagggacatgtgaatggtcacagagccttcatgaagaattgactaagtgaatagtttaaaaaaaaaacaaaccacgcaaaacttgttagtttagcattgcacatgaaactgcctgtacaagaaaacaatttcttgccacggtaattttagagttaacattctactttatgactaaagtcacttgctttttattgttgctgaaggtgaaagcaaatacaaaccaaattagtattaaagtgcaaatgtgcttcagtatactgtttcttttatttttgtccacattacattcccttatctaactctctaagcaaccttagtctgagttaacattggtggaaattattcaaagaattgtcgtctatagaaaggattaattgatggaagcaaaattatttccagaataaaatattgccgctttaggactagtcggtcctggggttgtcataatacatcattggccacagatctgcagttagttgagtgttctttcttatgtgtgatcgtggcacctagcattttggcctgtagtgggtgttcagtgaacccaaaatagtgcagtaatttaatggacattttttgggtgggacttcaagtagaccttggtgggtattgtgtccttgtttttctgttcctttgcttaccttgcacagtgccagacacactggcgcttagcctttgagtgaatgactgtcttcatgcgcccttagcacagggaattgaaataatggttgaatctagtaaagcattaagtttgtattttccttctactgctgctgatttttccaacagccattttatatgctaataaaaactttactctgggtaaagttaagtaaacaaaccttttgtttgagaactgtcagcctaaaatatatttgctaatttctcatttgcatagtttatacatgttagtgcacctctctaatacccataaatgtgtgtaaggattggatgaggagaatacttgccagggtgttaagtatgtattaaaggggtggttgaatcagccagtggcctgggtgaatcagatatcctttgtggcccatgcttttctgtatgaacaatttgtgtgtgcggttatccaagatattaatggagatgatgctgatatagaacataggcctctacccatcataaacagatctggttctaatcaaatattctgtgaaggtatctccagaaatggcttctcctttaaaactgatcatattccagtattgtttctgagtaagtaggggaaaagcaatttattttcttacgtgattgtgacactgtgagtctggcatctgatgaggcacaaatacagtatttgtcctaaaaggtactgttgagtttttcagcaagtttgggcagatttctgaagatggctgagttcagtttgatcattcacacccggaggaattttgtgtctattgaagtagcataaactagtttaaaatttcaaagttaagatttacctgcagttttaatgatgattctgcaggtattttgtatgtttgtatttcttttccttcattactgtataatttcactgcaaaatctttaaaagacaataaaactcattgtctcctgaagaaaagctgcagaaataaattacctaatgtagtttttcatgtttggacttgatgttgattttcttgagtcagaagcatggaccattccttgtcttaacatcctatatgacttaactgagctatgggagtgtgctatcactagtccagaggaaaggtacctttgagatggttttggctgtgatgtaaagtttgtaaggactttgaaagagtttccagagatagaagttgttataatcactacaaataactagttctagattggtggcaagattttgtcttgaggctaacatctagatactgagaatagcaaaaatgtgtgtgagttgtgaaaatatatttttaaaatatatagtgaaaatacatgtgtatgtgtatatattaaatgtatacttttagtagtcttttgaattataaagcagcccattatgactggcaaataagaccttttttaaaaaagcattatatatcatgtaatataatttcattgtgaagtgggtttttggaaggcatttattataaatgagaagctatagtttatgtatctagtaaatataaattcgaataagttttcaagaatgtttcaatttatgacaatttaaatttcattgtcacatgttttattaattggcaattaaatggcagggtaacgtttgacagcctttattaggactttaaaaattttttgccagtgtactatagtttcatgcacaaatttttgttttaagctgtatttgtgacataggtgcaaaacacagtacaaaagtatttacaaagcatatgagaaaagtgcataggactaaagaccacaagaaaacagataagaatctaatagttttctaagggtagccaaattgactaggagtgttatttactttttcttaaccaaactatttttaacctacttattactcgataatgttaaaatgtttttgaaagtgattttcttaagagtgagatgtgttaaccctttgtatggggtagagtgggtaccttttaatttagggccttgtaaatagaatgttatttaataagtgcttcactaatgaacgtttgtagcctgcttttactaaaggctgttgcctgatggagcattggagttttgtagttggaaaaagtgtgtccttttttcctcttgctaatgaccattttcctcctccttctaattcttacagtggaccctcatagacatctgccaacaagattgctttgggagtagatgtaaactcatctaattgttactatccagagtagcaataagccaaattactcttggaggaaaataaaatctttgctaggtgcttgatattttaggtgttctctctcttgcctatatgtgactcaagcgctctgattggccttgccagaccaagaggcccttttcctacagctgaattttcccctacggtctcttgtaagcagcatctggcattgtttcggtgactctgtacttctcggttctggttgtgccctagctgacagttgctgctctccaattgcctgttggttgtcttcctccctgtgtgtgtctagctgctggtgcacactgcatgtgtccagggcagaattatcttgcgccacctccagttttcagttttttattaatgctatgattattctgcctgccccactggattcagttttgacccttcaccaagtggcatcagtgcctgttacatcctcttttgatcactctcccactgccttcaccatggggcactgcagcagcctctctcctaccgcctttcgccatttctgttcagtcctgcatgctccctctgaatttgtggtctttgttaatcattcatcattcattttgacacctaattgtgtactgccttgttagctacttaaatgatttcaggggtgtcattcttcacctaggctggaatttctgtagggcagaacctttgtcaacatctgtagtacataaatagcaggcattcagttttgattgaaagtttgcctaaactttcattgtaatataatttcattgtgaagtgggtttttggaaggcatttaatttattataaatgagaagctatagtttatgtatctagtaaatataaattcgaataaattttcaagagtgtttcaacctatgacaatttaaatttcatagtcacatgttctatcaattggcaattaaatggcagagtaacgtttgacagcctttattaggacttttaaaattttttgccagtgtactatagtttcatgcacaaatttttgttttaagctgtatttgtgacgtaggtgcaaaacacagtacaaaactatttacaaagcatatgaaaaaagtgcataggactttttatacctgagaacctgagagtcagaagtacaggtaaaattcagttctggtgcagatgtcatgaggaagtctgctatagtaggacattgagtaacaccagttttttcttccccacatgttgcttttccttgtaactaaaaggagttgtatacacttatctaaaccatcacttttataactttttgattttaagattttcagattctcataaaaccctaatctagagatcatgaaactgaggcttagagaggttaagtaatatacccagcgtgatagggctggtaaatagtggagccaggattccgccctaagacatctgtcccttgagccaaactatgtaaccccaaatgagcacttcaggaattagattttgttatattgtaccaactgcaaaaagaacagacttgacagttcatgcaaaacccatgtattagtattcaagtaaaatgtactttttttttttttcaatcagccacaagctttcatatcactttctgttgacttgttaacagtttaagtaatcacaggccattctggatcatgaaggttcttaaaaggaaaccagtgagtggataatacagggaaatgaatatttggtattcgaagctactgtctctttgttcttgatgacttagatacctggttgtattgctaaggttaagcaatattgccttctgtagatactgcttagctccagattggtgtgatgagttagtctagacttgtggaatattctcagaagctggccctggactaacaggagctggagataatgcaagggctggtagtggcatttgcctcggcaggcagaaatctctcgcagacttccattagaggtccaagggctccagaagaagttcaaaggtgctttgttcttattagggcattttggaattaggtggtcattagttctcatctgtagttccaaatctgttttgttgttgttgttttttaattcccatgtgattacttttaaaaccacagatggagggtttctagaaagcctttgccatttgcctgattgattttgttgcatacaactctgccgttttagggcagaggtttgatgtttaagaggatcttttagatggtcagtcatgatagagtatgaaacctacgtttttatttattttcatttatttattttctagaaacttggtgaaaaaaacacataacaaaatacttaaccatttttatatgtacagttcagtggtgttaagtgtattcacgttgttgtgtagcagatcttcagaacttcttcatgtaaagctggaagtctatacccattaaaca

SEQ ID NO: 95404 - DNA, 1049 bp, Homo sapiens
gtatgcgcactcacacccctggaaggctctaccactgtaggacagagcacggaggattgcccaggcgccggagaagaggttagcgccccgcaactccgcccctgccccgcccacgcaacgcggcggctgcgcggcgaggccgccccgtctccacgtgattgccgacaccgcctccgcgaagcagaagccgccatcataagtcctggcagctggacctgggcctgcctccctccttctcctgcgccaggtagcggtaacgggctggggttgttctgtcctggttctgtctggccgtgaagccgcaggcctccgagagcgggacgaggaggtggggcccagggggctccggggcggacagactgaccgccggacagcccaggtgtcggcacagcgtgggcggtgcccagagccgcgccccgcccctcgcaggccagcgctcagggctcgcgggccgtgcccgtttccagtatggccgcccgccgcgcctgacccgcggcctctccgctccgactgcttgtaggcgatgcccaggcaaagaccgtgactgacactctcgctcacacgcacgcacggacccaggcccacgctcggagatcgagccccgggctcgcaaccgttgtcgctcccggcgccgcggccagagcccggaccacggcttccgcgccgccgccgcctcgccgagaagggccgcgccggacctcgagcgcggcggcccccggccggcagggatggggaagcgggcgggaggaggagcaaccggagccaccaccgccgccgtctccacgtccgccggggccgggctggaacctgcggccgcccgtagcgggggcccgcggagcgcggccgccggcctcctaggcgcgctgcacctggtgatgaccctcgtagtggctgcggcgcgggccgagaaggaaggtgggtgtcccccggcggcgtccctgcggcggggctgtcaccccgctctcgcggaggccgggagggctgggccgggaggaagggccgcggccggggctccggcgcaaagttgggcggtcgggtaccgtcccgag

SEQ ID NO: 95405 - DNA, 1015 bp, Homo sapiens
gaggggctagtgctatgttcccggctaaagatggctgtgtgtgtatgtgagaaagttcttttatcctctatttttcccagataccataagcagggtaagacagtttgcaccatgctgcctcaccatcagaatgccagcctagcttgtctgtgttttttctcactcagtcctgcctttcttagttgttcagactatggatttaaccagcctagggagtctccagtcacaaacctctagactgttcctattggtccaaaaaggggctgttggctttgctactcagggcatgtcccttactttgaggaactaggctttcctggtttgactgatggttccatctgtgggcatcctctctcattatcttcccacacgcctgcttgaccttcactgtatttggaagtccttcctcttctattttggttcagggttcagatgtctcttaatttctttcaagatagagttttgttcctgtttcttattctccttctcacttttgggtgatttctcagagaagagggaaatggtcctctttatgccacatttaaaaaccacaggcttaccctcagagtcttttgcattctgcattatttttagtttcagttctgtatcacatataatctttttatgtttttagagacagggtctcactctgtcgccaaggctggagtgcagtggcatgatcatagctcactgcagccttgaacttctgggctcaagtgaccctcccacctcagcctcccaagtagctgggactacaggaatgagccactgcatccagcctgcatcatacatactcttttaagagtcatttaagattaggattagggacctgaattcaagtttaaattcagtcttgcctggtgctaccaatgcaaatagctcaactgaagtgacagtcaaatcatctgatacggtcacacatggctaaacttgcatatgtgcaggcaatgacaaccccctcgcagtatacttctctgtctgactgctggtaagtgtcatttgacatgaatgtaag

SEQ ID NO: 95406 - DNA, 1109 bp, Homo sapiens
tcccagccctaaaccactctccttggcatgaacttcgattgattgaaagacataaatatctaaattaatggtgccatgtcattttaaaaaagtgttatagagtcaaacctatcccttaactgagacagtagaggtccagaaaaggagaccaggcaatcactattacattgggggaaatattatacctgtggtttcaaagaagcaggacaccttggctacatggcgaaaggattaggggttgttgctttcacaacattccattgcatttcccctcctcgcagcggtgaccctggcttgtgtgaggtgcttttgaatgtttttattcctatcttatttgggtattatcaataattcattttaaatattctggctgctacaaacatttactttagaaggatttattgtatcctaaagtctgcatttatgatttcttgagatgatatcacttccttggggatttcagttctgattctcagaaagagattagtgggggaagcggaatttgatgttcagaaatgttccagaaacttggctgcaatgcgtcaggcctgctaggcgggctgccacattcctgggcctgtctcagccggccgctcatgctgtgtctccccttttaggagctggagtcagagaggacgtgtttctcgtttggcaagagatggaggaagcctgcagcacgctggcccagatccagaggctggtggccgagcctcccaagcccgacgtggccactgtggactgcggttggtgctatttctggtcactggtgtaaaagattcataaatgttactagctggggaccaggggctgcttccatgttcctgaccagagaagctccagagcccagctgcgaggggctgctgaggagagcagccagagctgtgtggggtgaggggtggggagggggctgaacacacatgcatggacatgtgtgtgtgtgtgtgcccacgtgctcacatgtgtgcatatgtggagattgtcagtacccagagctggacagtaaagtggtaaaaacagatgcttgggccgggcgcggtggctcacacctgttaccccagcactttgggaggccgaggcgggtggatcacgaggtcaggagatcgagacca

SEQ ID NO: 95407 - DNA, 1046 bp, Homo sapiens
ttacccatgcattggtctgtagtgtaaattgcaaaggaatcttgcctgagagcccgctctgacaaatcaggatatgttctctgaaatgtggtccatttattagctctcagtcacagctggactgagacaagcgtgatccctttgcattttatgtaaaacccatatgtgaggaaaatatacaactgccacttccccttccacagaaatgagcatcttgctggctgaggagtggctggatgacaaatcgtcagaaaaggtgacgcgagaaggaagccaggtttatgaccacgagtgagttctttaatttgacaaagacagttctgttatgcttctgttggttaaccatcaagttgtaaattttaaaacaccacctccttgtgttcttagttcttcagatgtgtcttcagaaaactggctgaagacctatggcttggtcgccaagaaactcaccctcatggatgccttgtcagtggcagcagtcccgcacagctccacctatgttcccgtcctggacaagcatgtcgtgtctaaggtctttgatgaggtaaactgattgtctatacgtccctacttgaggccattttcattttctgctcaaataaaaagtagtccaatttcttgtgtggttgtaacagaaatgtattttagccactgggggaaaaagtatttgtaaaggcagtaaaagggagagagagaggcttttaagaatttgggcgcggtggcgcatgcctgtaaccccagcacttgggaaggctgtggtgggtggatcccttgaatccaggagtttgagaccagcctgggcaacatcgtgaaaccctgtttctacaaaaaatacaaaaattagccaggcatggtggcatgcacctgtagccccagctacttgagccactgaggtgggagaatcgcttgagcctgagacatcgaggctgcagtgagcggtgattgcgtcaccgcattccagcctgggtgacaaagcgagatcttgtctcaaaaacaacgaaaataagaattctctttttaagctgagagaaactgatcttggttgg

SEQ ID NO: 95408 - DNA, 2195 bp, Homo sapiens
acaggagaaatcttaagtctgaaattttaaattccctttgaaaactcccctccctagcacccctcatgttactgtgattgcagatttcaccctcactagccaatccagagccctcagagctgaacgataggggaagttgccggagggcatctgtgaattataattaatcctccctgggagcctggtctagggcagcccagctgtgctgtcctccaacattttctgaataaataaagattgttctccagggcaaatcctttggcccagaaagatcaaaaaggctctctcacccataaccttgactgctttggaaaatctggaggtagaaaatatttttaagctgaaagcagctctaaaggaggccgtggaaagttacccacaccactggctgcacacgtttccttctcaaagccgtgactggcaaggaagctggagcctatggccttcaggggtggggaattgagtgctctgctccgggagaaagagagcgttaggaaaatgcacacagggaggcaggcatgggcgaggctggatgaggtggaattaggagaaggaagagaagagatcatttgctgttgagaacattctgttgggttgtgactttgacactatacatgcaggaagatgttagctggggagacagaggaaagtgtctttcagttatcagttatgtaaaataaactcagaatatatacggctgttatctgtgtcccagatagtaaatgaaccaattgtcattcttcaattgtaacttttttttttttacagtccattaacgggaggtgtgaggcattacaccctaactgactagtcggcctttccaattccactagtaaaaactttagtctgttttgctgatattcaggtctgttgggaagactagctccctagtggctgtgaactgttctccagtggaacaagatctactgatgttgagacaggaaattttccctgaccccttcatgggacttgcaaagagggtggcttgtttactcagcccgtggctctcagcccctctcgggagagggagcacgcaggtgagtgggtgcaggggccaagatgagtacttctgggtgccggcaggagcagaactctgtgtggccccaaggcagcttctagaggagtacccacaacccctggagccccagagggcgtgtgttaccgtgctcctttagtgttgctgtccacagatggctaagtgtttaactccttggtgtgacagcccgctgtatccctagctcttgttcagcatgcaggaagaatcaggtcacacgaacaaattgaagatggtaaatacagggaattttattgctgatgaaagtgactctcagcaggatggagagctagaaaggggatggagtgggaaggtggtcttcccctggggttcagccatcactggccacactcttctctgaggtcccgccatcaagccatccccctgaagtcaagctgcttctcaacgacgtcaggctgctgcttctcttttctccatctctgctactccactgccagtggagcctggagtttttatgggtacaggatgggggggtggtgtgggccagagtggttttgaaaaaggcaacattcgagaaggaaaacaggaatgtgggtccaggcttgagagtggggccctcactggggactgctgccttctacccagtatttccctgcctcctgtccatatcagtgggcaggaagttaacaagtctggggtgtgcactggtgatgttaccatcacacagaagtgatgtgtgcacattcagaccatgccgtcctcagacagcactgcagtgatggtttagcatctggaagtgggacccctgatgggcctccagggcatgtggccagagtgaagctgaaatcccagaggcagtgagaggatgacaaagagaaaatgaagcccttcattactgtgccacgtttatctaggggttagatggggctttaaggagagaatcctgctcagaaacaccagtcactggaggaaactgaaagaagggggaaaatatccccaaactctattttctaagaagtcttctgtctcatgtcctgatgttcaggaatgggaaggtgggtgtcaactctggggatccctgaggtgacaaaaacttagaaccaggctgtcttttcattctgaagctaaaggcaccctcctcgctggagattcggctgggcagatgccagcactctcctgc

SEQ ID NO: 95409 - DNA, 1046 bp, Homo sapiens
gagtttccaggggcttttgggctgggagttgttccttcactggcttggtcaggacgggtccgtatactcaagttctccgtgccgtgggaggctcccaaacaccaaaggctcgtggaaatgaactgagtggacctaagcccagcctaaagcattgggttcacagcgctccagagactcctttccatgggaagagggacgtgggcaaggagctgagaagcagccgtggggatggcttggacatctctgtagaccccgcagccatcaaggcagggtaaccctgatctctctctgtctctagagaggatgtggaggcgaggaactctgctttcctcttctggccactgaaagaagcggacacgcaggattccagagagccaagacgagagaagcccaggaggaaaaagaggcccgccaagcagccactccagcaggcggcgccctcggactcggacggctcctcccacggcatcagctcccatgggtcctgccaggggacacaccccgagcccagggtttgggtgatggggggggaacacaacatcgcttatctcaggaacaccctgaaatccctttcaagaatagtacacctaacatcgtccttcagattctgggcctgtttaggctccagtgcagcaaagaccctaacatccttaagtaatgctgaactctgcttccccagacagcccacctccacttccccgcggccgggcgtctaggactcagcagccacgccatcattgccacacctccacctcgagcagccctgccctgtactctccaagccacccacagcagcaaagggctgaggagcgtccctgagacactttaaggccgtctggtggcagctatgtttaagagaccagcgtccttccaggctgttcagacctcagcgttgacactgaaactggcccctccgcggaggtaaggccgccctccgcgccgcctatgcctgccctgtctgtagcaaagactcctctcccctccatccctgctgcctcccctacccgtttgacgacttggttctggctttttctgactgttcttta

SEQ ID NO: 95410 - DNA, 1017 bp, Homo sapiens
tcaccatagcctgtctgggattggaaagccagggtcctgggtgcagtgtgcatgtctctttctggtctttgcacatacctttgtcatgccctatcaggctgtcaggcccaggcctgccagccagccagcccagctggcctctggtgtttgcccacagccctaacctggagcatgggtgagactgctggccttttaatatgaaacttgttcagtgaggctcacctggcgagggacttaggcacagtaagcagatgtatatggtgggggcagtggggggatcatgctctggtgaggtctattttctggaatagggtcaggaagacagggatgtcctctgatgtccaggaagaagggtggggacctctgaaagaggaaagtgtttacccgctgccagctccggtcctgggatcctcctagagcgctttccctgagacacctggtagttttcctgacctccggttgctgcagcgcccctctttttgcacctcactaggtggtattctgatgtctcctgaaaaccccctgcccctttcctgcccctcccatagccctcacgcaggtggtgtcagctgctgttatggaagctgtctattattaattcaccctagcatattgaacgcccttctttccctctctcatgttgcttgcatctctaaagggtgtattctcaaaccaattaatttgaattttcaagaaggatgacctaagtgtataaactctggaaatgtgaaggaagtatttaggcagatggttgtttctgggaaacagggctctactaggaaacaaggatgcccagttcaagcttctccctggattatggggtgtgtcagttgggatgcttttggttgccaacagtgacatttattatctcagagaactggagtctccatcagcatgtcagcagtttcatcaaggacctcgattctgctcctctgtccagccatcactgccggtttcatcctagggggttagtctcctcatgattctgagatggtcgttgggggcagtgggactgcg

SEQ ID NO: 95411 - DNA, 1006 bp, Homo sapiens
tctcaaaaacctccctgtacttaacttggtttgacaaatttgataacattttatgttttaataggcaaacattttcatggcttaaaaattgtaaaatatagcaggatatgtggtaaagcctgtttcctaccctatcctctagccatccatgtcccctcccttaagacaccaatgccatgtgcttgttgggtttttttctgaagttatgctgtgtatatgccagcaggcctgcatgtgcagacatgagacagttttccacatccctggtgccatgctgcgtgctcgctgtgtgcctcttctgacggtttcactggcccacaaggagttttgtgttccattgtccagctgcatgctggcctgctgccaggctgtgctgcagattcttcaaccagtgctctctggatgcctgttagcttctttccagcctgtgcttcacactaatacgttagttttgtgaaggaagctgcaccccccttgctctgaggtctgggcctaggctctggctggattgagcatcattctagctggaaaaagagggtggggttagacgacgtgtttaagcttctgcccgtttatttcaattatgacctggcctgtagggttttctttgggaaatgggcagttaatggttagatactatttgtaaggcacatgtctctaaaatattaccttctagtggccaggcgtggtggctcacgcctatgatcccagcactttggaaggccaaggtgggcggatcatgaggtcaggacatcgagaccatcctggctaacacagtgaaaccccatctctactaaaaatacaaaaaattagctgggcgtggtggcaggcgcctgtagtcctagctactcaggagtctgagataggagaatcgcttgaacccgggaggcagaggttgcagtgagccgagatcgtgccactgcactttagcctgggcaacagatggagactctgtctcaaaaataaataaataaatagataaaaataaaataaaatattaccttct

SEQ ID NO: 95412 - DNA, 1003 bp, Homo sapiens
gatgggaatagtgaaaaagagggtgacaaaagcagagagtctcaaagaggggacagaactcagtgactgaccagtttggttgatggttggaaagaggtgtcagatacatctgagctcccaagaatggtggtacctggaagggagagaaatcaggaggagccagttctgaagggaatgtggtctcgggtctcagtggataccaggagttcaggggcgggtgactgggtaacttggaaatacaggactgggccttaggagtgtcattagggccaggccaagaggggttttggcatcatctcctggatggccttagtggataaaactgacaaggctgcagagtggagggatatgccaacacccagccctggcttgaacctgtccctgtcccttgatgttgggaagcagagattccctgtcatgtcagatgactcagaggggccctaggatgctgaggcaccaagtgagggctgtcatttacacaccgtctgtcgataacattggtaccaagcagtatagggtcttttatcctggagattctgaacctctgtgatggacccctgaggtcccctctactatgacagtcccattctgaggggaatttggccttaatgcttcctctttggcatagcaaactctgcttcctcttcttctggagagggtgcacagaaatgttttctctagtctgtaactatggagaggtaatttgtttctgggagggagacgaagtagggcacctttaactatttgatctgagtttttgtccttgaatcatgtggaattacacatagggtttatatacccccccaccccccaccccatgcagctgcaagattctatctgccttttcttctccttccatatgggattgacatccctgtaggatccaagtgcttgtggagtgaggaggacactttagaagggcctagggtgatggagctaatgcagaactccttgtaacctcttaaggtgtagtggctggcactgaggttggggctgtgaccat

SEQ ID NO: 95413 - DNA, 1079 bp, Homo sapiens
ttagctttgcgttctgggccttgatgacttaaattgcagattctaattaaatgtccccaaataactatgaagtgcttctaaggtctttttgacctaaaagtttccgtgacctgtgaactctctcaagtgtaaaattagtctgtagatgtacccctttaagcatttctatctccagaaacctcatgatgcctaggatataaaccaccctcctaagggcagagcaggctggtggagtgggcagggaccctgcagggagaggtggaaaggggtaggcatgggtgagtttcggagcttccccagggctggcaggatgttggggtacagatgtgtccctctgttaggtggcctgtctccactgtcataagtgaagggggtgaccgacaccttcactaacaggctgagcagggcagcaaggcaggcaatggaatgctttagacacactgggaaaaggttcaaaagggaagagcctcttcttcaagctgaagtcatgcctggggtgctgccctgcctctggccagcatggggtgcaaatcttcagtgacacaagagtatggctgttagagaaggaggaagacagttccccatgatcacacccccagcatggctgtcatcttgatgcagccgcctgctggctgtcccctctgtacagtacctctttaaatggctgcaaacagagcaaaggtgggctatttctttaaaaacacatgatgcagaactcacgtaagttttttttttaatgctatgttgtcttgtatacactttgtattggggtataaaaatcacctgtgtacagctcagtgaatttcacacagtaaagtctgtgtgtaacccgcacccagatcatttccagagccccggaagccctctcaccctccccagtcagtacccaccccttcaggataccactctccatactctggatgccacagattcgtttggcctgtgcttgaacttcgtatgaatggatttgcctagaatggtcttaacttttccccttgacgttgtttctgagactcatcccattgtttcatctgttctactgttgacgaacatttaggttgtctcaggtatcttgctac

SEQ ID NO: 95414 - DNA, 1055 bp, Homo sapiens
ttaagtagagacggccagttttccagcgcgggtgactatttacgctctaccagtagtatcacttccagttactccacgtcctcatcaacacttggtactgttggtcttttgtcatttttgctattccagtgcttgtgcagaggtatctcatgggttcagtttgcatttccctgatgactaatggggttgaagaacttctcctgtgtctgttggctttattatgatcattttgatagccagataatagtgtgtcttatggatgttccagaacattcttttcttacctatagctgggcatttggattgctttattattataagtaatgctgcaataagcatttttacccagtagtcttttccatgttctatactattggcaagagttttgttatcatttacaaattttgataattaatgccagatggctttctgaatgtttgaactactctaagatggagtaacaatataggagagtcctagacagcttcccccaggtcctccagcaatgtgtattctcattgaagaacaaacaaaactcttttggaggacgaatttaggtgaaggaaagcatatttagcattgcgttacttaatgagtttggtcactttttcaaaatgtttaccatgtgtgttcctcatttataaattcctaccttttgccacttgcattttggtgagttttttgttaatgtgtacaaccattactgtaaaaagcagatattagtactgtaagcactttcctgttttaccagtcacattgcacattgcttcacttgtgtgccttttgacgttaaccagcaaatcttccccttggtgatttttattgtggctcccccaccaggccactgccgtgtctgcagagatgcccagactgaaggtccctgggcacccctagtgggagggataggagcatagcctgtgagagaaactgagtcagccctgggctaagcactctgctcttgcggtcatctgattccccgaccctggtgctttgagagggatggctcatgagctgagccctgccctgtggcctgccaaacagcccctgtggtgctg

SEQ ID NO: 95415 - DNA, 1045 bp, Homo sapiens
tcctgatagcctcctaggggagatgacgaggcaagcaggaggtggctcattgcgattactcacagcctgcagtcctctctgttccgggaggatcacacgttgttttgcccagactcaggtgggctgtggtttgagcctgtgcttgagggcacctgcaggtcgtcagggtaaagcttctccctagcagcctgtcttcttctccccacctccacttagtttcccttgaacattagactaaattcccgtgaaaagctactctggacacactgccacgtggtcagtggtctgcttttcatgtagctgtctgtcctctcctccaacccagttgccctttagacaggcagtgtaaccattgtcctggcctgccctgggcatccatgatacttcccctgcaaatgctgttgtcctgggtagacctcctgggcctctctggggaaaccagttagcccacagcctgatgcatctgtgtcttgctttcagagtgtgtgagctggaggagctgggagagctgtccccttgctgggagagcctccggcgccaaattgtcacccagtaccagaccatcatcctcacataccaggagaacctgaccgacctccatcagtacagaggtgggtgcacccccatgctgtcaccacacacgcgtgcgcacacacacacacacacactctcactctcactcagtcactccctctgctttcccagccagggatctggaacacagggtcacttacacattcccactgacagacactttaatggatttttaaaaataacttcttatgtaggtgtgaattctttcaaatatgggtttttctgatcttaattaaaaagacaaatctgtgaattgcagtgaagagtcctcctatggtgtcatctaccaaaacagccactgtggaatgaaatttaggggaggcgaaatcccgggctattactgcttcatgttgtttcttcatcttggactaatgtcagtataggatgtactaacagaaaggatgtaggccactcgccttgaaacaaagcagtttttcttgatttcccagtt

SEQ ID NO: 95416 - DNA, 2100 bp, Homo sapiens
ggtatgtatttgttgaagggtacacagccacctccttacacagaagtagatctacatacagcacattttatatatgtactctaaatattgggggcctgggaagaatcctttttttttttccactgtttttggagtcagggtcttgctctgtcacccaggctggagtgcactggcaccgtcataactcactacagcctcaaactcctgggctcagttgaccctcctgcctcagcctcctaagtagccagaaccacaagcacaagccaccatgcctagctaatttttaaatttttttaaaaggtggggtctcacgatgttgcccaggctgatcttgaactcccaggctcaagcaatccacccaccttggcctaccaaagtgctaggattataggccaccatgcttggctgaattgattttttaaaatcctattttgagattgtctttttaagatgaaatggtcttagaaggcagctattcatttggaagagtgattgcagattggaaagtagtgtgcacatcatgctgtggaatgactcctgttgtgccccacgagcttgagtgcggtctgctgcatgggcttctggcacatccattgttttttactgtggcgtgtgggcttgtggtggtggtgtttctttccggggtgctttggttttcggtttttgcatgtttgccacataatccagcaagggaaggggtagtggtggtttcttgatgaaccactttgggacttccctgggaaggggccaatggggaagattctcagccctgaccaaggtgactgtcatctccaggggaagtgatggaggatgtggtgagaggtgccctcgctcctcctctctctctcttccccagaattcaaagggtagccctttagggaccagtcaggacccctcatcccatgagcgaagggacacccattctacccagagctcacaatttcaaattttaggaggagacctctgcattggtggcttgtacttcttcctgctttcttcagcttcctcagatggtctgaaaaataaatttataatattggattgattgggatcaggctaagagacatgcaatttatcatcaccgtttagttggacccaacacactggccaggcccccacagcgggaggatgtgaagttggtctttcagagcctcctgattgtgctgggaggggctgggctgtaggcttggcatcagatccctagacacacacgctgcttggtggcgaagaggtgggaaggagggagagccagggttacaaagccactgaggagtccggctttgcctgtggcttggcatgttctccactttttcttcatttgatgaaacgttatttttcaaagtagggaagtcctggagcgaaggaaagggaaaggaaaccccattttctagggacttgctggggtcagacatgagaggaaggacgactgtgggtatgttcacagggagcttgaatgcctgattggccaaaagaaaaaataggttttggttgtttggggacaaagtctaacacccactgcagtctctgctacactgtgataacctgaccccttcttctgtaaatggcctctatgtctccacttaagtactgcttataagttaatagatgaggttgtgaggtggaagattacgatcatttgggtgattatgggatatgattgttcaatacctgttcatacatttacatacacaagtaaaaatacagatacatgcaaatacagataaaagactgagtcatagtttaatatttcaagctcctgccatatagacaggaagaatctcctaagatatactttgctcatcaacaactagagtagcttgagagaacatccctgagtcacagaacacttcatcttagggtcaattgtggctggggttggaatgatgctgtcatccttttcagattctggagaatcccttagaatccattcttatcctttccagtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgag

SEQ ID NO: 95417 - DNA, 1167 bp, Homo sapiens
tccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggtgagtctgctgctgtggctgtcatcccactgctgaacttgggctgaaaaccacaaaacctgttgccagtctctgcccctctgaagtgcctcaaggttcaactgctgtgaacaagctccaggtttccttcctggatggctccttggctcctgatgcagggagggaggagactgttttcaaacccttgtgtccagataggggtagggctgtgctgggggctgggccagcctcagacctggatgaagaggaagacaagtgggttttcctcccgtgttggaggtctctccttcccctgcctcctgtgccttctatggccttgggatgcttgagaccagtcagtgctctgtttgctgttagattttccagggctatgtgtatttggggacgtgggagctctggtgctggggcaagtagatatggattttggagctgccgccctgacattacatcacattattgttcctcagagaattggccctgggagcaggatctgtgtttcttgagggagtgacacattgtacaacttgtttttaccatttattgagactactgcttagaggcattgttctacaagcactgaactattaatcagcagcaaagtcccatcctatacactgtgcgtgtttctgcaaatcactcccagaccttcctctcctcctccccacctcccctatcgaaatttctgttcccttctatcaaaaggaggcctccattttgtctgtgtgtgatgattgtaggaagtctgcagtggcaagaggaggagatgagacagtgccctgtggcctttcaggcagcactggagggccacctggcctccagaagagttactagcaaacatctcccaaactctaaaaacaatggccgcaggacatcgattcatcgttgaaaagcaaatgcaactttagtggggaattaggaatcatctttatatttctaaactttgaggtattttaacaagtgtggaagcctagggcaggggatcagtggagggcgattt

SEQ ID NO: 95418 - DNA, 1032 bp, Homo sapiens
ggtcaagagaagggagatcacagagaacctttctgggtgtccttcctctccgggtggaggtgctacagggctgtggaaggagatgggcctctggggacagagcattttctggcctcgtcatgacttgcagaagcttctttgttgttttcctccgaaggcattgtcttgagtatttctgtttagggtccccaacaggttcaggagaccaggcatgtcttggaggtaccggagtagaactggtgtttgaggttgctggaaagagctggggctagagggctagagggctagagactgggttggttccagacagagctggaagatgaggtggagatgggggagtgggaggactgcagtggttaggggccaggtgacttgttaaattgccagaacctaattcttaaaatctctctctcattgtgatgaccccttcgcttgtgccccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacggtaggccccgggagcaccccgagggagaccacgggcacctctcagctcagaaaagacaggcttaggaagcccttccctctcacttcacttgtaaaagaccccagatggccatatttcctcctggtggtgctttaaaggttatttaatagagaggtctacatttcaacacagtcaggagaactaccttggcagcccatgcttgcttctcccaaggaactggcacctgcagagtctgccgattctgcacccaggagatagtgagggcatgcatgggtggcacaggcttctttgctgcgtttttttttttttttttttttactgcacagaggttgagtgagggcaacacaggtatttgctgtcagtgcaaacattgctcgtataacagtaggtgccttagctctgcagcttgttgcagg

SEQ ID NO: 95419 - DNA, 1035 bp, Homo sapiens
ctgtagcaccaaaagggggaagaagccccaaatttctagtgtggtattgtttggattccacccttggggatgctttcagaaccctaacttgcaaagatggaaacagcagtcgctcatgcctgccactgctgagcctggaacccgaggcggggctggtgggggctctgcgcttggttggttggtacctgaggtaaatggtttttgtttgcgtggttgatcaagaggcagctttggccaaatcctttgtaccaccccctgctcaggcatctgtgagaaggtcaaatccccaatggttcttcatgttccgcttgcttctcagaaatccctgtctgtgcagcatgtgggggcatggccgggcagcatggagttgtgcttggccagccgagagagtgaacatggaaaaccattcgttcaacctacatgtgtttattttcagtagattgcagtattttttcttattttcacttctctttctctccttttttcctgtaactgtgctggttttgttttggtcttcctctcatacccgtttctgcatttcatcttttctttctattgtgacttcatttcatttttttttaaccttatcttttgtttctcttgtttatcccatcctttttgataaaatccatcgcatgtgtcttctttttttctttattttctttcctttcctttttcctttttctttctcccaaactttttccttttcacagcattggaacacgggaggtagtcacccagaagaacttgagcggcctggtgcccatccgagacttaaggctagaccccagcctcctctgttccatccctttattagctctgagccccaatttactgattgtgtggctctttctgagcatagcatacctggtgaccaaattgcgttgcaaatgaatatcattatgaaaaattaataagtcacaagaaaaacaaaagtgccagaacatgtccagccaccgtgtacctaactggacagaaggaatgtgtcaaaccgtggtctgccaagaaatatttcatgccttacattttgacgtt

SEQ ID NO: 95420 - DNA, 1040 bp, Homo sapiens
aatggagaagccatatctgaagtagttcattaatgtaagagtttccaaagattaaaggagattaactgtgtataggaacctatagcttctgctttaagtggaagtacgtttttgattactgaatgaatgttaggcaaacacgattgttacttactccagggggcctcctgtggcctaggtgttcagctcagatgacacacatctagctgaggccttgaggctccgtgacaagaaagcatatccaagttaccaaattagttacaacaaccaggtggatacttttctaaactatcggagcttagcttttgaataaaaaatactgtcttaccaaaagtattttacatgttcttgataatgagactgtcattttcactttaaaaggcttgagcaattgccactgatgttttttttttttaaatgcgtgacataatggtcttcatacaatttgaattttttaaaaaatcactgtttcttggtaactgcaaattttacatctcataaggggaattttgtactaaatttgataactagttgatttcactgctagtcttagaacagcataaaaccatcaagttatactgtgctgtgggaagtcatttatgtttaaaatcacttttgctggttagttttatgtctacacctgaacatttcccagagaactccccggacgcgctcactgagtaggtgaggccccctggctgctcatcctcccatgcagtgtttgcttttgccccctggattgccatggcaaccctccatcagatgcagctgaggatgacgctggtagtgagttctctagggaagggcacctgtgggctctcactggctcagtggcacctgtgcaagagggaacacatgggggcagcccacctgtggaagggtggctggctgctaccagaacttggtgagatccctccctcataacattccagccctgattgccaggctgctctgcagacagtgcatgaacccattggattacctggcacccagaacaactgtcctccaggagacagcagaccagaacgccttcctagcca

SEQ ID NO: 95421 - DNA, 1039 bp, Homo sapiens
ttctctgaagctccctgccgaggctccctcacgcccagaggacacatctccccttcttctctagatgttaatgtagggcctcagatgtggcatgtcaacactcccatggggaatttatgaccatagagatagtagaaacctaaatattttcagaaaaaaaattttttttgcaggatttccaatttatctttgaaaagacagtacaatcatgtttgaatgtctgatgaaagtgtcttatttttaggtttgcaataattgttactttcttattctcattcttatgtaagatgactattgagaaacagttgaaatttattctcctcaaatgagattttgaaagggatttatgggccataaaacttaggaatttcatagaaaattttgtctggtcatcttttataagatgatgatgagtcttatctgcacatagcagagtttgtttcttaggagtttatatgttttattgattctgtttacgatgtttacatgttcttgaaaaggttgtaaaagaaatacatatggcacatattaatgatgctgatcctaatgatttgtgaacctcttagaaattcttttgtctaaaagcctagagattcttctggttcctttagaaacatgtaacaaacttgggccaggggtgctgaggcatggggaggactgcttattggcaggaacacagagggggtgggcatcaggtagggtggaactggatgaccttccagaccccctcctactcagaagtcagcatgcaagcagcgcctgctgtctcccgatgcctgcagggaggaaaatgtctgtgaaggacactttaatgaaggacgaagctctctgctgctccctcaaagctgagttcactgtggcaggcaggaagcagagaagctcctgcccgccaaacccactgcacaggtggctgctgctggtatcagattctcctttttaagtgtcaatttctgttcacagacagtttgttttcaatatggctgatttaccctttcacctctccaccatctcatttaatttgtaaatttttagttctgtc

SEQ ID NO: 95422 - DNA, 1093 bp, Homo sapiens
atgattagtggtgaacataatttcatgtacttgttggccatttgtatatctctttggagagatgtctcaagtcattttgaatgagttaaatcattcaaatgggttaaatcccttaaaatggttaaggtggtagatgggtattaaaaaaataggttgtttgctcttttattgttgaagttccttgtatattctagatgttaacctcttatcagatgcatgatttgcaaatattttctcccattctgtaggctgcctttttttttttttttaaatgcacaggggttttgcattttggtgtagtctagtttgtttttacttttgttgcctgtgcttttggtgtcatacccaagtcaccgctgactccaatgaagtttctcctgtgttttcttctaggagttagagttttagcttttaaattatgtctttgatctattttgagttaacttttgtatatggtgtgagtgtccagcttttttgcctaaggatagctggttttcccaacaccatttgttgaaaagatgttctttccccattgaatggtcttggcatcctgtggaaaatcatttgaccatatatgccagggtttatttctgggcatgctattctattctgcacttctgtctgtacatatttatgccagtgccacattattttgattactgtagctctgtaataataagctttgaaatcaggaagtatgcgacctccagctttgttctttttcaagattgttttggctacctggggttccttgagattcgatgtaaatcttaggatggatttttctatttccacacacaaaaaaatcagttgggaatttgatggggggggggtacattgaatctgtagctcacttttgatagtactgtcatcttaacaatattaggtctttcaatccatgtgcgcaagatgtctttccattttttggcattcttaatttctttgcagcaaaattttgtagttttcaatatacaagacttttgcctctttggttgtttattcctgagtattttctttatgatgctactgtacatagaactgtttccttaatttcctttggagattgttcaacaatggtgggttgttttttttt

SEQ ID NO: 95423 - DNA, 2608 bp, Homo sapiens
gcccgctctacataatgggccagtgtcagctccaagtccacatccttattatccatgattcaaaagggagagagagaacttcctttttcagggtccacaaatcaaatctataaaaggactctggtcttcccaggatcacctgcccttgcattggaccagtccctgtggaagaggggatgggggcctgtgatcttggccaggcctgggctatctatctgcactgtcattgctaactcctgtcagaatcacatggatgagtagtgggctgaatcccaaaaggaaaggggtttagagcaagtggaaacaacagatgttcactatagaaagcaagaatgaaaaccatgaagtggttgaagattagccttacagtaattttattctgatcacttaatacagtagagtcaaacaggaatccaagtttccaactttattatttttggcactgaagaattacaaagaactctagcgtctttatacctccgtggttcactggagttaaagcaatcggggcgttgtacagctcacttgagtttttaaaggttctactaaaaagtgagaattccacagcaatatgggtcattgttgcagaatatcacaaaggtctgttgtgtatactccttttcaccaggaaagggacaataatagtttttttcaatgtatatatatataagtgatctaactttttattaataaaagtaaacaactctaaaatgtatattataaagccctgtcatctttgttgagtaatagctttattgagctttatttggagaaatacacataccgtaaaattcacactgaaacttaccaattcagtgttttttattatatctacagagttgtgcaaccatcaccactaattccagaacatttgcatcactacaaagagcaacctgtacccattagcagtcacttcccttctccctcagcctctaaaaaccactaagacactttttatataacatgtagccttttgtgactggcttctttcacttttaccataatgttttcaaggctcatccacatgtagaatctatctgtacttcattaccttttgtgaataatattccatagtatagatgcaccacatttttttatccattcatcagttggcagactggtttgtttacacatttgggctattatgactaatgctatgaacaatagtgaacaaattttgcatggacatatgcttctgtaagagtggaattacagggtcatataattccaaccttttttttttttttttttttttgagacagggtctctgctgttgcccagagtgcagtggcatgattacagctcactgcagcctcacccaggctcctcctaactcagcctcctgagtagctgggaccacagtcacgtgacaccatgcccagctaattttttttgtatttttgtggagacagggtctccccatgttgcccaggctggcctcaaactcttgggctcaggtgatcctcccacctcggcctcccaaagtgctgggattacaggcgtgggccactgttcctggcccaactttaacattttgatgaactgccaaaattttccacagtagctgtaccattttacatttccaccaacaatctttgagggttccagtttctccacatcaccagcagttataattcatgtttgattacagccattctactgggtatgaagtggtatctacttgagattttgactttcatttctctaacgactaatgatgtctgagcatgttttcatgtgcttattggccatttgtatgtctttagagaaatgtctattcaagtccttagtccagttttcagttcggttctttttattgttgtaacagttttttgtatgttgtagatacaagtcacctaaagataagtgattcacagattctcccaatttgtggtttgtctcttcactttcttgatggtatcctttgaagtataatttctaattttggtgaattacaatttatttttttcttttggtgtatctaagaaaccattgcctaatctaagcttaatggaaatttattgttttatcttcatttaagagttttacatttttacctcttacatgtgagtctgattcattttaaaaataatttttcaggcttttatttgcaatatatttttaaaattttaaatgtaagatacatataaaatttactatcttaaccatttttaagtgtacagttcaacagtgttgagtgcactcacaattatgcaaccaatctccagaactccccttcacccccaccacccctccaactctccaccttgacagtcaccattctactttatgtctacagtaagtgcctcgtgtggaatcataccacatttgtctttgactggcatatttcacttagcatatgttctcaaggttcatccatgttgtagtatgtatcaaaatttccttccttttttaaggccaaataatattcagttgtatgtatatagcacattttgtttacctatctgtcagtggacacttgggttgcttgtgcctttgggtaactgtgaataatgctgctgtgaatatgggtatacagatacctctgtgaccctgctttcagttcttgtgggtatatacccataagtggaattgctggagcacacag

SEQ ID NO: 95424 - DNA, 1319 bp, Homo sapiens
tgagggaaaatccctgattatgcagagcagatgagctttgggttatattttttctggtgcatgaatgggccacatgtttctatttaagtagtattccagcctgccttgttaatatctttgtgaagtgtttcgtgccaacactaaaaatattctgattttagggtacccagttcacacatttcacccataaggaaatgaagataaccctttctagatttttatataaacagtttaaggaaaagtatccaatagaaaccagtgttttcaagaattcaacagtgtccttaaagttcccaagttactttacaatttttttttcattctttaggcaccaatagcccaaatgaattaagaactatttcctacataactttctattttcctcctttaacacttttaaaaaggactattttcagaaggacaattattttgtactttgtgagaaaatttccaaggtgtttatattgttttatgtgtctgtcataggaaggaaaatcacctcggcagtgtttgaaggaaggatactgcaactctttgaagtacgcattttttgagtgtaaaagatcagtggtaagtggttaaagatttttaaaagcctatgctaaaaattagctatagggaggttaaatatatgaatgacttaatagttataggtaagttgcagtgatatggtttggaaaaaattacatagataatatttcttcctccagtgagttaacgttaggtagcgttcataaaaacccacagctcattgttatgttcttctgtcaccgtgctaactacagctgctgaacttcatgcatttctgaaagtgtgagaatgaagtctcggcaggtatatacgggtaaaagttgatgttggccactcgagttcagatcagttggcaattgtatacaaacatataatgtggagctccaaggtgtatacatttgtgccttatgtgactaagagaaaatgtcagtatctgtgtttgaattttggagggatggattgtagaaatagggcctaaaaagagattacaaatctctggggttcattctaacattctttgatttggaagatgtatggagatctttggaatggaaactgagacccttttcttggagaaatgtataaaaccaaaaatatgagcatcccattaaaggaagaaagcacttggacttgaggatgttttttttttgttttttgttttttgtttgagacggagtctcactttgtcaccaggctggagtgcagtggcgcaatctcagatcactgcaacctctgcctcctgggttcaagagattctcctgcctcagcctcctgagtagctgggatta

SEQ ID NO: 95425 - DNA, 1080 bp, Homo sapiens
aactgggcgtcctttcattttagccgcaactctatcgccggccgaggggccggacgccgacatggtcactgccaggccgcagcgacgtcaggccgcaagctgtcgggattaaatggcccccggcgcgagcccgggccgcgggagggcagagtggtcctcaggcctcacctggagtcctgctacagcctcgacccacgtccgaaccagcccaccacctcctcccagcagccgaccccagccgccaccgggcgggcttcccttccctcaacggagccggcccttggggcgcgccgcgtcacgggaaccgacttccgccgcggacgcgccacctctcggcccccgtagtcctcggccctaccgccgcggcccgccggaagttgttgccgctggcttccggtcccctgagactggggcctcgctcgctcccgacccggttgcaagtgttgcggtgggagaaagtcgcgtccgcatcggaggggaagcgccgtcatgcctaagtattatgaggacaagccgcagggcggcgcgtgcgcgggcctgaaggaggacctgggcgcgtgtctgctgcagtcggactgtgtggtccaggtagcgcggccgggcgctcccggtggtgacgacccctgtcccaggcaggcctggctcggcggagggcagcgggtcgcccgcggcggcggttggagttaaccatcccgggcgtaggtcacagctcgggctcactgaacgtgcgcagatccactgagctgtcggagccccagttccctgtggggttaaatcggagataacgataaacgcaccctgtcgggtttttgtaaaggttaacccatttcagttcacgaagcctttattgaatgctagcactctactaggctttggagacataaaggagaataagccaggtttcttgcctgcctagaaatgataatctgtagaattaatgattccagagagttgcgtaaacctggtacactgccctggccagtagtgtctcctgcctgttcagttgtgacaatgtgtgctcagtttgacttgtgttgatgtgaatttgtttctgagttacagttctctgcattcttggat

SEQ ID NO: 95426 - DNA, 1037 bp, Homo sapiens
tacgcccgggatggttaactccaaccgccgccgcgggcgacccgctgccctccgccgagccaggcctgcctgggacaggggtcgtcaccaccgggagcgcccggccgcgctacctggaccacacagtccgactgcagcagacacgcgcccaggtcctccttcaggcccgcgcacgcgccgccctgcggcttgtcctcataatacttaggcatgacggcgcttcccctccgatgcggacgcgactttctcccaccgcaacacttgcaaccgggtcgggagcgagcgaggccccagtctcaggggaccggaagccagcggcaacaacttccggcgggccgcggcggtagggccgaggactacgggggccgagaggtggcgcgtccgcggcggaagtcggttcccgtgacgcggcgcgccccaagggccggctccgttgagggaagggaagcccgcccggtggcggctggggtcggctgctgggaggaggtggtgggctggttcggacgtgggtcgaggctgtagcaggactccaggtgaggcctgaggaccactctgccctcccgcggcccgggctcgcgccgggggccatttaatcccgacagcttgcggcctgacgtcgctgcggcctggcagtgaccatgtcggcgtccggcccctcggccggcgatagagttgcggctaaaatgaaaggacgcccagttacatttgcatcgtagataaagaaagagcatttagtataagcatgtccgaaatgttgcgtgggatgtaggcatactaaaaccttattcgtggcctgtctgaaatccaaatggagctgggtattctgtgtttttatttgctaaatctggcagccgtacccgcggccccgggcagggagggagcagctgggctcggccagaccctgccggcgtctggggggcctgcgaagtggaggggagacgggcagccgggcagtggccggcgttccccggagctcggaccggttggattggactccgacgctaccgctccctctgctgaactattccggatgtaaa

SEQ ID NO: 95427 - DNA, 3024 bp, Homo sapiens
tgctttcttaggcattttcttaaaagcttggtggttaagagcacggaatttcgagtcagatttccaatcttggctctatcactatcctcggagtcatggggcagtcacatcatccctgtctctgtaatggtagctgcccctggataagtgttattaggtgattcagaagggtgggctgttgcccttgcctgaggttgcagtctgcggttcccaagccccaagacccgcctcagaactaactgcatttgcttttgactcctggcctttctctagggttgggaagaacatggaaagtgacctccctgccaaataactcagaagaggagtgtcggtagccaaatgtttcttcagaatacgtgtaaaagaaatgtttttcttccatctaggaagatgttaccgagtacttcagtgaattccttagtgcaggggaacggagtcttgaattccagggatgcggcaagacacacagccggagcgaaacgctacaaatatctgagaaggcttttccgctttcggcaaatggactttgaatttgctgcctggcagatgctctacctgttcacatccccacagagagtttacagaaattttcattatcgaaaacagacgaaggaccagtgggccagagatgaccctgctttcttggtcctgttaagtatctggctctgtggtaagtgtgtttatctgagatagaattgaacgctgagtgtttctgattagattttttgttataaatgtgttgtgggtcagaatctggaaatattggaaactatttctcctttttactgaagcctcaaaaaatctcacaggaaagaaagttgtagtcttggttctacaggtcccaagcagatgccagagtaaactgttaccctaggacattgaaaagcaggggacaagattcactccatatctttttaagtacttgaatcggtacccaaatgtcagctgactgtgaataggaatatgaaactggaaattgcatttcacaggcaaatccacagtgagaattgtaaaggtattgatgggaacctgagaaactgaagttctccaattccataatgcaagggtctcatttacctgtagggtgttgaagtgggtaagatattgaagtttatagggtgttttgcaccttaactggacttaaactatgttagtgccttctctacactggcgttctaaatactgaggccaccgtggtgaatcagcctggcaagggcccacctcaggaaacttcaactctctcagtggccacgctgtgtcccaaggtagtgttcacacatcttgggagttttgtttaaagacctgtctctcccactagcctgggcatctggagggcaagggatgtgtcctgtatttccagaacctagcagagtccctaaatgaatcttgtgaatctttctttcagtgtccactataggatttggctttgtgctggacatgggattctttgagacaataaagcttctcctttgggttgtactcatagattgtgtaggcgttggtcttctgatagcaactttaatgtggtaagtaccataactttggtttttcagatactgctgtagcatctccatttgtttgcttcagaggtacaatagcagcagatggaaattgaaacccaggtagagttactaaatgatcaattttgactgccaagattattacaattttccctcctgtgttgccacctatatcagaaaatactataaaggctggtttataatattgtcaaatgtagcaaataattgaaataattatgttttgaacccaaaatatctgagatcggtctcaatttagaaagtttagtttgccaaagttaaggacatgcctgtgacacagccttaggaggtcctgatgacatgtgcccaaggtggtcggggcacagcttgctcttatacattttagggagacttgagacatcagtcaatatgtgtaaaatgtacattgttttaatccagaaagtggggaaaggcaggttacagttagataagagacaaatggttgcattcttttgagtctttgatctgcctttcactgaatacacaatttacttgtgagaggcaggtacaggaatagtcatttatgccttaatctggctcagtgagtctgcatttttacataaacaatggggcagaggaagcaatcagataaacacttgtctcaggtgagtagaaggaggactttctgtcccacacctgtaaagataagctatcttaggaataaaataggaggcaagtttgcctgacacagttaccagcttgacttttccctttggcttagtgattttggggtcccgagatttattttctgcatactaacaaaatgcctggttttgcaaaaatattacagatttagccagttctgcttaagttgtctggatgatagcatggttttctgcatttgtcaatagagaccacttcttgatattcattgtgtttaaatccatttagatctaaagggttattttgtggagtcttactttgaatctttgcattaaatgaagtatacttgaaaaagaaggattttttttttaaacttctcatgccttcctactgagaataaaattctctctctttctctcatacacacacaccctccgccccccccgcccccccaccgccacacacacacacgggctttatcagaagggttctcagtctgactttggttgatttagcaacagcagtgtactgaggataaatctggtgtttggtaaagtcctcctgtgtggttggcatgctggatgaagggcaggggatgtggctagcgatctcagtagaggaccagtggttgggtagacatggtggtcattgtggagaacattttagttgcagagagacctgggttcaaatgccaacttagttatctgtgaaactcttagtcccagtctcttcttttacaaaatctagttaattacctattctgtccaatttttgagataattatgttatgaaaattacctgacacagttaagtgttcaatatttggtagttactaatattttaagcaaaactctgcaactat

SEQ ID NO: 95428 - DNA, 1889 bp, Homo sapiens
cattgaatttccaatatatgtttataatacaagttttgttctttgaagatcttacttttctgttacttggatattttactttttattcatcattgaactgaaaaactagtaggccatgttgtagaacagtgacatacacttgaataattgttcttatggctggatgcgtcactcttcctaactgcttcttactatttcatcctccttttaatagggggttgacccaggtcttgggccttgggcctgttcattatccacattcatttttttggtgacatcattcaggcccgtggctttaaatattaatatcatctacacactgatgagtttatatttccagtttggacttgtcttctaaactctagacattgtatacaacttcttactccatactagttggcatcttcaacataacaggtccaaattcaaacttccgcacactccttcccacctcaaaaccactcttcccacagccagccccacctcaattaaaggcagctccatcttccatttgttcaaggcagaaatctctcagtcatccttgagtatttttttctcatactccaatccaataatgtcaggagctctaccttcagagtatcgtgtgtgccacatcttagcacctccactgccaccagcccctctgctcatctcttccttgcagtagccttctaactggtctctgctgccagtcttgtctctggagtctgttctcagatccgccaccagggaggctctgtcaaggcatttaagtcaaatacttttctcagaactccacagtggcttctcacgtcaccaggaataaaagccaaagattgtaaaacggccacaggcttcgtaagacatggagcctgtgtgacttgatgttgggcccaaccctgtttcttttctggcttcatttcttgctccttttctttcagacactggtcttttcaccattcctcaggcctgccaggcaccatcactatccttgggtctttacccaaatgttactttatgaccctcatatgtacaattgcatctcaagtttgtattctccacatttctctgctgctttctctctttccataataccatctgacataggtgtatcattgtcagccttccttcctagatggaaggcagggatttttgtctgttttgtttactggtatatctccagaatttagaatgtctgccgcatagaaagtcgtcagtaaacatttacagaattcattttattatgaaagaaattttaattttgctcttaggttcatctctaacaagtatttagtgaaacgacagagcagagactatgatgtggaatggggctatgcttttgatgtgcatctcaatgctttttatccactcctggtcattttgcattttatccagctttttttcatcaaccgtaagtagcagttaattagagtattatccaagtcttcattgcatgcattggtaaagggactcatggtctgcgtctcttctggcagatgttatcctgacagacacatttattggatatttagttggaaataccttatggttggttgcagttggctattatatctatgtaactttcctgggatacagtggtaagtaatttttttaaatgtttttggttgagaacatagcaagagggggaaagttgtaacagtagtacaaacagctgcttttatggaacacttacaggcactatcctaagtattttatgtgcattatctcatttaatcttcatgacaattacacaggtttgtttctgttttcaaatgaggaaactgaggcagagagattaagcaacttacccatggtcatgcagctagaaaatggcctagctggtatataacagattttatactttcaaggaaacatgttaaaccatactggttatctccagatgacttgca

SEQ ID NO: 95429 - DNA, 1905 bp, Homo sapiens
attcttagttttcatgattaccgtatggttctgtagacaatcacagaagatcgggcccaacatttattgtcctcaggacatgtttgcagatttactgttaaatcctgttgtcagttcatttttcttaatatgaatgaggaacatatattatttttcatttatgttaagaaatgatcccattaaataaagccaaataaaatctagagactgcgctgtacgtttcttaccccttcctttcctgttactgtagatgattagggcctaactgtaaatacagatggctctgactatgcctggctccggagttattcccaccccggttctctccccccttggctggtttgtcagggaacacttaaccccttcattgtaatgccttgtttggggagtgctttctctagtccaggggagatgtttgtgtcatttctaatgaattttgaaagtgttttgtgatgagaacactgcagcactgtggtttctctaagtggttatttgaacactcctggtaacgacctataccacttagaatagttggagtacagctcagtttgtttaagaacttcctatatgagaaatacttaggtcgggatgcatggggtagggtcccgctaactaagcagtgagcaagaaacatcaatatttggagccagacttttatatttaagagtttcagttcttttctgaagcctgggctactagttgagctcacaccctcttaaagtgggggtataatgctttacactggaaaatctcaaatagctaaaagatgttttcctataacgccatccatctctgtactttaagttggactcctagaggtttctgaggcagtcacaagtttaaattcaccactgttttcatgaatatttgtgacatttctccctcattgttaacctctcttggtccagtgtatgatgtcccactcagcctctgtgctgaaataattcctctcctaggtttcttcccagccctagacaaggaggaaacagcacagaggggttgggaagagtagtctagttctgggcataaatagcatcatcttactgattcaaaatatgcattcccttccaccccacatgttgaagtaagctgtctttcaaaatgttcatttattagtcatttatttttttttttttttaaatcagtttggattcctttcttttccagcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactaaagcatgtgtgttcactctaatatttgcaaatgtaagagctacatgtaaaatgctaatggcatggggaaaacataaacataaaacaatatgaattatttttgaaagagtatcatctagttggagaacaagggaataatcatacagccccatcgctctcctattgacaaagatgcataatctccatttctaattagctgtattttaaatacttacttacataagccacaagatcccttctaaccttcggaatcctctataaacctgtagtgtcagtcaaacgggagtcactgtacttcaggccctaagcatcattagcagcattttctacattaaaaacttacttatagcccctaaatattttagatcaaagaggcccaggtagctactctta

SEQ ID NO: 95430 - DNA, 3129 bp, Homo sapiens
tgaagtttttaaatatgcacttcttcatgaaaaatataaaagctgaatgaaagtagaaagaagggggaaagaaattacctgtgccctgtcaaaagacatctactagaaatattttggtgtattcctttcctgccttaactcagtgatattttatgtttgcttatctcggtgtatccaacaagtattgatttttattttgaaggaaaatttgagaatggtgttgcagaaggaatggtggatccaagtctcaatcccatttcagcctttcgactttcagttattcagaattctgctgtttgggccattcttaatgaggtaagcatatatcaaatcagtgaaacaacttagaaactacatttttattatgtttttattttgtatttaaggcctttttggaattgagaattaacagctttatcataccttttatgattttgtatttcagattcatattaaaaaagccaccaactgatcatctgagaaaccaacacattttttcctgtgaatttgttaattaaagatagttaagcatgtatcttttttttatttctacttgaacactacctcttgtgaagtctactgtagataagacgattgtcatttccacttggaaagtgaatctcccataataattgtatttgtttgaaactaagctgtcctcagattttaacttgactcaaacatttttcaattatgacagcctgttaatatgacttgtactattttggtattatactaatacataagagttgtacatattgttacattctttaaatttgagaaaaactaatgttacatacattttatgaagggggtacttttgaggttcacttattttactattatagaccctcttttatagattatcagggattatatatataaatatataaatatacataaaaatgttatggaattaatttattagaaacacttaagaagtacatatttttgtgcagtagatttttgaatcgatactttttttgaaaaccagtttccttgcttttttaagttctttctatatttttctttggaaatgcaaacattacaaaccaatgccatttttcaaatgcactgccatttaagattgattatagatggatttcttaattgaagtacttttataatcacagtgactgaacaaaatattttcaaagacatttgtcattccttaaagccaagattttaaagactaatgtccttcctgagggttactttactatactgtgtatggtgtatagccacagaaagtcagtctgataaattttcaatgtgtaagtgtgatgcattcaacccagattattgtagacttaacttattatatttcctctgatatgtaaaatgacaaactcttctttcctttttaatctttgtctttaatccatgaattaggtgcattatctgctgttgattcttttatatctgcactcattttatgacgtcagacaaaatgttttctaggtgttgctattgtatgagtcataattggtataattttaaagaaaattgtaatattgttttttggtgaaatatattattagtagtatattttccaaaatgattttattgtagtatgaactgataagtgagtcccgtgtccaagagactgtatttattactcttaaacacgctattccaaatgatattactactataaacaaagaatattaccggtctcagcaatcagtgatctttataaaagtacttttaaaaaatgatgaattatcaccaggcgctgtggctcacgcctgtaatcccagcactttgggaggccgaggcgggcggatcacgaggtcaggagatcaagaccatcctggctaacacggtgaaaccctgtctctactaaaaatacaaaaaattagccaggcgtggtggcaggtgcctgtaatcccagctacttgggaggctgaggcaggagaatggcgtgaacccaggaggcagagctggcagtgagctgagatcgcaccactgcactccagcctgggcgacacagctagactccgtctcaaaaaaaaaaaaagatgaagtatcaacatcagttcccagccagtctgcttggacacactggggtgccacaagtgggttgcaggttggttgcagacgggcagagatggattctgctgagctttcagagtgaccactggctggggcctagcgctggggcaaggttccagctggctgcctctagcctggaggagcttcatctagttacccaatgtgctgaaccaacagcatgaaatagcatcatttcctgtgctgtgttacaaagtgcaaacgtttggaaacactgatacagtacaattatttccatcactccatgttgttataatttttagttacttttcttgattgaaaagtcaatcacattgccaaaaatgatttttatgtcagttaaaggccagttgaaatttttttattaggatgttttaaatttacttttcactttcttgaatttttttcttctcaaatttccttggcccagtgcccatgagcaaatttcattcaaaaacaggaataaccttttgtcataaaattttggcaccagcttggtatactaaattactgcaaagataactgagtaccagaagtaaaaatctctgcaggtgggcttaggagtactcttgggtccctggttcctcagttgccaactctggtttcatgaagaaagaccatgctctgaaaatctagggaggagaaagttattgcagcacctggtgtgatttgttacaacttctttaaagacagcctgcctggctagctttttcctgttttcatgcagtttgccctcccagcattggtccacctgttgttcccaagaaactcattcttgttcccaagactccttttagccaaatctttcctatcattccaggacttttttgtgcttctctccccatgaatctacccgtgcctagggtgtgtgccaggcacgtggcaggtggccagtcagcatctggatgtgagaccaattattccagcctgccctcctctttctctttttatcattttgtattatttttgagacagggtctcgctttgttgcccaggctggagtgcagtggtgctctcatagctcactgcagcctcgatctctggcctcaagcaatcctcctgcctcagcctcccaaa

SEQ ID NO: 95431 - DNA, 1053 bp, Homo sapiens
atgtttctttacggttaagttgaggttatgcattgttggcaagaacaaccacagaactgatgttgtgctcttctcggcatgtcacatgcttgaagtcgagagataagacattagtttttaagatatgtttagtgtttttaagttttagttgtaaaatacagtttgctgtttatacttcgcagccattcattttttagtgtgaagtttaatgtctttcatttttatcagttctttttttcttatggttaagccatgtgaaaatgaattacagtattacaggtatgcccttgtattctttatttttcttcctgaaacttaatatattttgatccatcagttattcctatcaatttgagagggtataatacttttgaaatagaagtgtttttctgtattgtccttgtacagttttttaatataattactatttttttttccagtttcaatagtcatgggcattcccacagtgaagagagaagttaaatcttacctcatagaaactcttcattcccttattgataacctgtatcctgaagagaagttggactgtgttatagtagtcttcataggagaggtaattatttaattgttgttatgtttttaccaaatatagcctataagagttgaaactctaattgaatatttgaatatgcttttaaaaacgctttttaaaaaatgtgatgagtaaagcttaggtaatatattctatctggtagtttaatgtaaattgaactcacttctgtcctgcaattacaaaccaggaatagtaatatttgttgtcaataggatgttacacccgtagatctttaagaacgtgtgcctatttctagctctaagacttaaatttggagatttgcactgatgatctttgggagtcctgaaacctgaaaaaggtttaggctcagctggggttttatcattcttttattctctccatcccttctctgtactcctaagaaatcatgtgaatgagaaataccacacttcttgtattttagtctcctcaaaagatttagagaaagaataaatcttgagcaagttctttttaaatca

SEQ ID NO: 95432 - DNA, 1050 bp, Homo sapiens
agagcaagaccctgtcacaaaaaaaaaaaaagaaaatggaagtgattgatggttaatgtacttattatttattacattttcataagccaacagtatatttagagtctgtttggcaaacttgagttctaatacattatagaggtgagcccttagcatcccaccttcttacggtcctctagctggccattttggtttccttcagccagttttatcaacatcatgacctgtgagactttggctttgaaagtgtccttttcatcttaaatggagatctcattcaccagagtgtgaaactaggaaagaaaattctttagttctagttcttattaatttttactgctggttttataaaatcagcaacttctgtaaggtaattcttgtatattaattatacttctgtgtttcagataataccctaaagctgttaaaggagttaacaagcaaaaaatctcttcaagtgccaagtatttattatcatttgcctcatttattgaaaaatgaaggaagtcttcaacctgctgtacagattggcaacggaagaacaggaggtatgtttattttgtttcttactgcagttgtactactgctgttaaatgtgttttggactattatgttgaccatcagaagtctgggaggtcaaaaaatgaaagttctttctttatctgtgcacatcagatcattctaaactccatgttgaaaggaattggacattttccttcatagaccaaagtaatacagctgaaagggatcatgtgaaatctagttcaggccccatcccaggcagacaaatgttgacacctttgtcatttttctgtttaagaaacttgggaagtacagagatgacttgccttgtatcttatttcaaaattaacagctcttttggtcatgtcataaaggtttttcttatgtctgccccacttttcctacagaggtgtaagtagatagtaacttttatgtaactttttatggagtagtagaaatactttgatttgcttcttttttcctaatttattcaaaagataatatatagcttatttttctcttcttgtc

SEQ ID NO: 95433 - DNA, 1005 bp, Homo sapiens
gagttatttcagagagggatgaatactgacaaccaaacaagctaaggcgatgacaagtgactgaggtgggaatgacggctgtttagatgcgagtggtcacagaatgcctctctgaggaggtgacagttgaactgagacctaaataataagaagccagagagttggagtgaagaggggtcctggcagtatcacagcaagtacaaaagtcctgaggccagatgagtgtggcacattaggagagtgtaaaaggaagctagtgtggctaaagcactgttaggggtagggagtgttgggggtgtggtgggagataaagttggaaaagcaagcaggggccaggtcacactggatatggaggccacagggacatctttggattttattcctcagtgggaagctttatgccgagggtgtaccacagtctgattgacatttttcagagattcctctgcctttaaggaggtgttctttatccagttgaggaagttcccctctgttcctagtttgtagaaagtcattactttttcatatatttttttctactactttttctctatttccttctgtgaacgcttgggggtatcctatactctggggcctctctgttcagtctgttcagtttgttcagttttcctcaatcttttttctctctgttcttcagactcgataatttctattaatctaacatcaagttcactgattcttctgttcttctgccatctgaaatctgctgctgagcctctctagtgaattttaattttagttgctctaacaactaaattccattttgttttatatttcctgtctcttcgttttctctattcattgagtcagtttcctcacatggtcctttagttctttaaacttggcttcattagttcttttaacttatttatagtaactgtttcgaagtcttcatctgctaaacccagcatctgggaatactcagagaccacttccactgactgccagaattttatttttcccccgagtatgagtcctggtttc

SEQ ID NO: 95434 - DNA, 1357 bp, Homo sapiens
ttctctgagttgggctctaattttgggggaactcttgggggaaaatgaatgaaaaacttgctaaggtcctttttgctttatatacaaatatgtacattttagaattcatgtttttattgtactaaatgagaaggcttaatcaggaggtgctttgtttttgtttgtttttgagacagagtttcactctgttgcctaggctagagtgcagtggcaagacctcggctcactgcaacctctgcctcctggattcaggcaattcttgtgcctcagccacaggagtagctgggactacaggcgcaggccatcatgcccggccaatcaagaagtagtttgaatagttaatcaaactattgattgtccctgacatgaacaaaacaaatgactggctattaaaagtctgtttatgaaataagagggttgatgagcagaaaagtatatgggttttttttttttgtaggaaacttacctattcagagaattatagtagtggagaaacttgacccttctcactgtgccttatttgaaagatggcaagtcttggaatctccatttaattttccttgtttcttatgtaaaggccttataataagcataattattaagctgtctttagaatgaaaattaattaaaaaaataaagattctttctccacgcagtgttagatgcacacatacagtctgttaactttgatcatcattctctgaatagctccataattcttctttgcaaacttctgctctgattttctacttggtgttttttccagactcttccaggtatcaacacaggtttctggttatggttacataaaatcttctgtgttaaatgttatcgtttctgtagccactcaaactgttgggcatttggattctttctagatagttctggcagtcagacagcctgggttttccagagaagtcctgatttgagagactcaattctaatatacccataaaccacgtgctctgatttttattttgaaagtgtggtttctataagctttgatgttgctaaactaatggtttttttttgttgttttttcattcattcatgggtcccttacatgtacctatcttgcacctagccctatattatatgctattaataagaaaagcaataagtaattttatgcctttgagcagctcagggactggtcagggaaagatgcatgtaaacaaatttaccatcagatagagttagatagaaacaataacagtgcttgcctgtaagtgtattatatgtattttaatcctcataacaacaattggagatattatcccctttctgtaaatggagaaaccaaggcagagtgactgagaaacttaccaaggtcatatgttaagtagtggagttaaag

SEQ ID NO: 95435 - DNA, 1084 bp, Homo sapiens
atcccagcactttgggaggctgaggcgggtggatcacgaggtcaagagatcgagaccatcctggctaacatggtgaaaccccgtctctactaaaaaatacaaaaaattagctgagcgtggtggtgcatgcctgtagtcccagctactcgggaggctgaggcaagggaatcccttgaacccaggaggcggagcttgcagtgagcctagattgcgccactgcactccagcctgggcaacagagcgagactccatctcaaaaaaaaaaaaaaaaaaagccaggcatgtggctcacacccataattccagctactcaggaggctgaaaaagttgctacttcagaaaggacaccatgtaccaaatttttcagaggcctggaaatcttgttgccttaccttaaggcagagcctgtgctttatatcctcagccaaaaggcaagcaacctgggaatttacattgtacgacaactcgttgcctctcaggagactgtgcttgacagccctcagcttccagacttaacagctgcatccctagtgtcatacggggtgtggcccaccattggggtcccaccctgggcccctcaactcgtcatagcagaagtccttctgaaagaaaaaaacaataccttaaggctgaattttaataggcactaaaagaactaaccatcacctatcagaaagtcaaaatgaagtgatgagacgaatctgtcccacgtaggcgtagttgaacacctctagaaatggtttaacattgaggatttttgaaagggttcattttagatcttcccgaatacaaatagctcagtaataatgccaaatgtgggtctgaaaactttgtcatcctctcctacaggagagttctgtgtggaggtattttaagagtgattcctgggaatgcagatgaaaacggctctcatctcgggcagtgtgtcctgcatccgggatggccaggctcgctgtaacacacagcgtgtgcatggaggagagagcgccgccgtggatagcgggactgcggtgcacactggtgtggcttgggccaggctcctccatgatgcagcgccagcagggcagccccgatcagacccgct

SEQ ID NO: 95436 - DNA, 1050 bp, Homo sapiens
ggtgcggtggctcacacctgtaatcccagcactttgggaggccaaggcgggcggatcacaaggtcaggagtttaagaccagcctggccaacatggtgaaaccctgtctctactaaaaatacaaaaattagctgggtgtggtggcaggtgcctgtaataccagctacttggcaggagaatgattgaactcaggtggcagaggttgcagtgagcagagatcacgccactgcactccagccttggtgacagaacaagactccatcttgggggaaaaaaaaagaaagtatttccacacacgtaaagccagagacagtgtgggaagacagcctgggcagaaaagagcattgttgcgttggtcgtccttatttcacacggtgaagttcatgctccgtgtgtttgttccttgtcccacgaaggtctctgtcgtgtctccagaccacgtgagcgacagcaccgtctctgcccggatctcagacaacagcctggcaccagtggctgacttcagttatcctgcagaatcctcctcctgcctggacaactctgcagctaagcacaagctccaggtcaagccccgcaaccagcggtcgagtaagatgaggcggctctcatcggtaattgggtttccttctccacacagaggcaggccaggcaggcttggcacccccctatgcccccccccaacctgcctcactcccccacacagggtctcatgccccctctgagcaccccacagttgatggagccatgctgcaggagctgaagttgctcatctttttaaacataaaccagatctgtctctcccttgcagaaatgctccattcattcatccatccgtctgtccgtcattcctcacacactcactactgaatactggttgccttccccctgcactcagaggaaagtccacgctccaggcctggcacatcaggtcctgcctaccccccaggcttcttaccttctttctcactcagcgttctggccacctttctgcctcttgagctcaagagctgcctctagcctcaggccttggtgctgctgtgtcccagccttg

SEQ ID NO: 95437 - DNA, 1030 bp, Homo sapiens
atggaacctaagcaaggtgcagagagggcagtaataagccagccgctgaacctcacagtgggctccgcaactgggatctcctgggactgtccgcctggagggcaggagctgcaccccctgtctctgtttttagtactgtgctgtgcacaggcaggcatccagtaaatgtttgctgggtacattgtcaaacaaggatattatccagagttgccttctagctcaaaagtctgtgaacagctgaacccatgattatatgcacctctagtcccctcttatttttgtgggaatggtaaggaaaaactataacttgagtcttaactatatctcccaagttaggtttgtaaataatgaaaataaaggttaatttttctcctttcattggattacatggaacctccctactttaggaatctaaagtgaccagaaaaagttatgaaaccttcaaggttttggtgttttgctcatctgtttcagcagaagtcactgattttctgcatactccatgtaatgaatctggtatgctgagataaggacacctgtgactgagatgatttctttggcgtccgtgcaagataaaaggtaggtgctaagaggagcaaggcaaatatatatttagcgatgctgtcagtgccttcacgtttaataccagaagggtaaaaggaacaaaccaccggtacatgcaacagcttggatgaagctcaaaagcatcacactttgtgaaagaagccagtctcaaaatgttacatactgtacgattccatttttgtgacattctcaaagagacagaacgatcgtgacggagaacaaatcagtggttgccagggggaagagtgtgtggctataaaggagcagcatgggggaggattttaggggtggggtggtgatgggacaattctgcatcctgactgtgctggtggctacatgactctacatgtgtgtcaaaacccatgggcttgtatgtcaaacccaaggccgatttatggtgctatcctttagaaataacgcaaaatatttccagaagggtgagcaa

SEQ ID NO: 95438 - DNA, 1047 bp, Homo sapiens
cctctacatgagtggttttacttttagtatctgttgctgtgagaaacagaggttctacagattcagtaaggttgaatttcattgcatctatgaacattgaaaaatagtaatagcttaatatctaggtgacgggttgatctgtgcggcaaaccaccgtggcacatgtttacctgtgtaacacacctgcatgttctgcacatgtaccccggaacttaagaaagaaaaatagtagttcacactcctattaatgctgagattacaggcatgagccaccgggcctggtctttcttaacaattttttttttttttttttttagtcataaaaccaattatttaattgaagctataaaaaaggcagtataagcgataaaataattaggaaagaatatttagcatgtttcaaaacatttaaaataggagcagaacattttacaaaaagttgtacaggaaattaaattctaaaactgtaagtacaaacatgacattacagagtatcttataaaatacaaagacaaatataaaaggactatgatgctttaagtctgaaaactattggccaaatatttaggtttatatttacagttctgggtatgagaatcatattactatacacaactcccaaaccagtaagtagtattttccaattaaccatgtgtggtatcatcttctacaaagtctttggccatctccgctgtgatcacatcaatatgactaaccttatttctgaactttacaccatagaatttgtcagctgactcaagcagttcaggcctaaaagtagttgtaataaactgagcatgtacagcaagttccataatcatatctgacacagcctttctgtgctgagcatccagagcctggtcaatctcatcaaacaagtaaaatggagccgggtcacatttctgaatggcaaaaatcagagcaagggctaccaaggatttctgtccacctgaaagctgttgcatttctctcatttcaccttgttttcctgtaaatgacaccctaattccaactccagtaaactgctcaactgatgggacactgctt

SEQ ID NO: 95439 - DNA, 1442 bp, Homo sapiens
atgcccagcctagtagcatatgtttttctaaagcaaatccatgccatttctaggatgtgtgctaggtctgtggacatttctggcctctctaaaatttctttaccattttttctccaaaattatctttcagttaaaatatagcatacccagaaatcctggaaaagaaagatatctaactgctttttaaaaattactgatatataattttttaaatgttgtatttaaaaaataccaaattaaatgtttttaaggatcctgtttgttttcaatttcacttagaaaatgatgctatagtttagcttgaaataatggtctaattttttcctctttggcaagataattttagatactgaaaaagcacaaaataaatctccttctagacttgattcctttgtcaagactttggaagcagacaaagatcactataagagtgaagctcaacatttgagaaagatgatgcgaagtaggtctaaaagtccaagacgcccatcaccaactgcccgggtaggttttataaacttacaaatattttggagtttgttgcccagacactggcttttattctttgttttacctaatttgaaaataatttgttttgatttgctgtgaattgctgtttcaaaggggttgagagacagaggtctctttgatggcacagtagactactgatattggttctttatcctcagcataattagcacttgggaggtaatcaggcaaatgtggaataatttggaatgaagctgttttaaaaagatgtggtttttaaacttattttttataatttcctttcattatatagtcttattttcttaaatagaaattgggcactaccatcagtagcacctttctatcagtactatatatcaaagaagatttcaaattccttatataattatagggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggtaaacttacaaaaaacaaattatataagtaataacattgagttctagagttatgtaattcttctttgagttttatgagactgcttaaacctgcaaatcaagttaatctaacatttggggattacatatgtttttaagatattcttaatgaaatgtagtacatttccaatacagtaggtatgtgagtacacacgtatgttatccccatagccaaaaatcatacacatgtataaaaatagtcttatttttggaataagatatgaagaaaccgttaaatgataagttgttatgagttcaaggtaaaaagatcaaatcctgacctttttaccttgaacttgccacaccttatcacatcactttaggaacttttatataatttgct

SEQ ID NO: 95440 - DNA, 1060 bp, Homo sapiens
cgctttatttttccctgtagcactttgctgttcctttccccttccctcactgtgctccagccatgccggtctccatacttagaaccaaccagaccttcttttgccttaggacctttgttagagctgtaacttttgcctgcaatgttttttgcccagattttcacatgattgacttcctttcctctgaagtttttggtcaaaggtcacctttcaatgaggacttcctgaccaccctatttaaaattccaacctgttcctccataaatattcccagtatccttaactctgctcttctttttctagtatactatataattatttgttaggtttattattgtctattctagctggaatgtagaatccacaaaggcagaaatctttgtctctcttgtttacttaactcaagtgcttagaacgtgagcgctccttgtattatttttttgagggatgcaatcactaacatattttgactattatcttttgtttttctttttttggctagaatatatactacatgagggcagagatttttaccttttttattcattactttacccagcacataacacaatggcaggcaggtagtaggcattcattaattgttaagtaagtgaaaacactgagttagcagtttttcatttgggccagttattttgtttttcagagtggaatcaacatttttttaaatcactgtaaaattaatgcatatttattatacaaaattttagtccatatagaaaagtaaatgaagaaaataacatctaccataatcataccttgttatacctagacataatcttcagtttatttggttatgtttatatgtaggatgtctgcgtataaatttattttttatgagaatgtgtcataccagatactctgttttgcagagtgaatttttatacttaatgtggaaatcttaacacattcagagtagacctgtatctttttagtgtctacttagtagtatacattaaaacattgaaaattgtctattcaaggctatacataaggttatccaaactctatgtaattatgttctatttctaagtacttcact

SEQ ID NO: 95441 - DNA, 1019 bp, Homo sapiens
ggcaagccatactagaggataggaaatttgtagaaaacttgagaaactgaaaataatgcccaaattaaatagaaaaactattttgatacttgataatatatatttttaaatttgtaggtaccaaagataatactaagagatgtaatctcagagaaaaaatttccaaatacatggacagagcggaaaacataaagaagtacttggaccaagaaaaagaaggtaaagaggttgttttagaaaatgcatccataaacaactgtgactgtccattcacccaatgtttctggctcctgccctttggagctctgtgtggtctggaccagttgtccctgggagcttacaggatttaatctgtatttccactcccatacaggagttgttcttaattttttgtttgtttgtttgttttggcttttgtttttagttgggggtgggaatatcagacacccctttgaacatctcatgaaagctatacttactggagaatgttccatgccatttttaaggggttcacaaatccctatgaagcttatgtgtggaccctatgttaagaaatactacagggaatactgaatgtaaattgtgtattttatttatatttccctttatgaaatgaccaaaatcatgaaagaagctaaagaaactcctgggatttctctcagattttgttgtgaatcaaaacacctcaggagttaagcattcctaatgattagaggtcaggtaggtattgttccctattattagttccctactcctaagcatccagtttacaaatgtctgtaaatggccatttccacccttacctgagtgcatacttgctgctttctatagccaaaggtactgctgccctcaaaagccagtgcccccaggccccagcttttcttcctctctatactttctacacccctttccccatctcttcctactatcctgtatcagtacataccctggggaccccccactgagctcctttgttcagtgggaataaagttatgtttccttagccccgatttgaaatt

SEQ ID NO: 95442 - DNA, 1053 bp, Homo sapiens
agcctctaaagagagcaatcactacacttatggctgggattttgcgcttagtagttcaatggcccccaggcagactacaggtaagtgtttcttttcaagaatttgtcttttctaccccttatgaattttttttttaatcattacaaggcaagctaagttcttttttttatttttttgagacgaagtctctctctgtcacccaggctggagtgcagtggcacaatctgggctcactgtagtctctgcctccctgattcaagcaattctcctgcctcagcctcctgagtagctgggactacaggtgtctgccactatgcctggctaatttttgtatttttcatatagtcgggggtttcaccatattggccaggctggtctccaactcctgaccttgtgatccacctgccccggccacccaaaattaagttatttcaccagttccttttcgaaatggtttagatattgagagttaatcttgtttatgtatggtttttctgctgttttatccctaaagatctagaatcaaaaaagatctttttctggaaaacatgccaataaaaaatggctgtcattgattccccttggtctgtcttaatcttaaagttttaggttgtttttccccttagattatggaaggagtgcattttcaataataaaatattagaaaaatatagaaaatcagaaggaagagaaataatctgtaagagaccctcagtgttagtattttcatgtgtctccttctaggcttgcttttagaaagtgcagtggtgctgcctaatctgctcataagggccagagcctagatgagcctattgacctgctcctggctgcagaggacaacaatgtaaggggctttgtatatattaccttaacctcagattaatcctgtgaggtcaatatgagttcctttttagagctgaggaaactgaccctctgagagagtaagtgtctcatgtctcacagctggtaggcagcagaactcagcccagtgcctgtcttctagtggtttatgccatctctgcaatgcaggaaatgctgggagggaatgatggg

SEQ ID NO: 95443 - DNA, 1033 bp, Homo sapiens
ggtggctcacgcttgtaatcccagcacgttgggaggccaaggtggacggatcacgaggtcaggagatcgagaccatcctggctaacacggtgaaaccctatctctactaaaaatacaaaaaaaaattagctggacgtggtggtgggcgcctgtagtcccagctattcagaaggctgaggcaagagaatggcgtgaacccaggaggcagaggttgcagtgagccgagattgcgccagtgcagtccagcctgggtgacagagcgagactccgtctcaaaaaaaaaaaaagaaaagtttgcatattgtctgactgcttttaccctgtgatggccaagctgagttttggcaatggagactacatagctctagagctggaaatgtttactatctggtcctttacagaaaacggttaccaatccgtggtctaaaagtatatttatatgcttttagctttatattatgttagtgcttagatgggatgcgttcactcagctagggagctaagatatacctttaataattatagggtaggttggaacagacttctgttacctaaagattggtgggtatggatttctctactgacagaattctaaaaaacaaatgatttatatcatattttagactgtgacaaaaggtgtggagtctcttatttgtacagattggattcgtcacaaattcaccagatcaagaattccagaaaaagtaagaacaaagtttgatttttttaatgttagtgttgttttaaaaaatgttttaagtggtacccgtttttgtaatattggaagattttatgttaaattatatgtggatgtaggtgatggtacagagtttaaagcatagtgggatttatgtgaatggtgatcataaaaataaaactgttctgtcacttgtgtcactggccttcacagtaatgggtttttattatttcagtctacttattcctgcttgtggtttgtacatgtgtgttggtatcaccattgtcctgagaaagcagtgggtcttcctactcaggctctcactgtgtcactctt

SEQ ID NO: 95444 - DNA, 1289 bp, Homo sapiens
ccagcactttgggatgccaaagcaggaggattgcttgagcctaagagttcaagacaagcctgggcaatgtagtgagatgtcatcactacaaaaaatgtaaaaattaactgagcatggtggcacacgcctgtagtccaagctactcgggaggctgaggtgggaggatcgcttgagcccaggaactggaggttgcagtgagctgtgatcacaccactgcacatcagcctgggccacagagtgagaccctgtctcaaaaagaaaggaaaataaaattgatctaaaacattcagtaggacacaataaggtttaaggctattaaccatcaatatcaatataagcattatacctcttccctgacaccagcattttaaagaaattttattctatgttacaggaagaaaacaaagatagatttttgtgcagtttagtatactagtactaaatcataaagaataaaatgcttttttttttttttaagtggaaatttaatggagccaccatttcagaaccaaaagaaatttggaacaaacttcacaaagctggaaaagaaaactatccgaggaaagaaatatgattcagactctgatgatgattagagctcaataattctttgtaaattgtctttttttttctgcttcagatttaaatgtgtttttaaaattctattaatgtctatacattggtcacctaaatactcatattctcgagttttatacagttgtatcacatcgaaaagtgtctttactgttttctgtgtggccatcatgtttaagttgaggaaaactcagttcttaaattatctgggaagggtctggattctctatttttgagattgactttatcacaatatgattcttacatctttataccatttacaattgtgttttagatctacagagttagaaattcgaaaactattccaggactaattcttaatcggcattatttatacaagaggtcaagtaacatttactagcgcaatactgcacttgtaaatgaattataaacgctcttctggaatatatttaaataaccattaaagaactgcttattcattctggacactgcatgttgatgttgaatcaactgatgccagcagaaagctattttgatttgtgaacatactgccttatttaaagggtcctgattgcttgtattttaagacattcattaaaaagaaaccaggaaacacttttgaaataacagcataaggaacttcactgtctctgctcaataaaatacctgtaactggaagtttatgtggaaattgtcataaaagcatacatcca

SEQ ID NO: 95445 - DNA, 1226 bp, Homo sapiens
catgccaccacactccatcctgggcaactttagcaagacccattctcaaaaaaaaaataaataaataacacttttgggccgggcgcggtggctcacacctataatcccagcactttgggaagccgaggcaggcggatcacaaggtcaagagatcgagaccatcctggccaacatggtgaaaacccatctctgctaaaaatacaaaaagtagctggacatactggtgcccgcctgtagtcccagctactcgggaggctgaagcaggagaattgcttgaacccaggaggcggaggttgcagtgagccaagatcgcgccactgccctccagcctggtgacagagcaagactccgtctcaaaaaaaaaaaacaaaaacaaacaaaaaaaaaacttttttttttaattgacttcattacaaaatacgatggtgatttggacacttaaaatgtcaagtggttctgaaagagatatctcacatgtgtaatgttttgcctctctccaaattaggaatggctttctaaaggacatggggaatacagagaaatccctagtgaaagagacttttttcaagaagtcaaggagagtgaaaatgtggtttgccatttctacagagactccacattcaggtaactttgtttccatctgtgactttttctaaaaaaacacagtgaattgtttggctggagatatactggcttactagagaaatgaagaaaactaaaagaaaaaacttcctaagttgtttcattgtactctctcatatgttatttagtattaagttaagcaggcaggggcccagtgactcaagcctgcaatctcagcactttgggaggccaagtggggggtggatcacttgaggtcaggagttcaagaccagcctggccaacatggcgaaaccctgcctctactaaaactacaaaattagccgggtgtggtggcaggtacctgtagtctcagctactggggaggctgaggtgggagaattgcttgaacccaggagacagaggttgcagtgagcggagatcgcgacactgcacttcagctcgagcgatagagtgagactccatctcaaaaaagaaagaaaaaaaaagttaattgttattttaaagagtaacttaaagaacagttacatgcaaaagtataaatgaatattactgaaagtcaatattcccatataaatggcttatatttttgaattgtattttcactagctaactaaaaacatctt

SEQ ID NO: 95446 - DNA, 1066 bp, Homo sapiens
gctcaactgtactctgtgtttaagtaaagtttaatatatatatttatgtgtaaaacctcagtaggtataccttcctattgttcgcagttgtttctgatttctctttcccattggtaaagaacactgattgtcagtatatatcactaggtataacttcacaactcatttctctgtggtttggtgatggtcttaaagacttgtcttggctttagtatagtaaaacatatgctaaatcagaagcaccctaaatttgctgtaagtagtttttgagtggtgtgactagaacctactgagaattaaatttaaaaacacataaaaattgttaagcccagcatcaagtgcttggatgtcgttagaatactccatagagtacacattatacacttgccagaatttttgaaaatggtagagaaaaccttgcttattgtttgcattttttaaaatgtattttgtaaatcttctccccagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagtaacctctctgccctgctttctgaaattgctataacagtatgcgcctaacaacttatatatacatgtgctgtagtagttacatttcgttctttgtgtttagggtttttaaaattcagaatacctattactgttaaaaatttgcccagaaaaaaatatgttttaaagacattcaaaattagcccaatctctatattaatccacagtcgagtaaaagaaagatctgcccaagatcgtttttctgagcttggatttgtttggttgaatggagggctagggagtcattggtttccatttcaggtaatattaaagccgatttagctattttcaaagcaaacgagataagacagatgagataagagcaattaagtcaattta

SEQ ID NO: 95447 - DNA, 1076 bp, Homo sapiens
aattttgtagaaggtgataagatacacataccctttgcattgcattgtataatatagtagcagtatggtttcatatcccttttaaaggagtcacgacttcataaggacatcgtaagctgggagggttttcttttgagacatagctagttctcagcttattgattgtagtacttgagccataacttcattaagagagttgagagtgaaaactgttaagatttgtggttataagtggtgggggccactgaggagcaatgactgctgggctttcccttcttttgtcttgtttttcctctttttgtatgtaactgttgatgatcaaagatgttctgggtaagaagatgaagactggggaaatgagatgtcagaaggtaacctgtagagaaggtgggactgaatttcccggtttctcttattgcagctgttactgctgagatagagttaagaataaagagaaggattccctcttatgctcttcttgtttactattattaagagttttggcggagaggggcagaagccaaagtaagtgaaaaagggcagcaacagtgttatatgtgacttatccttcctttaatactttgaggttttggacaatttgtccatcaacttggggatggggacggaggaaggagtggtgtagtttggattttacacttctaccaacatgctgtccattactataggtcctggtattgattaggaataggaagaaatatgggggtgcttcggttattattgtaccataacaagtcatcccaaacagtggcttaaaacaagaaaacttgtgattatctttcatggttctggaggttgactgggcttaatcagctggagttgtcagctggagcatctctatttgatctctcctcctgacctggacatccccattagcttggcagtgagcattccaagagacaggaagctgccaggttaaggcctaggcctagaaactataacaaaagttgcatccttctatttagcaagcagtcatacaactcccacattaaaggagatagacctccacctctcaaagagtgtcagagatattttgtgccaggttttaaaacctctgc

SEQ ID NO: 95448 - DNA, 2487 bp, Homo sapiens
aatgcacagggatccaaatatttaggtgttgttattgatcgtcgagaaataagacttgttttatgttttaagatctcccattttataaataacttcattcagacgcacaaaaaacctttggtatctgtaaaagttaatttccttttcttgattaccctgatttttttctggagcttttcattatctgttccttatttgagtgtaatccagaaacttcactgaagcagatgtagggaggctgataagtagatgtaacttgtgttgtaatgaaagaacttgccaaatgatttttctcattgtgctgctaatgcatgaaaaaggttaaaatgataaaatctatataaatgaatgattattttgcttttaagtagcatttaggatgtttttgttttcatttaagcaccaaggatgacattgatcttgatgccttggctgcagaaatagaaggagctggtgctgccaaagaacaggagcctcaaaagtcaaaagggaaaaagaaaaaagagaaaaaaaagcaggactttgagtaagtatattttaaatatatttgatttttatttgttttggtactggattcacttaataaaaactataccagtgcttcacaatgtattttaatccttttctagtgaagatgatatcctgaaagaactggaagaattgtctttggaagctcaaggcatcaaagctgacagagaaactgttgcagtgaaggtgaaagacagacctttgttacctattcgtatttcgtattctattctttcttcttaatgttggtttggggagctacatttggaaacttttgagcagtgtacaatatgttatttaaaagcttctatgaaatctgatgtcaaagggaaaaataggaatgtaaaggtattttgtggtatgttgattgttcataaaattggtacatttggagttgtgatgtaatcactcgttccatcttcagttttctctgttgtttctttttcatccttcgaatttggataagcctcagagtaatgggaaaatcatagatattttttcttctttcaacttgtcccttaggctttgtaaagttagtaaatgggtggtgactagtgcctgtttcaagagcccctggattctgcaatttacaatgatgcgagatgtgtctgaggccaaggccaacctctcttgcttgtttgaattttatattcctgtgaaaaagactttgaaaaagattttgaaatcattttgagatttttaaaaaatgtttacttaatgaagcacatgactctggtctcaattataattctgttaattttttctaacaatggaaattttttagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaaggttggttaatactttagaggaaagagcaaaaggcttttgattcacagtataagttgtaatcattgtgccccaaggtcgttttgttatttgtccatgggtataaagacacttgattgtaaggagccatctaaaaaattacgtctaagtatttgacttgatttgcattgttaattctttacatatatagtataaatatctttcagattatttatgtacagactggaatttttatagaattgcattatgaaaactattttttttgctgttgataaaggctatagaagttacttaatgaaaaatttattcttcctttctgataactcagtgtcagataatatttgaattctttcctgtctttaaaaacctagttcaatttatgaaattcacaaagaaatgttttcatgaagttgctaatattttctgcttcacttaaaactcaacatgctaaaattagtgtcttttaagcaataatgagccatttttttaacaaccaattataaaa

SEQ ID NO: 95449 - DNA, 1050 bp, Homo sapiens
agagttcttggagtataactacctatatttttgtattttatcctactaataccccctaaagtggacatcattctcattaactccatcttgtagaagtgaaattagctacagaacttacgtgggtgttagttcattctgattgttagaacttcatataagcatctgttggacaccagccactcaggtaccatggatttagagatacattaggtacaggattgcccttttgctgctgacagtatccttctgtcttactgtattcctcaggacatctgagaccaacatcagtattgcagacttctcaggaggccatctgtgagttattctgagctattctagttaccaaagtgctcaggatgccttgatgcctgtagaacttagcctgctgctggcatcggccttggcccattatggtccttgaattgtggttgggttttgctcgtcatcaccacagggaattgttttttcatttcaatgctttgcctttattctttttggtagatgacaatgaaggagacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggtatgttttcatgaagttggtaacattgatattgtgtttaacttaaaatctattctctgtaaaatatctttactcttctaattctgaaaatttcatagttgcatggtaattcagttatattattgttccgatacaaataataagatgaagaggtacagcacatcttatctttattttctcaagaacagattgctcgatacataagttgcttatgtatcattgccaataatctgatgtgatattaattaataatcatgtataacatttaaaatactttgatttggaatctcctaacataatactttgcatgtgtctcaagagatttatttga

SEQ ID NO: 95450 - DNA, 1023 bp, Homo sapiens
gtagtttcctgtaaaacatatgactatatttaaacattttctaaacttgaagaaataggtttgcacaggctgggtacagtggctcacgcctgtaatcccagcacgctgggaggctgaggcgggcggatcacctgaggtcaggagtccaagaccagcctggccaacatgatgaaaccctgcctctactgaaaataagaaaattagcctgtcatagtggcaggtgcctgtaatcccagctacttggcaggctgaggcagggagaattgcttgaacccgggaggtggaggttgcagtgagctgagattgtaccactgcactccagcctgggtgacagagcgagactccatttcaaaaaaataaaaaataaataggtttacactactgttttttattcagtacttaatggagtatcttaacagaaattatacaccaaaaaaaatattatcttggtttctgcccctttttcagtgtctgaatcaatggaattatgtgctgctgtagaagttatggaacaaggagtaccagaaaaggaagagacaccacctcctgttgaaccaggcgggtagtgttatctgattatttaattagtgaattcttattaaatagtgttggtgtgtcataagttgtcttagttattataaataattggggagaaccaaataagtatctggctggatggccctctttcttcatagttctttcttttctatttcttttcatttctactttgaataagtatccaagtgagacttgaatcagttgtgttcttttcagcagtgttagaaaatgttttgtagaaaggatacactttgggagggtgaggcagatggatcacgagatcagaagatcaagaccatcctggctaacacggtgaaactccatctctactaaaaatacaaaaaattagccgggggtggtggcgggtgcctgtaatcccagctacttgggaggctgaggcaggagaattgcttgaacctgggaggcagaggttgcagggagatttcagtgagcctaggttgcacc

SEQ ID NO: 95451 - DNA, 1338 bp, Homo sapiens
tgtaggtcagctttagtaacaaccctattttgtaacatcatcactctgaaaaaatgcattctaaaccttaggcagctatcttacaaataacattctgaggaaccactcattcacaaaatgaagatccacttgaggacttagaaaccatggcaaaggagagaacaagagacttatccctatccccagaaatgttcatatggctttcataatcaaaagactattcatttaaatatatatcattcatttctaataaccactggatgtatcagtgtgtgcttatgaggtattcacctttttctgtctcctcatcactggccatagcttcccaatcatccaatccagcatcctcagtatcttcttcttcttctgtaagtaaaaatttgcatttaagacacaaaaattatttagaaatatgaaggtcttttagaaaaaagtaaaaaattatgctctgacataaaaaaagaatgttttaattatgtaaaaaatatgtatgcagctattatctttagaactatctttttttttttttttttgagacggagtctttgctctgtcgcccaggctggagtgcggtggcgtgatctcggctcactgcaagctccgccttccgggttcacgccattctcctgcctcagcctcccaagtagctgggactacagatgcccgccaccgtggccagctaattttttgtatttttagtagagacggggtttcaccgtgttagccaggattgtctcgatctgctgaccttgtgatccgcccgcctcggcctcccaaagtgctgggattacaggcttgagccaccgcgcccagccagaactatctttttaatatagctagcatgttataatttactattacttaaatgcttccatttcctactactgccaacatattaaacttaaccaattttacattcaagctaattgtttcattaatttaattaatttaaatgtttctttagatcttgaaaaagctacatgaatatactcagttcttgaaaacaaatgaaatttcatatatatcttctttttgatcatccaactcatactttatgcaaggaatttattattttgcttttaacctttacaggtatttaaatatacttaaattctgaagttgaaggtacaaaactaccaccatcactctgggtcaatgctgtgctcataaccccaaaacagccagaaagctaaaattctgaatattatttagacattaaagacctaatactcttcttaacaagaatgcttttctttactgaaatctaaccaggcacaactattcttaaatgaaagtaagatgacgggtaggacatgtggtacctgcttccctgaaata

SEQ ID NO: 95452 - DNA, 1034 bp, Homo sapiens
ctagcacaaatttgtaaactttcttaaaacgtgagacttttttttgtgatttttatttttaagctgatcagctattgttagtgttagtgtgttagtgtattttatgtgtggcccaagacaattcttcttgtaatgtggctcagggaagccaaaagattggacacccctgctttaaagtctcttatcttgatataaatctatcatattaatgtttatttatttaaaaatatatttgctttcgtagtagaaggaaacaaagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgaggtatttattttaccgtttctctctacttttcttcccactcctctgtgatgattaaaacagtactctacaactaaaggctttgaacagcactttatgtattctcaagaatagaacaccgttcagtttttgtaatgttgaaatattactggcctttgatactggtcttacccaaggaccccccgtccccgctcttacctaagatagaatggtgtgactacttcatttttttcttgttttctccaaattttaatgtactctttgagtgatagtttataagtatgcagaggtattctgagcatatgccctctgcttataaacatcagttatgtgtttgcctcacatatttaggttagtcaccatgaggcatctgatcactatagttatataaatctggtgggttgatgaggcttctatttagtaaagtccgatacctgatagactttctgtatttttcctacttaatgcagtagatttcagtatgcttcaagagaaagttttct

SEQ ID NO: 95453 - DNA, 1108 bp, Homo sapiens
ttgaaaggttttatagcatttgtatattggataaaagtgtgaaataaattgcctttaaaaatctttaaaattcttaggttccagtgaattttttaaaatgtacaagttcacctgtttttatataaatcctcacacaaattcagggttgcactatatagtcagtatgatgggaagattgattccttttctagtcattatattccattaaagtaactgtgtacaaaagtattcaaaaattttgaaatgacactttacaatattcctattcgtattcagcagtgctgctgtgaaatctaaacaggtttttccttatccagaggtgctgtgatgggaattcgattgtaaagttcacattataaattccaattatgtgtagtcaaatcaacaaagaacttggatgcaggttgtagcattcttttgccaaggcaaaacagaaaataaggatagtgaggatttgaaataatatttaatttttgatttttttttttttttatttctagaaacggcgacttgaacatagtaaaaatgtaaacaccgaaaagctaagagcccctattatctgcgtacttgggcatgtggacacagggaagacaaaaattctagataaggtaagaaagtattaaatgtattgatagaactttgaaaataagtgaatggtaccttataaaaaaaaactttagagaccaataggacatataagcaattctgcttacaataaataagttgctaatttcttattatttttgctgctatcttttccatgttcaaataccaatctgtatttgctgtcttctcatagctccgtcacacacatgtacaagatggtgaagcaggtggtatcacacaacaaattggggccaccaatgttcctcttgaagctattaatgaacagactaagatgattaaaaatgtaagtacattgtatttcatgtattttaatctctgacaaaaattaagatatgaactatttcaaacatagaaaaaggacagagactaggataacagctccatatactcaccattcagaattaacatgtactattttgcctattttgctttagatcattctttttaaagaataaaacactacatattataggagctctca

SEQ ID NO: 95454 - DNA, 1050 bp, Homo sapiens
cagaaagtcaagcatttatgacgttatttgaatacaacagggtatgcatttactctttaacacttttgatcaatgtggtaaatttactttaaaatgtacttttgggatatatttgaagtcagaattgctttaaaattggaccacataaattttcccaatgctgagaaccacctcttgcatgtcagatttctatagaatatttcagatgactgccctgcgattcgtatcaccacttacttaataatctgctcaaacttggactacagtcatagttgtaagaccttaagaaaggagatattttctcatttagtatttttttgttaaaatgcctttggattttaatgaaaatactgacaactgtactttgctggttaactcactgtttctaaagccatttatatggaaaagggagtagtgatactttcagagttttatggcaaaaggattgttctgtaaagaagctttcatgtctgactttcttaaactttgaacttttccccattgtttctagtttgatagagagaatgtacggattccaggaatgctaattattgatactcctgggcatgaatctttcaggtaagagcaatttgagtcttttctcatcaagcaatctacttgaaaccattaagtctaaaagttcagcagagtcattaacctttgagtagtaatttgatctctataactaccactccacctttgtacctcattgatttagtaatgttttctttgaatacttgttttttatagagggaagtctttactgctttaaaagagcacccccttaatgtggaatgcagaaaacatgctaatacatgccaggcctatctcctgtaaaacccgttacaagtggaatattatgctgttgtctcttgtccatattctttaacacagaaaacttggtcagtaaaattattagaaatattagttggttctaaaactagctcattccacttgaggtcaattcaagtgattggtagatgagcctttggcaagttaagggctaatagtacttgaacaatttaatacatatactctattttgtttggg

SEQ ID NO: 95455 - DNA, 1865 bp, Homo sapiens
aattttttggtatataattttatagtgatggtacttgctgggattgattgatttgttacaaaaactgtttcggaattccaacaatatacattaatagtcttaggataattctaggatgttatcttttgcaaacaaatggcagccacttaggaactcatggaggctgacaggggcagcatggcaccacagcagtttctaatttaagagcaggtgccgataagcagtctgaaaggagcttttggtacaataaagtgtatgagtaagtcacactgttctgtatatatgagacacacatgaggaattttctggagctattaatacagttcttgaatgttctgaattttttagagatctttctcatgaaaaaactttttcagattgataggttatatgattggaaaaagagtcctgactctgatgtggctgctactttaaagaagcagaaaaagaatacaaaagatgaatttgaggagcgagcaaaggctattattgtagaatttgcacagcaggtaagaaggccttccttctttctgaagagcctatctcagaatatgtattatattatctttataatgaagtcagcattttcattaatactggttcttttcctctgttgacagcaattactttttttaaattcttcttcccttttctcctttttctttgcagtctgaatactttaatttagaaaactgagttgacttagaactactttgctataatacagttaatgcttataggatatacatgatcatttttagtgtttatgaggagtttcaaaatgatgagccatttgctcatccggcttctagtgaggcacacctattccagatacgttttctttacagcctggcattttggatgatttttgctcctagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggtaatgatcaacttttcagtttattgttttttttttttttaaaaatagcaagttccttgagtggaggatatttactacttttagatttaatgaacatggtgcattgtatgtatgtctttctctttgcattaatgccttttaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaaggtatgctgaggtgggaagcattgacacgtggggacttgtacagtgtttagaagttctgctgagatggtttcctcactttgaaagctgtttgacttaatacagaacacatacatccctcgctctcccttttattttagttgtcatcatacaggaaggcctgtctgtcagagtagagatgtgtgaaagtacctgcttaccagactgggcctttgccagattctaaactacactgttatggttctacactgctaaatacggttgactcttgaacaacatgagggctaggggcactgactccctggccagttgaaaatccacatatattttttgactccccaaaaacttaactcctaatagcctaccattgaccagaagccttaccaatcacatacacagtcgactaacatgttttgtatgttttatatattacatactgcattcttacagtaaaacaagctagagaaaagaaaacgtgattaagaaaatcataaggaaaatag

SEQ ID NO: 95456 - DNA, 1086 bp, Homo sapiens
aattatattctcaactgcagtattttagtttcattgttttacagcttcatcagttcttggatgttaggttttaaattttttttgccattctgctaagtgtgtagctcattgccgtttcagtgtgcatttgcctaattgttaacctggttggtcatttaaaaatgtttattggccatttatttcctccttcgtgagatgtacatttttcttctgcattatctttcttacagatttatatgcgcttatatattcaggataccggtttgttagttggtgtgttttgcaatatcttctactcttgtgactttttttttcctgtggtattttgagaaatggaaatatttaattttaatgttaaatttatcagtcttgtgattattgctttttgtgcctcgtttaagaaacctctctctaatatcatgatgagattctcttatatcatcttctactgctaaccacttttaaagtacatttggtaacaaatgtttttatctctgtagaaccagtatgaaaagcataaagaagtagaagcagctcagggggtaaagattcttggaaaagacctggagaaaacattggctggtttacccctccttgtggcttataaagaagatgaaatccctgttcttaaagtaagttcatttaaaaatttttttccttaaaagctatttgagttctggcatgtgtcagcattgcacatgctagggatggtgaccaaaactggctttgtctttgtgaagcctgccatttcttggcctcttagcaaacttgatgcttttgaattacttcagtttgtacaatcatagaaattggtataatttttatatgtactagaattataaaaataatgcattttattcaaataaaaaaatgagtcaaaagctagaagtcggctgggcatggtgaatgcacacctgtagtcccagctacttgggaggctgaggcaggagaatcacttgaacctgggaggcagaggctgcagtgagccaagatcgtgccactgcactccaacctgggtgacagcaggaccctgtctaaaaaaaaaaaagctagaaattgtatattctttttggcccatgtccattg

SEQ ID NO: 95457 - DNA, 1102 bp, Homo sapiens
agtatgtcacagaggacagttttttaagataggacagttttaagatagctacgtaacatgaaagccttcatagcaagagaaattacttactgagggtcatgttccaacatcactgaagccttcataacatcttttttatgcactgggccaatgttaattcctgcatactgaaaaaatgggagtttccatgtttatctgtatgtatcaggtaatggcgatggcaccaaaaaccacgaccaaccaccattcacttgtggagcgagttgtagttacttacgggcacttctgatgttttcagaaattccagtagagcttccaaagaacccagtgtagatgcctggacatagactcctttttcttctaatttgatagcatttagtgtctgctttaactcatggatcaattcatccttgaaaagaaatcagatttgataaggttgtcaacacacctctatcctcagcagtctagaattaaattgtgtttctctctttggttaagtactcatctgcaaatatgaaactaaggcttagatagagcaaggcatcacagaacctgtgctggaatgaaggaggagatttcggggccataccctaactgtatttcgcttcacctttgtcttaggtttactaactttgaaatatgtttaatctccgctccacttggcaaatacagtagatgggtgggcagaattaaacagtagagaagaaaaatttttttaaagttaaaaaagtaccacataaacgtaatgtgttatgatagcccaaaagttcagcttgtctgtgttaactaggaaataccataatctcatgatctcagcagctccttcctccatcactgcttgtcgggaaatggaagaagagatttttaaccagaaataagtaaaacaagtttatcaatgccactgaagggacgtaagtccactccatactcaggactgggtgaagagacaggcctgccctattctctcactggccctaagatagcttattcccaacagcatgacttgatgctgcctaaataataaacacggccccaggacacaagagccatgtgctgggaacagttgtattttctctttggcaaatgaacaaactatggctca

SEQ ID NO: 95458 - DNA, 1110 bp, Homo sapiens
atctgatttcttttcaaggatgaattgatccatgagttaaagcagacactaaatgctatcaaattagaagaaaaaggagtctatgtccaggcatctacactgggttctttggaagctctactggaatttctgaaaacatcagaagtgcccgtaagtaactacaactcgctccacaagtgaatggtggttggtcgtggtttttggtgccatcgccattacctgatacatacagataaacatggaaactcccattttttcagtatgcaggaattaacattggcccagtgcataaaaaagatgttatgaaggcttcagtgatgttggaacatgaccctcagtaagtaatttctcttgctatgaaggctttcatgttacgtagctatcttaaaactgtcctatcttaaaaaactgtcctctgtgacatactctgtttttcactgaatggtctttgatgtgttttaaccttttaggtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagtaagttactgtttttatttactttgagtctttgttaatgaacatgattgagaattactgaattccagaaagggctgtaaacagcaaaatcatggcatttactcatctaccagaggctgcatcctgaaatggtgtgttacaaaccagaaacccaacatactggggacattccagcagtatgcaaacaagtcttgtctgtgacttcagtttaataatcttggcagacttgggtcttgttaatgggttcgtagttattaaatgtagggactttatgttgctcatctgggattatatagattggaagtaacaaaacttgagtgaggaaaaccgggaaataagagattctgtgggagagaagtccattcctctaccaaactttcactcaagcactcacagtacctacattgctgcagtggtagaggaggcatcagcagagaaccaggccagcctccctcctcctttccctttgagacag

SEQ ID NO: 95459 - DNA, 1104 bp, Homo sapiens
tggccttttggatcaatggtttgggaacgtggtggagaaaaggagggtgataatacggtctgatgcctatgtgatcccccagtagcctacatatgtgcctaacgaagacctgcctgtcaccaggtactgcctaggttctaagccccagactgtggctgacatcttcagcagccaagctcagtgttttagactaggaacagaatgctcctgtgatgcagcttcttttggaggtagggctttaaaagagaagaaagcaaagacttgggaagcaacagaatggggaggaggaggttaagaacaaggaagaagcgctctgggcatggggtggccctgggctgcagcaccctgcctgcccctctcctgtggccgctggggaaagctgctttcctctaatgggagaagcctgatgttcagctgcagtttttctttttatgtttaagtgattctgtaagcttaaaattcttttcttttttcctttcaggcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaatgtaagttctagttgtacattctgtgggtcatttcttaaagcactaaatgagtgtccaagagtcgtaccaacacagctttgtgcctgtagttcacagtactgtgctgtgtatttagtgtggtctccaccttcttaacaaatgtttcagtgtttttacctcagtaggaagaaaatgtggtaactttaaaacaagcagagcctgtcaccttctgttgtgcttcagtattggtaaatatcagtgctccatagtcagtgttgactcagtgctgatctcagtgcttcagttaattggggctccaaggcactttacattattgccttttattttattttgaaaggtttcaagcctgtggaaaagtttaaaaactagtataatgaacactcatgtttaccttccctttctgtcagcatacctaagaaaaattaataatatttcaacaatatcctataatttgcagccctcaacattatttcaccagttattc

SEQ ID NO: 95460 - DNA, 1781 bp, Homo sapiens
ttgccccaaactctgagatcacatcactcatctgctcacaggccatcattcttaaaatttcaggattggtcctcactctgacttcattcccatcagccacttcaagctcattcctgactcagaccctttgtgcctgctgatccctcctattacggcacctgtcacgtgaaatggtagagcaaaaataggaaatgacattgggtcaacagggcacttggaatgttttgcaaagcacattatctcctgtcattcttacaaccatcatgaagggaatagggtgttggtggtgccagcctagtttaccaaaatgttacaccgtgagtgatgaaaggatcgcactgccatgacttttaaaacaggcttttgctctagttcttacttcagctatccagccatggcgcctgtgattggcatgaattcttctgcatgcattttaatttgttcttattttatagtttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaaggtaagtatttcagcaaaagtggcacactttaagcaacagggaatcactcttcttgggtcacctgtacctgtagctccttgggcttcagtttgattgtagaatctgatgggactggatcccccattagggcttgacctctagctgggccttgtctgttgaggaagttgctctatcaggaaagcagcaccaacagagaaagctaggacttttaggtcccctcgtgcctgacatgcaaaccagatgtgattttggaattctactcccttaggcaggcaagccctgttttttatttctgcttaagctttttagtacagtgagagcgggcatctggggccacagctttctttggcacgtttgttatgttctgtttaccctgtttgtgcctcgggcattgcagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaaccaagcttctgcagattttgtgattcttgggacttttttgacgtaagaaatacttctttatttatgcatattcttcccacagtgatttttccagcattcttctgccatatgcctttagggcttttataaaatagaaaattaggcattctgatatttctttagctgctttgtgtgaaaccatggtgtaaaagcacagctggctgctttttactgcttgtgtagtcacgagtccattgtaatcatcacaattctaaaccaaactaccaataaagaaaacagacatccaccagtaagcaa

SEQ ID NO: 95461 - DNA, 1062 bp, Homo sapiens
agtaaaaagcagccagctgtgcttttacaccatggtttcacacaaagcagctaaagaaatatcagaatgcctaattttctattttataaaagccctaaaggcatatggcagaagaatgctggaaaaatcactgtgggaagaatatgcataaataaagaagtatttcttacgtcaaaaaagtcccaagaatcacaaaatctgcagaagcttggttaatcaaatactgcagtactgatttaatcagtataaaatcgaaagagctttagatctgtaataaaaatccaaatttggggaagggcaaactttaaaacagcagccaagtagagaagggttggggaagggagaggtgagtgaacaggcacattggaactgtggggacatgtaactgaccactgtcaaaccagtgtaagtttcttggtttctcatggaaaacattttatacacctatttttcttccttccatacttaagtccatcagtgtccaaatacgtctgttccattttttgtctgatttttgttgggatattacaacacagtattgcatttactccagttcctgctccatgtgaaaaaattagatgatttcaaatactttcttcagctccacaataagctgccagtcactcttctgcatttcatctctgaaccagtctttgagtgcatcaatggactgccggctgatctgcaatgcccgaggcacaaacagggtaaacagaacataacaaacgtgccaaagaaagctgtggccccagatgcccgctctcactgtactaaaaagcttaagcagaaataaaaaacagggcttgcctgcctaagggagtagaattccaaaatcacatctggtttgcatgtcaggcacgaggggacctaaaagtcctagctttctctgttggtgctgctttcctgatagagcaacttcctcaacagacaaggcccagctagaggtcaagccctaatgggggatccagtcccatcagattctacaatcaaactgaagcccaaggagctacaggtacaggtgacccaagaagagtgattccctgttgcttaaagtgtgccact

SEQ ID NO: 95462 - DNA, 1376 bp, Homo sapiens
ctaaactatcatcacactaccttgtatgccagcacctggtaacagtagagatttttatacattaatcttgatctgttttaatcttgatctgttttagtagagatttttatacattaatcttgatctgttttaatcttgatctgttttgtcctagaaaattccatcatacacacatttcctgatatttgggcttagtgcttctaaattgttgcagacacaaaacttaatgattcattcgtagtagtaatctgtagctagttttagggttttgctgaagtcagtgtggggtgtttgtttgaggaaaaagttccaaatatccactagcatagaattttaaactatttttattttaaagttatggcataacatataacataaaaatattttatatacgtttgaaaaatctataccgttcttttttatcatcaaagtttctcaatggccagtagaagcaaaaagacaacaccacctctgatctacgggacataatgttcccaggaaaaaaatcttcaagtgggtgtgagggtgtttctaattcaaaatatgtagatttctccgcatggaagaagtagtaaagattttcttaacatgctcctgtgttcatgcttggagacaagaataagatggtttagaagctttaccctttcttggaacaagtagaatcccggtctgagacctctcaggaatttcagagcttagcagtctggcctggaggtttttcagccttttagtataataaacagtagttgcttcctagagttgagtttttaaggattcacaaaaaggagcctgtacaaaatatacatacagttctttattaaacaactgtaaacacttcactgtaaaaatccataaaactttataaacaaacattttgtaaatagaatctatgctacagtaaaataattaacacaattatttacatgcaatactgacaaatttggcactttttgaaaagaaatgtacaaaacacttgctttaaaagaaatttaaaattataaaaactccgagcattactatcatgcactttgcaaatacctcacaagcacttatggcacagctatcagagagcatcaggctctctggtaatatttatgtaacttttaatgtgcttccataagtttgttgtaaaaccacctggacattgtcaagaataaagtcaaatgccatattccaaaccgattccaccgattgctgcatcagcctaaaggtggggagagaagaaatgtcattaggaattaggaaaggtccttaagactaattattcctttttatatataaaaattgactttggcaaaaaaaaaaaaaagtcctggccaggtgcggtgtggctcatgcctgtaatcccagcactttgggaggccgaggagggcgga

SEQ ID NO: 95463 - DNA, 1038 bp, Homo sapiens
ggtgaaccatgattgcaccactgcatggctccagcctgatcgacagcttgtctcaaaacaaaataaaaaaaaatttgagtgttctaggattttattttttttgagatggagtctcactctgtcgcccaggctggagtgcagtggcaggatcttggcttactgcagcctctgcctcctgggttccagtgactctcctgcctcagcctcccgggtagctgggattataggcatgtgccaccatgcccacctaatttttctattttttgtagagacggggttttaccatgttggccaggctggtctcaaactcctgacctcaggtgatccgccctcctcggcctcccaaagtgctgggattacaggcatgagccacaccgcacctggccaggacttttttttttttttgccaaagtcaatttttatatataaaaaggaataattagtcttaaggacctttcctaattcctaatgacatttcttctctccccacctttaggctgatgcagcaatcggtggaatcggtttggaatatggcatttgactttattcttgacaatgtccaggtggttttacaacaaacttatggaagcacattaaaagttacataaatattaccagagagcctgatgctctctgatagctgtgccataagtgcttgtgaggtatttgcaaagtgcatgatagtaatgctcggagtttttataattttaaatttcttttaaagcaagtgttttgtacatttcttttcaaaaagtgccaaatttgtcagtattgcatgtaaataattgtgttaattattttactgtagcatagattctatttacaaaatgtttgtttataaagttttatggatttttacagtgaagtgtttacagttgtttaataaagaactgtatgtatattttgtacaggctcctttttgtgaatccttaaaaactcaactctaggaagcaactactgtttattatactaaaaggctgaaaaacctccaggccagactgctaagctctgaaattcctgagaggtctcagaccggga

SEQ ID NO: 95464 - DNA, 1086 bp, Homo sapiens
aggcgtgagccactgtgcccagcccacttcctatggttttttaatcacatgtaagaccttgagggcaacatatttggaaccttatttgctacttagtcaacatggcaaaataaaggatatcactttctcattaaccctaatgagtacagtttcccagaaagtttaaaacaactcagtacaccctcagccattgtgacatgccattttttcccatttgataaaagtgatgaattactaccttttcatgtattttataactagatccagtttttccaaatctttttcttctattagatcagtacagtatttcacaacttggagaatgtcttcttccattggatctaggaagggggaaaaacttcaaatgaggaccagtctttttgaaggagaaagtcagagatctgcatggataaaggaaaactgcatttctacaactatgtcactaacagctatcaaaggaatgggctttgttacttttcaaagcaagtcccagaatttaaaagatttgggggtagctgctttaagcttatcagagttagagaaatgggttaaatctgcatagtttagtctgtttatgttctcaaatcatgagacgactacatctcagccttgggccatctaacacaggccaagccaacctgaaattgtagttatccattctctgagcaaggtcttcacatcattgaattcaacagctccagctagattgggtgctggaggtctcacacagccagctgggtcagactgcaaactagaaaggcctggcacacctgaagtagaagcagagagttcttcctgttaagaaaacaaaggataaaattgctatattcacacattatccaggtatattaagatctcataaaggtcaaagttaaggaattaccaggggtttctctgcaggaggtccttcatgttttagaaacccatcaattaacttctggggactgccacaggcccctggcagagtttttgcaggactgttaagcagcttgttattcaaaggactctgaatcctttttggtgaaccaatggtttttttcttcttgtttcttttcttttctttcactgctgcctttagatgaagta

SEQ ID NO: 95465 - DNA, 1037 bp, Homo sapiens
aacagcttagactttgcccattatatactgcaataattagacaacagtgactccattactctttgtcttcatttttgttacatgccacttccaaggctcaccagatgcgctggctgactgctggtgagtgctgttctcgccctgcctttgtctttgatcatacgctgctttcagctccctctgaagttcagcaggaagggcagcaaatacctcagggtccacctagtggaaaagacgaggtcaaagtcaaacctgagctaattgtagatggtagctggtttctctttttcacaaaacagactttgttttcaaatctcacttttctgatctgtacgaattcttaacagttccccaatatcaaagctgattaaatcttcaaaatggttagagcaagaataaggaattaagagcaagaataaggaattaagagtactaacttaaagaaacccactacaacagcagaacctgggcaaaatgcactagtagaaaatgggaagcaaaacattgaaacagggactcaggttgttactgtcccccatgcaggattatacatctccgctctgttgtattcaagtgtggccattgatgtgtttgccccagatcagtgtgtttctgtcttagcatgccctcccccgtctcttccctgctgcttcagcgggaggctgctctgtgtctacatcctgcagatgcaggagatggagacaagcccactctcccctcccctcccctcccctccccagtggatgtggtgtcagatacagaggagaaagggaagtgagacaggtcctaagttggagcaggggggtgagaatattgaaactacagcagagggttcccatatttaacttacctgtgaaaatgctggaagggctattaaatttattcctgcgtcactgttcgattcttgaggttctggtatttgcaacaagactgtcccaactggttgtggcaaaattcctgtattacagccatttactggttctttctttttgtcgccatgtgactctgcttgctggacagcacagacttgctctact

SEQ ID NO: 95466 - DNA, 1366 bp, Homo sapiens
gctgttcatcactcccgccaatattttttgagaagtatttcatttaaaaaagataaaaatagtgaagtttccaagtagactgtcctctcttaatttttttttatcctaatttaaaaccttagttgacgagaacatcagtggaatacagtattccacttgtttggattttctgattttaaagatcttttggtatattttgggagaattggatactctgaagtttgagatgaatgaccactcactagctactttagaaattgtttttgtaataagtcatatagaatgctgtttgaatactttcatttacctttattctagaaacaggatccaggagatagtgaaaaggatttgctgaggattttgcttagctgaattcatattttcactttagttttcctagaagcatactctttattctgggttctaggttgggattcacgtgaatcagttggttccaactaatctgaacccttccacatgtcccagtcgcccatcagttcagtcaagccactttcctagtgggtcatactctgtccgtgatgtcttccaagttcagaaagctaagaaatccaccgaagaggagcacaaagaaggttggtggtcatcaatgtggttcttttttaggtgctgcttatgtccttggaaagacggcagttggttttaaaattgacacagctttatgtgattttaaaaatttatattcttcattatgatgaatcagtaataaagtttttttatttgtaatggacagaggattaaaggccctgcccgatgatctgaagaggctattttatatattttctttttgtagtatttcgggctgctgtggatctggaaatatcatctgcttctagaacttgcactttcttgccaccttttcctgcacatctgccgaccagtcctgatactaacaaggctgagtcttcagggaaatggaatggtctacatactcctgtcagtgtgcagtcgagacttaacctgagtatagaggtcccgtcaccttcccaggtacatttttgtagtcctaaatataagtacattttatactcctaaatataaatacaaaaatacaagtttacaaatgaaaatggcatttttatttcttcatccgtttaaccaagaaagggagaacgggccacttgtttgggtagatcatgatgttggattctaaataagcaatatttgggttgagtgaaagtgcttttgcaaagatttgccactcttgcaagttgtaaagcatagctgaaaggcagtcctcctgtggactgccattgtctgtgacagtggtcatcatgcagacttactgtattcagcaaggcagctttggtgattagtggtgaagtagaggccttatgtcgaagggttt

SEQ ID NO: 95467 - DNA, 1066 bp, Homo sapiens
tcaagaacattgtgtttaccattcacttgtgctttagctggaaaatatgtatttatttgtgcatatgttagctaaaatctacctttttctaaatttctcaacttatttttagttgacctaagtgtccattacggtttttaccttaaagttctagtgttccataatttttctttcccccttggttgccagtgtaactaatttggtatttctggcttccttgaagggagactatggcattcacttttataatcttctttgtaactgtttacaacttttctataactcttttaaacagttccatactactttagtactagtgaatacatatggaatgaagcttttgttttttaattctatcacttacaggactgtaactcttgaccaggcaacagataatgcaaaaataattggaaaggcgatgctaaacatgtttcatacaatgaaactaaatatatcagatatgagaggggtaagtatatagtaacattgtaaattctgactttgtgtaatgtatctctcatttttgaggcttgctctcaaaagggttattgctggtgtatagggactttatatgtaggtctttagctgctttgtaatacaaggaaaagagaaacaaaaattcttgacttcctccattttgacctccttcattttagaataattttcttagattcttactgtacttttccaaggtacccctgattaaccaggggctaatatacatgtcttccctgttcttgtttcctagaagtagatatgactgtgaggaatatgaatacataaattttgtacctttaagttcctttttaatcagaaacatactctgcatctgctgtatgatgacctagaagggagtgaaaccacaggcacatcaagatgcctttgaaacaggcaagaggcatcaaaatgtcaaaaccatagatttttgtgtggggttttttttttttgagacagtttttgccctgttgcccaggctggagtgcaatggcgttgtatcggctcactgcaacttccgcctcctgggttcaagcaattctccttcttcagcctcccgagtagctggggg

SEQ ID NO: 95468 - DNA, 1106 bp, Homo sapiens
gtatttgtatttaatagttgagggtataccaaacagtttttgttgttgtagttttacttttttgagacggagtctccctctgtcgcccaggctggaatgcagtggcatgatctcagctcactgcaacctccgtctcctgggttcaagcgattctcctacctcagcctcctgagtagctgcgattacaggcacccgccaccacgccaggctaatttttgcatttttagtagagatgaggtttcaccacgttggccaggctggtctcgaactcctgacctcagacgaatccaccagcctcggcctctcaaagtgctgggattacaggtgtgagccaccgcgcctggccacgtttctttttaatagatgctgagcgtgatagtgagtaaccaacatgtttaatattcaaagttaaaatacttgagaacaattattaggtatataggaaagtggaatggtagtttctccacgtttgtctttccatagccaaaagaggcagaagcttttcttctgagtctttcagaagaaattcaaagaagactagaagccactggcatgaagggtaaacgtctaactctcaaaatcatggtacgaaagcctggggctcctgtagaaactgcaaaatttggaggccatggaatttgtgataacattgccaggtaagctcacctcagaaatgatattggtaattatatttcagtacaggttgttgtaagtaatagaaaatgaagaaaaccaaggaggagtttgaataaagacctgtaaacccgttaatctggtattctgtagaagcaggcatcagcccaaggcattcagcttaggttaatgcacttggtttcagcgaggcccacacacaggaggttggtttgacggcattgctgaccttggcagcctttgcttggcatctttgggctgttaactttactgcatggacagaaagaaagggcaaggctgcagaccaaagggactgctatagtttcgggacttggtgaaacttttttcctgaggaaaatttcaatgtagttcttaaaaacaatgatacaggccaggtgtggtggctcatacctgtaatcccagcactttgggaggctgaggcagctggatcactt

SEQ ID NO: 95469 - DNA, 1042 bp, Homo sapiens
taaaactacaacaacaaaaactgtttggtataccctcaactattaaatacaaatacccaccttcccaacaaagtgaaagtaatgagtacttttaaaagatatttttcctttctttccttttttttttttttgagacagtctcattcttgtcccccaggctgaagtgcaatagcatgatctcggctcactgcaacctccgcctcccaggttcaagtgattctccttcctcagcctcccgagtagctaggattgcaggcgcctgccacaatgtctggctaatttttttgtatttttagtagagacggggtttcaccatgttggccaggctggtctccaactcctgacctcaggtgatcggcctgcctcagcctcccaaagtgctgggattacaggtgtgagccaccgcatagggcccctttctttcttttctatgccatcactgacttgtcgaaaattcttttgtaactatgttaataagttctgctaataaaatgtgtgttccaacactgtgcttacagcccaaacatcatctatctccatgcctaaggaaacaaaactcctgaggtccacagtgtaggcacagagggtaattaactcatcacatttcaaatccttatgatatggtgttgtttgtacatacaaattcaagacatatccagccgggcgcagtggctcacatctgtaatcccagcactttaggaggctgaggcgggcagatcacaaggtcaggagtttgagaccagcctggccaacacggtgaaaccacgtctctactaaaagtacaaaaaattagccgggcgtggtggcgggtgcctgtaatcccagctacttgggaggctgaggcaggagaatctcttgaatctgggaaacggaggttgcagtgagccgagactgcgccactgcactccaccctgggcaacaaagtgagactccaccctgggcaacaaagtgagactccatctcaaaaaaaaaaaaaaaaaaaaaaaaacatatccaaatccataatctgaaggaaaatggaaactactcagccatctgtgct

SEQ ID NO: 95470 - DNA, 1351 bp, Homo sapiens
aaaaatgtggctgataccactgtgagatttggtgatgaccgaaatcataatagatcccttacatttcgtgagttggttagtatgtctgtaagtcacactatagacttgtttaaatgacagttgattccttagttgattttgtgactaagatacatatcttggtattattcactaataaagaaagtgacatttttgataacttgagttatacatattttaaaagtttctggttcatctatatgtggagtccaaattgagaagtagagtctagaaatacatctactagcatgattttgcaccaaaaaattcttcagcctgtggatgcttcagttatgttgcctaaagactttaaagattattttaaactagttgttttgtgcataaatggtgggtattttgtgttaataaacttgttattagtagcttattctgcatacttaactatattccctttcctaggagttggacattcaatggaatctaagttggcatctttgggaattaaaacttgtggagacttgcagtatatgaccatggcaaaactccaaaaagaatttggtcccaaaacaggtcagatgctttataggttctgccgtggcttggatgatagaccagttcgaactgaaaaggaaagaaaatctgtttcagctgagatcaactatggaataaggtttactcaggtactgatcattgaacagattttgccatctgttgctctttatatttttacatagtcctacctctacaactaaaccattagaccctcaatgcttgaaattaagtcttaaaactgttgtatccccagagccttaagaaggccttttaaggcactgtgtggtaaggtgtagccccagataagactgagactgaggaaacttagctcttggggaaatatactaaaagattatgctttggaggccagttattagagaacttgagattataattattctaattaacagtgaaaaaataaaaaagatgagaaaaatatttttaatgttgaaatattttttaagctgtagttaaaattaagtttcagcaaacccctccttatgcaagcttttggaaagctgcagcacagatggctgagtagtttccattttccttcagattatggatttggatatgtttttttttttttttttttttttttgagatggagtctcactttgttgcccagggtggagtctcactttgttgcccagggtggagtgcagtggcgcagtctcggctcactgcaacctccgtttcccagattcaagagattctcctgcctcagcctcccaagtagctgggattacaggcacccgccaccacgcccggctaattttttgtacttttagtagagacg

SEQ ID NO: 95471 - DNA, 1037 bp, Homo sapiens
tttgtcaggaccttaatgttacatttttgttttgcttctattcagttttactttaggtatttctcaagtagcaagattctaagaaacaatgttaaaagggaggatgatgaaattgactttcagtcctttaaataaatgattattgaaatagtttactcctgggctaaagataaaagttttgagcttcgattctcctatgtcatgctgcaggactagcgacagttttctgagtttattaaacaagtacttttaaaagtataaatagaatgtgtgtgagctgtattaggaaaaaggaaacgtaaagaaggattgtgttttcaattaactccactcatggaaaaaaaccttccatcttaacctttctcacctaaggggcaggatgttcagttatttcatatttttgtgtagttacctatttattataaagtgcctctgtcagctttgtaaagtcttccatcttcatttatagtgaaagttttaaaattcatttgttaaaagtagatttagtggcatttttagatgcctatttttaagcctaataaaagtatgtccgaactaacttagaagtttctgttaacaggccataaatattaaacgacagaaatggcattttatggtaggttagttttaaagcttcctgacccccgtagtatataacttaaaacgatgtattagtgtcagaaatgtgtaatatgacatttttgatggttagtttcacatttaatttgagaatactttataaaatcaaactagcaaattactgtagtagacaacacagtttaaacatttttaataagaaatcttactgaagttttatataagaaggaactggtatatttaaagttgcatgtaaaatttgagttttaagtttattacactagccatctgtattagttttctaggggtgccataacaaagtaccacagactggggtgcataaacaacagaaatgcgttgtctcacagttctggaggctggaagttcaagatcaaggtgtcagcagggttggctctttctgaagcctctgcttggcttgt

SEQ ID NO: 95472 - DNA, 1002 bp, Homo sapiens
aaacaaatcctttttgtggatagatcctatgagatgattttttaaaaagtatgtccacatgcagagagtgtagataactattctcagacaagcagttgggatgactggccactttttccttctgtattctaggcctgctacagtgagtggaatttaactgtgatattttggttttaggagagtagcaattactgatttgtctaatttttctgttccttaaaggattctcataaaccattagattaaatgttttgacagttcaaattcacccaccggttttcaactcttcaaaggtttatagaagtattgtcagtatagagaaactgaaataataatttatgctgtgtttttgtttttttgtgtttaaattttttttgttggttattttactcctcaaacattttcctatccaatatgctgtattttggtagttaataaggagaaagagaacacactaattaactttgcagttaaaagttgggtgactaaaatggtacttcagccaattcatttaaaatgctttgtgaggaaatagaaaaaagagaggataagaagactattttgcaacattgggtctaccagatggtggctgtggctgtgattcgttgcctttgctctgtgttgatagctacactcataacattgaagctgtcagttgtgatgaagcgctggtagacattaccgaaatccttgcagagaccaaacttactcctgatgaatttgcaaatgctgttcgtatggaaatcaaagaccagacgaaatgtgctgcctctgttggaattggttagtatctagcttatcttgtactcaaaagagttgctttgagattcttgaatatcagttaattttatggagtttttctttttattagcttcctctcacttgtaaaaccgtttttagcattgcttacaattgtgtgacacacgagataagtgctggaaatataagtaaatggttgataatcttcgcaataaataagttagaatatttcttacttattct

SEQ ID NO: 95473 - DNA, 1775 bp, Homo sapiens
ctataaacatatttgggtttctttttttgagatggagtttcgctcttgttgcccaggctggagtgtaatggcgcgatctcggctcactgcaacctccaccctccaggttcaagcgattatcctgcctcagcctcccaagtagctgggattacaggcatgcgccaccacttctcgctaatttttaatttttagtagagacagggtttctccatgctggtcagggtggtctcgaactccccctctcaggtgatctgcctgcctcggcctcccaaagtgctgggattacaggcatgagccactgtgcccggccttataaacacatttttaaaaaatgtgttatctttaatttgtaaactcagcttttacatgctgaatctatatatctggcataattattacctgaaatttacccttttcaacaccagaccttttttctgctttctgataaagtttctaaactattttatgtttctacatatatgtctaaactgttaggtatctactttcttcattagtggacaaagcctgttgaccataggtcatccttttctaggcaagtgcaaggttgtccccatggaggtcatggagtttgctttatttgccatcctatacccagcacctcgctaagtcctcgacacatcaagaattgttttctttacaactctgtcattttccttcctcttaggtatttcttatctactagggacttagcactgagaccatttataatattactatttttataaacataaaaatgcatgtgattttgcatctactgctgagtaacttggaggactctttcttcttggctctcatggtctggatgttgggagggtgccagaggcctatgagtaattggcaactgtttgtatatacgtttcttaaaacaaggcacgtctccatgctgtgtagtaaatatttattgaacatatatatagaataaccattatcctattatataatatgtaatttggtgaaacattgctttattattttgcttgtttttactataattttttttcttgattctttacagagtgataaaatagaattttactaattatgtataattccataattatagttttgtggtgaatgctccaaatgtcaaaggtaatgtggggcactgagacacacagatttaaaatttaccattttcaattaggtccctcaaagttctggaaccctggctcctgcccagagtgatgtcctaccatgtacaatgctgttggcatctcaaccactgtggagccacttcaggagcatggaattggtcaattgggaattgggtggtaataggatgagtacattttgtctgtttgtcacatagcactgttttgtgtagttcttttgtttatattctttgtctttgggggatgaaccctggccaaactgtgccttgtattaggggaagaaaacctctttttgacagcatattcctgctctgtggtggttgtgatatcaccagcatatggcatgctggcatctctgcaaaggggccagaggtatgagttttaggagaaagcttcagatacaagagccaaacctggtattttaatgacatagttggcacatctacatgtgtcatttacactattcagacagttgtgacttttgggggaaaacaaggctgtaaattttaatgcctatctttaatccctaatgagaatggagttaagtggaaattataaattagtggcatggggagatatcaacatatttgataaatatttgagttgaaaacttcctagaataacctccattgtgttttgttc

SEQ ID NO: 95474 - DNA, 1034 bp, Homo sapiens
tttaacttgaagaaaaaaaaaatgcagccgtaagatttttgtcccttaattgtgattttctgttttctagaaggctattcctagtgaaagtttctagaaaatagtttctggatacttgttttgtggccatccaacaggttatattttccttatctgaggaaaatttttttaacaatttgcataagagaaatgttactgagtttggagtggggactagattgtggggatgatctgctcagtttgatgcactggtgagttttcactatacatagcttaataatggggccagcaaaggatagaatgtgaatatgaaatggtagaaatacaaagtagaatgtgtatatgtgggtcacagtttgcactgctgttagtagttggcctatacttacagtagagagcaaactttatatggaatcagtgagaaggtagattgtacatgaataggtaacgatacacagatatcctagaatcacagatctttaaagtcatataatttctaaaccccattttcttgtgcttttgtaaggacccactacctttcttactttatggatgtattttagtatgtagaatggacagtgacagtggtttgatggcaatttttttcccccagagatgaagtcttgctcttttgcccaggctggagtgcagtggtgctatctcggctcactgcaacccctgcctcccaggttgaagccgttctcctgcctcagcctcccgagtagctgggattactgctcccgccaccacgcctggctaatttttgtatttttagtagagatggggtttcaccatgttggccaggctggtcttgaactcctgacctcgtgacccgctcgccttggcctcccaaaagtgctgggattacaggagtgagccaccgcacccggccagcaattttttaatattgttgaatccaacaccaaatacaactgtctgaacaaagcatattgccagacagaatatgtcctctgtgctttaaatgtaggaataagctgtttttgcagcatacacttaacgaagttttggtaatt

SEQ ID NO: 95475 - DNA, 1322 bp, Homo sapiens
gggagtaataattaaaaagagaagtcttcatttttttttccttgtcaaccaaacacagacatttttacctatatcacacagcaagcccttacacattgctggcaagtgttaaagtattcaataatttcaaatcgaaacagagtcttagatcagttacatctttttttttttttttttttttgagacggagtctcgctctgtcacccaggctggagtgcagtggcaccatcttggctcactgcaagctccacctcccaggttcatgccattctcctgcctcagcctcccgagtagctgggactacaggtgctcgccaccacacccggctaatttttttgtatttttttagtagaggcaggatttcaccgtgttagccaggatggctaactgacctcgtgatccatccgcctcagcctcccaaagtgctgggattacaggcgtgagccactgtgcctggcctagttacatctttttagtcttgattcagagttgtggctattcaggcatctaatctgaagaaaaaatatttgagctcagcatcgtctaatcataatagttttttttaaatttgctaattattttatttaaagtatatttaagttaaaaagcattaagttcaaacgtgcatgcttatattttaaactgttttccattcatgacatgccaaacttttcctccccagctaactttgcctttctcattaacagaattatgttttaatggttttcattgtcacttgatgctgtggccaaggaattgaaacttactttaaatgataattaagtcaaatacaaatacgttttgaattgttatactgctttttattaccacaggcactctagagctgagtttatgttgtgctcagtaggctagtctctttttctctactaagttaatgaatggtggcctggacttcagatggctagacagttatgtgcagtatctggagggtgtgatgaagcccagaaatattcccagtccttgaatttcgctagttggtaaaatgcgagctccgtttacccttgctaaggctgcctctgcagggtctctccctttataccttcatacccagtcccccaccaagatgaatgctggctggggagcagggctgcctccaggtgaaagtgtcaccagctctggtggctttggactccaggagccacaattgtgtgtaggcactaggcttctgttgggtgtttggatggtgcatttatatttacccacggtaaatataaatttacctttataaatttggtcaagcttcatgccttgcaaaataattggggtgactatatgaggacagaatactatatagtgagcca

SEQ ID NO: 95476 - DNA, 1469 bp, Homo sapiens
aggacaaatagcatccttagtcctttttgaaactttagtttcttagttgtcgtatccaaaaactctttaattagccccgtgcaaccagggtatctcatccatccatgacttcttttggaggctgcttcctgagcagtactcagtagtcacacttctcattgatgatctcattgtttggaacaatttatgctccaaatttcatggttggggccttttaccccttcctggatttccaggatacagatgttttctatcccatcgacaacttcagttttcattctaaagaacaacagttttaaaaatcgtattagtcatagatttattctcagcgatttctttttcacagacttgggtcctggcctctgatttctccaaccgttcctccacattctccatgtgcccgtctagtttgtcaagttttgatgagcagttctctactttgccctccagtgaggacagtgtgtccctgcatttccctgaatctcacatgaagcaactcactccgctcgtggagggacccacgcactctgctgcactgtggaacaggtcagccagcccaatggagaggaacacgatggtgctgcctctcaggccagggcactgggggcgcatggaccacagagactgttctctcctcaagcataagttttctgttattttcaagacaatatcttagataactagcccttcagataccaaagtcaggtaattctccaacttgtaaggcataactcatggttacaccttggaaagacagttggttgtggctgttcaagcttcagcactcctttttttggggtctagtagcaccctctgttgaagtgtgatactgacagtcctgaaattcttacagtttttcagcttagatgaatggactattaaaatttatatttacccttttaaaaccctccagaaacactgggtaatctgcttgggattctgtctttaatttgtaatagtatagctagcatacgttattcatatgtcagaaactagctcacattacacactctgctgttttgaagcaagtaggatttgacccgagatgttagtcagtttgatttgcatttatgctgtgtatatatggttgccgaaatccagaaatgcttgtatgggttgcatagttagatgaaagatgctgatgattattggtcaaaccaggaagagttgtttaagcccatgaagccagagactttgccagttttcctggtggtgcattaacgtggctgacttcacagaacagtgagtctgaaataaacaaaagagaaatgctgggtttcttagttatgtgttgttacagtgcactcaaaatagatttgtctggaatagctgaagtgatatattttgggtttgttttactcatggtacttttgtttataatagtagagatgtggctgaggttgtggttttagaatgtgatttttttttttacagcatactcttcctggaacctaatagtagtatcccaa

SEQ ID NO: 95477 - DNA, 1125 bp, Homo sapiens
taaacaccagtaatcattctccatatgctttagtgaacctgttatgagaaataaccttgttgcctctcttgactttttaattttggatattaataagcaaaatcataagttgtactagtcataatacttattaagattttcatgtgtctattgcttttttcccctgagtaaattcactgagaaatgttttcttagaaattaaattttttttggtaactgattagttttctcatggttgttttgcaaagccaaagagaatttttaaaattagtttctcagaaatatattacccagaaagtagtcagaagttagatatacagtgaaatggaaagcatgcagtttagttttattgcagttatttcagtgcccttgtcagttataaaacgttgggcttgtcacaatgactccaatgaaattaaggcaaaaggaaagccagcgaacatctctgaggaccttttttgggattatagtctttttgttggttttgatcatctgtttatgtggtcttaagtatgaaataacataattgcagatacatatttatgctttgtgtgtacatttatttccaagttttataaaggttttcttggtctttaaatcttttcagagatttttgagattctagaattttgtgtgtcatgagtagatgtggagtagctgttactgaacttgttgagatttacttgtattatggtataggtagtttcttaggtattggtagtatggtttttgtggtaggttggtttttctttttgtattttctgtgtgctattaaacagatgaaatcttaagttctagaaaataagaaatagcttaaggaagtacacaatacttgtcatatattaggcatttatgaaatactaaagaatgctgaaagaagaaaaaccaccatgtatatacttgcagtagcatcttcagtgctcagagtctctctggtaggtagtcttgttacacacgtccttttatcggcagcctacatttaaaattttaaccttgacaagctcacattccttaggagtagcagagagctagtcctcttttgtcttttcttctgttacaatcttactataaatggcttattaacacagtactgtcattggttacttgtcttcatcagtttagtca

SEQ ID NO: 95478 - DNA, 2072 bp, Homo sapiens
caaaaaaaaaaaaaaaacaaaaaaaaagttgggggagaattaggtacatgctatcacagtcacagtttggtaaatggagtggtccaaaactgttaggggatatctgtttttggaagcctattataaagactgaccctcagtactaatatttttaagcctgagaaaaactcctttatgagatcagaactttttacaagcccagggttctttttccaggatttgtgtatcttagaggaccagacgaacaggctaaggatgagactgataatagaggaaagctctgcttgtgcctggattagggttaaaatgaccctgatgaatctctttgtagctcaggatgattagaagcttttgtccttaggtgaggacactcacctttatctccttaaatgtggtatatgtcattcagctctgatctttaatagtatttaatggcataaggataaaaatgtacagatttacattttatagactgtttttaagtacttagaacagcaacatggtagtttaaaggctctgaaatcagactgcttgagacagaatcacagctcaaccatttaataataggctatgtgacttaaacttttagtctacaagatggagatgatacgattacctacctcatagttgtgagaatttaaataaatacatacacataaacctcttaacagcagtgcctgacacctaccaagcactggataatagtagtcacttttattgttgttattttatccaggcgcgtttgtagattgcatggaatagtgatcatcaaaaaaagttttacttagcttcatgtaactaaatgtatgccaacacctttgtatttttataaaataatcagcacagtgaaataattttaagatgcactttttgactaattagagacttaattaaatttggcttctcttgaggtgatagaaataatctgtactcaattctggttttttaaaaagactccattctgggtgtaagcatgttttaaatataatttctaaaattaactagacctgatgttttaaatagtaaaaattagcttggggtttgaatgctgtctttttccttctaggagatatgtcagtattgaattctcccagacatcagagctgtataatgcatgttgatatggattgcttctttgtatcagtgggtatacgaaatagaccagatctcaaaggtctgtattcttgcttatgttttaagaaaactgatatattgttataaatatatattcaaagagattacaaaatctttttttaaaaaattatgattttccttgggaaaatcggttcttccaaattttctatattcgattatcagggaaggtatagggaaattagagtttttctttctccctatagggatcttcagggaagaatattcatcttcagctgaaggatatgtcatcgaagactaatgtaggcaggatctgtattgggcattttctaaatttttatctgtatttattccttgttaatgaatggaaattttatggtggctcttgtctttgagacttgggtcactatgctttctcttgagcaaataacttgattaactgtcctgatgcccatgaacatcccaactttttgattgtaggatagttttgcattattgaatattgctaaaatgtgttaagtcgtctggacagtctttgtcttagtgaaattgcagatatttgtgaactagtcagtattttaaaaagcatacattctgggtttttcagtgtttacctctgtctgaaagagataacttagtgttttcttctgagaatcaattcttcccttaaataaggaatcactatggcacagaagctgctgtgttaaaaccaggactttatttttgtcatgggtagtagttcctcagctctgaaaggagtttttagaatgttaaataattgattttcatagagtagctttttaatgcattgttgattttatttcttggtcctcagaataatgcattaagtaaatatatatttatccctgctattgctttacaaatttatagtaatcttgtaacttaacatgcatacaaaaggaaatgatacaggaaagtaagtttatactaaagcaaaa

SEQ ID NO: 95479 - DNA, 3276 bp, Homo sapiens
tgtatgttaacaatgtattttcctgccaatatatggctttctgttgcatgtgttgctataatgcatgtaaagggtctgaatgtttttgacacaaaactagatgtaagactttctgacgtacatcacttttgttgttttctggggtttttttggggggtatattcagtacattttgtacatttctttgaaatgctcatctgtgacttcttgctcccttgcattctgtttatctcaagaggctgaactttctctgcatgtgacaaattaggttttctttttttcttcttttaatcatatctactttgtctttttccccatcactggcatgatcatctgtgagcatggcatctactcacagttgcctgtcacattccatatgatgtttagccagagcctgagctaacccagaaatgggtgatcatccagcttgtgggacttttctgtgtagtcaggctctcattactaataaaccaagttggtattagggtgaggggctttaggtggaacctgataatactgtggtaatttcacctgtggcttactactctgtagggcagcccttcatctggagcctgcgctgtaattgaattaatgctatggacatttggacattcctaagtagaatgaattactgctttgtaattcaggtttttgtttttgttacttagatgattctcgtgaatgcatttctaaacaaacgtctagaggagccaggatgtgactttagcataacatttgtcatgggttctgcatttataaagctgtcatcaggaaacttggtccagattgccttgtaccaccctggcatctaaatatgcatttcttagaaatgaagtgcaatttcccttctcagtaaggcaagcgtccttatttttctaggtgtaaattttactgaattacccccacacattgacatggctttactttttgtctatttgtgcaacagttagctcattaataggttaatcaatatagtcagtttttttcctactgaaaccatctggtttcgtattagatttaatgtgttgaatagtacctttcataaaaactaaaactaggaataagaattcaagtaaggtttttaaatccatttttatgaaagttatttgtagtatattaattcagcagatatttattgaccatgtagtaaatgccaagcactgtgcttcagaactgggtatttacagcttatagattccaattaattttttatgggaaaaataactgaaaagttttttgggtttttcttcagccatgagaaatgttctattttatttcttctttgggactatctgaagtgaaaataaaaaacaaacaaaaaacacctaaagggctgttaatattctagaatttttctagttatcttgctacttttgcaaagaatgatcttttgtcaaatcagaatataaagtttgtggtttaagtttcagggtttttttttttcattgtcaatattcaatataagaattttctgtttttaaagggggaaataccaaactgtgtaccactaagaaaatgatgaaatgaaaaaattgttttaacctaaaagtcagatattattaactcaaaaattttttcctgctttagaaatcacatcgttaagaagattgaaacggaaaatgaagtcaaagtcaatggcatgaacagttggaatgaagaagatgaaaataatgattttagttttgtggatctggagcagacctctccgggaaggaaacagaatggaattccgcatcccagagggagcactgccatttttaatggacacactcctagctctaatggtgccttaaagacacaggattgcttggtgcccatggtcaacagtgttgccagcaggctttctccagccttttcccaggaggaggataaggctgagaagagcagcactgatttcagagactgcactctgcagcagttgcagcaaagcaccagaaacacagatgctttgcggaatccacacagaactaattctttctcattatcacctttgcacagtaacactaaaatcaatggtgctcaccactccactgttcaggggccttcaagcacaaaaagcacttcttcagtatctacgtttagcaaggcagcaccttcagtgccatccaaaccttcagactgcaattttatttcaaacttctattctcattcaagactgcatcacatatcaatgtggaagtgtgaattgactgagtttgtcaataccctacaaagacaaagtaatggtatctttccaggaagggaaaagttaaaaaaaatgaaaacaggcaggtctgcacttgttgtaactgacacaggtagatacttattaaaattgtcttcttaagaaacagtcatgcttgatcattttgctcttatgctattattggtatttctggtcaatatgaagttctcataaaagtctctaagtatgtcaaatcatgtaagttacagtaagcataacatagaaagctaatttattaaaatatttttaaaacaattagatataattgtggctgactgaaaattttcagagaatttaaacagtaagatggttgggattctgagcattcattcctcacgtagaccttatcagttggtgaagttttgaactgtgttaatataacatctatccagtgcttaaactcctgtaagaatgaaattggtttgataagagtaattgttaatttctagaagcttgcatcataatgattttttaattttgacatagagctgttgtaattaacagtggtaaactttcagtgagattatttcacatcttaagtacattggttcattgtattttgttttttaatacttttcttgtcatcaaaaacaaatgcacacacagtagcatactgtttttctgggccagtcattataaattagtatctggtttgaaattttagttccttttacagattataggatttttttatggggagagacctcagagattaatactctataatttatagctgtggaaactgaggtatagagagaagctcatggttctgtcctagaaagtgatagagactctatgtggggtgttttctgttatgttttactgagtttgatgtattcctatgtgcttttagtcaaaaaatgctttttggtatttatgaaatatttcagaataatatagatactagattatccttacatcatgtcttggccttgttacctgaaggttatttaattcttaatgcttctaagaactatgattaattagttctgtgaatgggaataaaatgagaaattttgttattgtatgaaagcatttggtagatactggct

SEQ ID NO: 95480 - DNA, 1932 bp, Homo sapiens
aataaaaatcatttgtccatacaacctggtgcagtgcctagcatgttgtagaggtgtaatatataagaagctactgttactattttatttttattctgtaacattagcaattattagaaaattccaaaaattcaaaagtacattactatctctagaaagtcaaatatattggctgggcgcggtggctcacgcctgtaatcccagcactttgggaggccaaggcaggcagatcacgaggtcaagagatcgagaacatcctggccaacttggtgaaaccctgtctctgctaaaaatacaaaattagctgggcgtggtggcgcgcgcctgtagtcccagctacccgggaggctgaggcaggagaatcgcttgaacctgggaggcagaggttgcagtagacaaaggttacaatgagctgagatcacgccactgcactccagcctggcgacaaagtgagactctgtctaaaaaaaaaaaaaagtcaaataaataacattttacatattaaggattttttaaacctggagggataaagtcaaaggctcgtccctataacatcccactgattccttcctttgcactgtggtctcatgacctaaccactgtctatcaatgatatagtattgattaaaatggcttttaggtatgtgtctcttcaaaggacttggtcttagtatatgaagttggatcactcagagttgagctgtgttgtcactagagctagagtttttatctgggggcaatagttaggctttggagggaatggggaatttctgtggacaggaggagagttgaggggaaagcgatcttgctggggggaattgatttacttagaaaaatggtgttttccggccgggtgcgatagctcatgcatgtaatccccccactttgggaggccaaggtgggtggatcacgaggtcaggagttcaagaccagcctggccaatatggtgaaagcctgtctctactaaaaatacaaaaattagccaggcatggtgttgggtgcctgtaatcccagctactcaggaggctgaggcaggagaattgcttgaacctgggaggtggaggttgcagtgagccgagatcacgccagtacactccagcctgggtggtagagcgagactgtctcaaaaaaaagaaaaagaaaagaaaatgctattttccattacagttgcttgttttgcacgtgttctttttgccagatgcgcctagggagatcataagatagaaaaagcaacttagatagttaaaattcactttaatggattttatcttagtctggactgaggtttaatcatttgtctttaaataattaagagtgattttggacagcatgattatatatcctatgggcctcattttgtatttgaggagacagggccagtggggctcactgacttgcccaagaacagagtaggttttagagtccaggtgttctgaatcctgtttgtgtcctctttttaccatttaattaagcttgttatagatggcccatgtggaaatggatcagtgttggcatatatcttaaatgccaggagtccattatgtcattgtaacagggaatccttttggttaaatcatggcactgtttttattcacactctaatccctggttgatctcttcttagctgtgttttaatgagattttattatacttaaaaattttaacatgtattagctatttaataaacgttacatactcttctgaataattagtttttgtttttattcgagcagtttgaaaaggaactgccacttgtaagtatgtggggtgttgctttaatttcagttccctgatgtctgtatgtcagtagatctgagttaatgtaggcatggttatagggccctgactttgaagaggcaagggaatcctttcatgaggagcctgtgtacattaaagtgtgaaattattttactaaaacctttgttttgtaaa

SEQ ID NO: 95481 - DNA, 2320 bp, Homo sapiens
tactaataagccctacagtaagtctcctttttagtaaatatgagtaactattatttatctgactcctcttgtatactctggaggagtggaaggattagtctttgtaaaatgattcataaatgggtttatagttgttaatttttaaaaacacaatatcaaggtcatatgctaagtatagtaaaaaatgtaaaaatatttgtactgttattagtatttgattcattacttgaggtccctatttgctctgctaggcacttcttagatgtttttgtgttagttggttgtctggcagccagggaagggggatgtactaaaagcaacatagctttctcactttgtgatttacctcccagctttgtttactggcaacacagccaaggagaaggtgaaccaatgacattcttaaagttgacctatttaaggagttattcattagggttctacttcttacacataagactcttaatatattttaatataaattttgcagatccttccgctgaggaattgagaaaactaatgatgttgcatggaggtcaataccatgtatattattccagatctaaaacaacacatattattgccacaaatcttcccaatgccaaaattaaagaattaaagggggaaaaagtaattcgaccagaatggattgtggaaaggtaagtttaatttattaaatttaattaataaatttttaaagttagaatactttttatttatttatttttttgagatagggtctcgctttgtcgcccaggctagagtgcagtggcatgatcatggctcactgcagcctcaacctcccaggctcaagcagccctcccatctcagcttccagagtagctgggactacaggcaggcgccaccacacctggctgattttttgtagagatgggtttcaccatgttgccgagactggtctcaaactcaaacagtcctccagccttggcctcccaaagtgctgggactacaaccactgcgcatggcctttctatttcttttataaaattgtaactaatatattgcctcctgattgacagggtgaaaaataatgtcttaaacaacactaccgtttaagctcatgttgataatactatagcctaggatttggcatcctaataaaagtagcatgttaatgtgtttgccaggaattaggggtgatgactcaggaaagtgtcaggaagcagttatgggagaaggtggagcaagcgtgttattcaacaaatatgtgtgcacctcttaaagactaggcagtgttctgtgttcttgggaaataacaatgaacaaagcaaagatcccttcactacctcatggagtttatattctgttgggagagaaagaatgagtaatgtatgagtacattataccatgttgtctatcacataggtttttagcatggtaatacatcaagataatgtggacctagaatgctaggagtagggggaaaggagggagtacagtcgcagtattatttactgttttttaatgattatattgtggtttctctgctgttggtttggaaatgataagttgtaaatcagtggtgacattcatattgacttcctaagtttaaatatgtcatctgaaaccttggagatgagctaaaacttaagtggtttatatttttaaatgacatgaggtatgtaatacatatgagcaattactgatttataaaagaagtaaaatattaaagtagtaattttatgtatggatagattataatcagtgtatgagagattgcttatctttttaagtcagttgctgaattttttttctagttcttgcttttactaattataacaccctccattaactgttccacaaattaagtattaactcagttcctttgtatagtgtatttagccgcataaattcacggagaagcagcgtggtggaaaaggctgggcctgggctctggagacatacttggcttcagaacttccaaactcggcagttcagtatccatataacctggtataattttagaaactttatgcttggccgggcatggtggctcatgcctgtaatcccagcactttgggaggccgaggtgggcagagaccagcttggccaacatggtgaaaccctgtctgtactaaaaatacaattagctgggagtggtggcttgtgcctgtaatcccggttacttgggaggctgaggcaggagaatcgcgtgaacccaggagatgggaggctccagtgagctgagatggcgccactgcaccagcctgggcaacagagaaagactccgtctcaggaaaaagaaaaaaaaaaaaaactttatgcagtcactcaggaccttgtttcctcatttgtgaaa

SEQ ID NO: 95482 - DNA, 2419 bp, Homo sapiens
ctttacatcatcattggtgaaacatttgttcatatttttttcctcattttctaattggatttagtattttttactgtttagttttgatatttcattatatattctagagactactgctttgtcataaaagtggtttgcaggtattttctcccagtctgtagtttttcatcctcttgaaatggtcttttgcagaacgtttttaattttgatgagatctgatatgttgatctttccttttatggattgtgcttgcaagtctaagaacttgtcactttggtgctagatcccaaatgttttcttctatatttttagattttatagttttatgttttacattgaagttaatgtttcattttgaggttttacaattttttttttttatttgtggatttccagttgttgcaacacagtcagttaggcatattttggtggatctgtttctgggttctctgttctcttccattgatgtttgtgtctgttccttcaccagtaccacactatatcaaatactgtacctatgtggtaagccttgatatcaggtagagtgattgctttcacttgtttcttctttgtcaagataattctggctattctaggacctacgcctctctctctcttttttttttttttcttgagacagggtctcactttgtcacccaggctggagtacagtggtatgatctcagcttaccgcaccctctgcctccctggctcaagcgattcttgtacctcagctacccgagtagctgggattacaggcacatgccatgatgcccagctcattttttgtgtgtttttagtagagatggggtttcgccatgttggccaggctggtctcgaactcctgacctcaggtgatttgcctgcctcggcctcccagagtgctgggattacaggtgtgagccagtgcacctgacctatataaatgttaaaataagtcatttatccacaaaataccttgctgggattttgataggaattacattaaacctgtagatcagttcggggagaattgacatctttactatgttgagttttctagtttacagaccttatatcccattttatttttctttagttgattgaacagatatattttggatgctgcttgtgggttaggaactatgtttgaaaagagatagcagttgatggagaatgtggattttgtgatgaaaaagtaatctctaagccttagacatcaacagaggagggtgagtgccaacacagaagaggaaacaattgcctttgggagtgggagtgaatacttcataaaggaatcgaaatgtttagcttggtcttagataaataggcattttccaaatgaaaatggagaaagacattctagtcctaattctgacctacattttcaacctcatgttcttaaattttgctcaacaagattaccctgatattctagatttgtctttttacttttacagttctgtgtttctgtttgttcttttgcctctgaggaaaaactccttccctcctcacttctgtgaactggaagtatattcattcattaagatccagatatagttaggttttgcctccttccctgtctaagccagtccatagtagtagtattttatatagagagatatataattcatagcattattgctagaaacatttattttgacacctggattttgtcttgtgttgttaggtcttaattctatattaagttctttggcgttaggaagcctgttttatgtatagtaatcccttgccaaacatggattagagataacacctcagggccttaaatttgcagttccttctgcttcctcaggtcttcatcattcagatctctgctcaaatgttacctttttacggagaccttccctgacttcacctatctaaaacaggtgtactttgccctccagtcgctctctaaccccttatccaccttcctcttcatttatttgcacctaaaatggtattacttgcatgacttatttttgtctcctcagtggaatacaagtgctatcacggggcacagacttgagtcttgttcattgccatatctccagtgcctagaaccttgcctggcacattgtagatactcaataagtattagttgaatgaataaataaataacaggttttgtatttgtacatcagaatgttaaaatattttcactcagatgctaaatcaactcagtcttaaggaatgggccacatttgaggcctgcattgtaatctgggaggtaggctctgggcatgtttatttttgtgaaagctgcccagggggagtgagtgcttcagacttagtggacagtggttgcactttagtggtgtgagattgggacagttcatatggaaagaggtgttcaggttattttctacttcctttagtacatgggtaaaagaccaggtcttttgattttggcactgctgaagtttgtgaaaaagca

SEQ ID NO: 95483 - DNA, 2996 bp, Homo sapiens
tagcctcattaaaccatcattaaggaattttcttattggccttgtgcagtaggtatacaacagacgttacacaactggatctcttaaatgattgggccaccaaatgtattaaaatacactttactcctttatttacctttatttaacagtttaatagctgcctttaattatcggggtatgtgtttttagtgtataatggccagaactcccaaactctttacttgttccagcaggtgtatggattcagtttacatgtagtccagtgctgtgtgttaatgtatctcccagatttcctttaagggctgaagtctgttgggactggacaaaatgagcctcttgaaaacaggagaaatatttaacagagcatgtggtacttctgggacttgataatgagcacattgggtattcatgctcctcctgccttcatcagacttaaaaaagaaatctctcctcagggttaatcagtttaccaccttttctcggagcaccttgcacatgcccctaaaacgtttgtattatcttgtctctctgttgggacttaaccttttgacaacacttctgcatgtcttttaggcatcttttaagggtgacagtaaaaattcaaattgttataaatgtcaacaaacaaaaaccaaatcctgcagtatactaagaataaaaatattcataagaaaatatctgctggccaggcatggtggctcatgcctgtaatcctagcactttgggaggcataggcgggcagatcacctgaggtcagaggttcaagaccagcctggccaacatggtgaaaccccatctctactaaaaatacaaaaatagccaggcatggtggcaggtgcctgtaatcccagctactcaggaggctgaggcaggagaatcacttgaacccgggaggcggaggtggttgtgagccgagatcgtgccactgcacttcagcctgggtgacagagcaagactttgtctcaaaaaaaagaggccgggcacggtggcttacgcctgtaatcccagcactttgggaggcagaggccggcggatcacgaggtcaggagatggagaccatcctggctcacatggtgaaacgccgtctctactaaaaatacaaaaaaaagaaaaataataatcgggcgtggtggcgggcacctgtagtcccagctactcgggagtctgaggcaggagaatggtgtgaacccgggaggcggagcttgcagtgagccgagattgcgccactgcactccagcctgggcaacagagcgagactccgtctcaaaaaaaataataaataaataaaaagaaagaaagaaattatctgctaatgtgtgtggggtaaagtgtcatggtttaaggtgttgttaagtaaaaaattctcatagatcatatcagagctgatttgacgtggataatatataaggcttcatatggtaaccatttgatacacatgtatatagttactagaagaaaattatcttaatagaagtcatattaattttgttaagaataaatgtagtcatagcccaaaatgtagctgtttgtgttaaaaggctttgactttacaaggggtttcatttagcctctttttatgaattatatattttgctagccactgagccagctgccacttaatgtgagccatcatttggtcatcctggtggttttatagtatagttagttaagtaagtgttgccttaaggagaatgacagatttactattatagtttattatcaatgataatcttttctgcatcatttttaattgacttcttctagggctttggcagaatatgtgaatcaggctatgactgaactcttaagtgtccagtatgtaatagcaaagacagagtttaaaagccacactataggacaactcatgaagggaaatgttttgttagattgtcttatataatggtaacaagtaaagtaagcatggccatgttagttggatttggtgttttatgtaagtgaatgttaggattggtgctcaggaatgcataaagatatttttctattgaattttaaatataagagttacaatttaaacatgtgtaggagggtgttttatagacaaatttcacttgtaaagctggagaatggagaacttcagaaaaagtttacttaatattgtatactttcatcagttggacatttgaatttaatttctcattttcttgatattgaaataaaatatcatttagaaatacattatgttataaaattgacattttttttttcctccccaatacagaagctccaccatgaggcgaggtggatggaggaagcgagctgaaaatgatggctgggaaacatgggtgtgttttaaaagagtaaaaataattatatcgaactgtctagttatttttcattcttctgttataatgtggtttaagttgttttctaaattgtaaattactttagacaccacatctttgagttttcacagtgtattgaaagccttatgatgtttataaactttatcccctaaactttactctcaggaattttaccctgaggaaataaatatgcctagtgcacaataatttactatatgatgattttattgcagcattgctaataatacagaaaaacaggaaaacacataaatatccaataataagggattggtcaaataagttatctgtgtatagtggagcactgtacagtcattattcagctttatatatctcaacctggaaggataaccttgactaaaacaatgtgttacaaagaaatattttgtatgattatatgtttgtaaaacctctgtgctctgagttatggaaataagctttgaaaacaacaccccaaagttttaatgaataggattataccagttttaattttcttccccatatttcctgtattttctgaaaagaaacttcatagtgagcatataatattttaataatcagcaaaaataatgcagtcatttccattttgggaaaaaaacatcatgtacttctagccacctacacctttaatttaaagacctaataattgaaatc

SEQ ID NO: 95484 - DNA, 1038 bp, Homo sapiens
gtagaccatggataactgacttaaaataatgatgttctctgtgttatagttttcaaagggtttccacgtgtgtagtctcactcgattttcactctgtagactggcagagtagattactataacagtagttaatgtttattgaaggtgtaccctaaatgttaagggtaagggtacttttgcattcatgtattcactcttcatccgttttttaaactaattttttgaaacacagtaattggctgccctgttaaagttactggataaggagagattggcaggttattttaggttgtgaatcacagtttcagaaactgttatcacattcctcaaggtcatcaagttatgtggaattaaattgggagcctggtctgcaagagttcctctgaaaactagaaggcaatttttgtttacaagtctagcttgataattggatggtttgtcaatacagggcagtcacttcttagtgagtaggtttagtcaagaggacacattgtaattcaggaggttgcttggaacaggataaaaacagagggagtgtgttatttctgaaggatatttctgtcaagtagtggtatcctgattaaatgccctcctccgttctagggaaagtcctatttaaagaagcaaatcagtcatcttagtgtggagaacttttccctggatgttattacagaggcattggcggagtctctttttcgaagatccctgctgattagcagaaacagcccccatgcctggctaatttttctttctttcttttttttttttttgagatggagtttcgctcttgttgcccaggctggagtccaatggtgcaatctcggctcaccgcaacctccgcctcccgggttcaagcgattctcctgcctcagccttccgagtagctgggattacaggcatgcgccaccatgcccggctaattttttatttttagtagagacagggtttctccatgttggtcaggctggtctcaaactccccgcctcacgtgatctgtccacctcggcctcccaaagtgctgggattataggcgtgagc

SEQ ID NO: 95485 - DNA, 1840 bp, Homo sapiens
tacaggcatgagccaccaggcccggccttttgttttgttttatataccttggtgagagtcccttcaagatcaaaacctgactagtttgtgggatgtgcatgtctgtagtgcccgtacaacttcagcaattgtttgaaaactgtagccgtagacaatgatggtctgtaaggttgaatcaaaacaaaacccacaaacagctgtatttttatatctaaatgttacataaaaagctgtttgtgctgttaaaacttttaccattaaaggacagaataagagcacattggagcagactgttaccaaactttttttagggcatgcgtgctagcactttatgtacttagtcactcataaaggcaatacctggttcttgtaaattctacaaatggcctcccactactgccaattcaaagtaaaaaacaaacaaaacacccaggtactgctgtacagatttcttgaagtagcctttttcccagctttgcaccccacctgaagatcctgtccactgcagcttgcaggtgcctatacagtgtttccagcttcagaactacttttttaaaaaactcttttcttcttaattgtggtacgatacatataaaagtttaccattttaactgttcagtcacattaagtacattcacattgttgtgcaaccatcaccactatccatctccagaactcttcaccttgcctgagactctacctgttaaacagtaactccacccgcaaccaccattctgctttctgtctctgaatttaactactttaaatacttcatataggtagaatcatacagtatttgtctttttgtgaatggtttatttcacttaccataatgccttcaaggttcatgcaagttgtagcacgctttggaatttccttccttttaaggctgaatagtatttcgttgtatgtatataccacattttgtttacccattcatctgtggatggacacttgggttgcttccaccttttggctattgtgaataatgcttattaatatgaatgtacaaataaatacctctttgtgtctcaggtttcagtgcctttggatatatactcacaagtggaattacatgataattctatttcagattttttgagtaactgccatactgtttctcatatcagctgcaccattttatattcccaccaacagggctcgggggcccaatttcttcctatccttatcaacacttgttttttttttttttttttttttaatagtagctatcctgctgggtgtgaggtggtatctcattgtggtttctatttgcatttccatagtgattaatgacactgaacgtttttttgtgtgcttattggccatttgtctatcttctttagagaagtgtctgttcagatcctttttttatttcttagtggcgttgtgtgtttattattacagtttatggtaggagttctttatattggtaagtgtatgaaccccttatcagatatgatttgcagatattttctcccattctgtggattgccttttaacccttttttgccctgtgattcacagaagttttaaatttttatgtagtccagtttatctgtttttttctgttacattttccccaaaaagtcattgcaaaatccagtgtcatgaagcttttatgttttctcccaagagtttgatagttttagctcttatatttatgtcttttgtacactttaagtttttttttaacatggtgtaaaggtccaacttcttttgcatgtgatatccagttttcctatcaccatttgttgaaaagattgtcctttcctcattgaatggtcatgaagaggttcttttaaacacagatgaccctgggttggatcataccttaagc

SEQ ID NO: 95486 - DNA, 1584 bp, Homo sapiens
gtgtttgttgaaagcgtttttaaaactagatgtgtagaatcatacacatttgtttattttcatttatttatttttttgagacgaagtctcactctgtcacccaggctggagtgcagtggcatgatctcagcttgctgcaacctccgcctcttaggttcaagcagttctctgcctcagcctccggagtagctgggattataggctcccaccaccacgcctgactaatttttgtattttttagtagagatggggttttaccatgttgaccaggctggtcttgaactcctgaccttgttatccacccacctcggcctcccaaagtgctgggagtacaggcgtgagccactgtgcctggcctatttattttttttttgagacagagtgttgctttgtcacccaagctgtagtacagtggctcaatctcggctcactgcaatctctgcctcctgggttcaagcgcagaatcatgtacatttaaaaaattgcaaaagactctagaatttgtcaggtctgtaaaaagtaaaagtagatgtacctcttcaaagactttcctccccatctgattagaaataaatagtaacttctcttagaagcaaaatttattcaaagacctgtgctcctaaatatttgccctggcatgcttatactggtccaagcaagcattaggtcatatcctgttctcttccttatttaaaagtgtttttatccttctcagcattccacaagttacttcctccttcctttgttctcctccacctttgcctcttttaaaaagttctaagttgctagccaatcggaacaaatacagaatgtgaggtcccgttccagccaatggaaaccagacacagcagtatgatggacgcatcaggttataaatgaccctgtctcctttgttccttgtactctcatggcaaaactgctggcgagtgtaccttttctgcaggaaataaaaatggccttactaaataaattaaatttatgttcaagtgctgtttctttatggcaccggggaacaagcatttcaaacaggtccaactctttccacatacggaggaactaaaatatgactgattatgacttgcttaagttcagagaaccggttagcaacaaagttgatgctgtctttgaatctctacttcttttttttttttcttttttgaaacggagtctcactctgttgcccaggctggagtgtagtggcacaatctcggctcattgcaacctctgcctaccgcgttcaagtgattgtcgtgcctcagtcccccaagtagctgggattacaggttcctgctaccatgctcggctgatttttttctttttaatagagacagggtttcaccatgttggtcaggctggtctcaaacttctgatctcatgtgattcgcctgcctcagcctcccaaagtgctggaattacaggcgtgagccatcgctcccgacttctgcttatcaatatggactagttggggtctagatggagcttaattgtaggacctgttttcttccttagttttgttacatatatggctctattatgatccagactgttgctagattacctggtgaagaagcatctgttttgttg

SEQ ID NO: 95487 - DNA, 1035 bp, Homo sapiens
aaaccattagctcagacctggaatttggggtaaggggaagtggggggcaggacaggcgagattttgttgcctgtaatctttttgttttttttttttttttttgagacagagtctcgctctgtcacccaggctggagtgcagtagcctaatctcggctgactgcagcctctgactccctggttcaagcagttcttctgcctcagcccccaagtagctgggactacaggggagtgccaccacacctggctaatttttttatttttagtagagacgggatttcaccatgttggccagtgtggtctcgatctcctgacctcgtgatccgcccacctcggtctcctaaagtgctgggattacaggtatgagcaactgtgcccagcctgtcgcctgcaatctaattaaaaccttcacctggtgaattgcattactcctgatgtgaaattcattctacttaggacacgttgtagcatcattctctctactgtatataacctttctcgttaccactgaactgtccttttctctattatcaccactatagatacatttttaggtacaggcaaaaccagtggttctcaaagtgtgtgccgcagtccagctggaaatgcaaatttccagccctgccctagactcactgaatcagaaacgttggagttggggcccagcatcttgtgttttaacaggccctgtgctagtgattctgatgcatgctcacgtgtgagaattactgctttagatatatttccctcttctttgatattatttcctttattcttcagctaagttctgttcttcctgttactagctcttctgctgtggcctttggaatccctgatttattgcaaccttgaacttttctacagataatcatttggctttcctgtgagattataccacttctccttagtgaagatcagtggcttcttcctccttcctctagactcttaatttttatcatgtcatctctagaacattcttttgtgttccttcgtagcttgatcctgcttatggacatgctgactttgagatgtgtag

SEQ ID NO: 95488 - DNA, 1067 bp, Homo sapiens
actctcccacccaatttacacttgcttaaaacttacaaagtaaggtttaaacttcttagtatgatatattcaaggccttctgttatatttctccacctaccttagtttgtctacctctacatctggccatgttcctacatactggtaagttctagaatgttgtcctaaacatctttttgtattttttatgaggcagagtcttgctctatagtctaggcctgagtgcagtgacgtgatgatggctcactacagtcttaacctcccaggctcaagcagttctcccatcccactctcccaagtagctgtggccatgggcgtgcaccaccatgactggctaattaaaaacaaattttttgtggagacaagggtctcacttcattgcccaggctgatctcgaattcctgggcttgagcagtcctcctgccgtaaccccgcaaagtgctgagatacaggtgtgagccactgcactcggcccttttatgtttttaattatgaatttttcttcttcctgaaatctttgccttcatgtcaccccttcccacctaccttctatcctaccttctatcctgtaaaatcctactgattgttcttagttcagatctacctctcagtgatgctttcttgggtgtcttctcgaacatgagatttatggctgttttctctgtgcatttattgcattccattagtgcctataatgcaggatcttgtattattattattattattattatttttacttttttggtcttgttctgtctcccaggccaagtgcagtggttcactgcagccttgaccttccaggctcaagcgatcctcccacctcagcctcctgactacaggtgtgtgccaccatgcctggctctttttattatttttattttttttgtagagatgaggtcttgctgtgttgctcaggctggtctcacgcaagagatcttcccaccttggcctccaaaaatgctgggattacagatctcatattatagttatatgcaaatctctgataaccttggattgtggtttattctcattttactcaccttgaaaactatagattatagtaaatt

SEQ ID NO: 95489 - DNA, 1063 bp, Homo sapiens
aagaatcttacagactccagaggcaatgccattatatcttactggaggaaagtgagaccccaagagtcatttgcctgctaaagaggagaaataagatgagaccctaggttttccccccaaggccattttttccccctgctacaccaaactgttccctgcattactgagggaaagaccagcaacacttagtatctcatattcaagagggtggaaaataaaacgatatgttcttgtaaaattacgatttaaagtcttgattttatcattggaacataatagaaaaaaattttgtcctctattataatgcagttgaaaatgatactttctcatataggcaggagactgccttatccacataggatgctttgagaaaccttttaaagactagtcgggtcccatggctttgtgcttgaattaaaatattaggtagtgatgggcaaaaaaagttggttgtgatgtgagtagttcgtattcaaactcatagcctattaagcaaagtgttgcttactgacctcagtcattcctgatcatacccaaggctaaaatgaactttttggaggtttagtcacaaaataatggctgcatcttacattctctaagctccatcatttctacatttgctatttctaggaatggacttaatgcatttttatcttttaggcactggtctgagttatgtagttgaaactacttagattttttgctcttttaaatggttttcattaagttctgtattttactcataataaattcaatttcttgatgactccttagctttttattttaagcctttttttttaaagcatttaacctggacagttctgaactttacaaatgttttaacaatttcttcttcaatatcttaaagaccgtaacaaaaaaaaaatttttttttttttttttgaaacggagttttgcccttgtcgcccaggctggagtgctatggcatgatcttggttcactgcaacctcctcctcccaggttcaagcgattgtcctgcctcagcctcccaagtggttgagattacaggcacctgccaccacgcccagctgggttttgtatt

SEQ ID NO: 95490 - DNA, 1099 bp, Homo sapiens
gattgtcactttcttgcttagtgtcctctaaaagcatcctgtgaaccacttacatttgaatcttagtcgccatcagggcatagcatgatttggcagctgccagcttctaacgttacctcttactaggtgactgactttcagcaacctaccccagtcccatagtcattttgccggttcttgaacaaagtgtttcttccttaggatgttatacttactattcttttagctggaccaccccttcctctaagtggtcaaggctcttcatgtcttgtcttgtgtttctgctcaaatgtcatcgcctcaggccttttctaattctaaaataggaaccagccccttcctttataatcttttattctttattctctttttctccatagcatttattactaggtgaagatacactgttttttttttcccacttatttatttccccccttagacttgtttgctgccagccctgttctcaacaagcgagcagaggtcttgtctgacttgtacacagctttatccccagtgcttagaactgtgcctggtacatagtaggctgtcagtaaaacttgttgagtaaatgaatagtatagttgatttaaatattggctctggaatcagacagctagggtcagaattctctggctcccaccatttactgattgagactgtgggcaagttaataacttggtggtgcctcagttctgctcatctgtaggatgactgtaataatacctacctcacaggattatggtgagtaataattgagttaatgtatgtaaagtgcttagaacagggtaattttttttttttttgagatggagtctcgctctgtcgcccacactggagtgcagtggcaccatcttggctcactgcaagctccacctcctgggttcacgccattctcctgcctcagcctcccgagtagctgggactgcaggcacctgccaccacgcccggctaattttttgtatttttagtagagacggggtttcaccgtgttatccaggatggtgtcggtctcctgacctcgtgatccgcccgcctcagcctcccaaagtgctgggattacaggcgtgagccactggtcccagcccagaacagggaa

SEQ ID NO: 95491 - DNA, 2460 bp, Homo sapiens
tgtccgaatggcaaccgaagagccgcgacccggtcaacgaagcgcgggggtgaccggagcaggacgggcgggcaggcggcgcagtgcgtgggcgggcccgcgctgcgctcccctccgcccagctagcgagacggtcacgtgccgcccaggcgctgccccttgcgggcggctgcagaacaacagggcggggccggggaggggaggaacacggaggccgacgccgggcgccgcggtgctacgcccgaggctggggtcgccccgggccggggggagcagagcgcgtgcgccgcgcggctgtgagcgcgagcggggccggggagcgcgcgcggaacgctagggggcgtggctgcggcgcgcgcgctaaccggagggggaggggcggagagccaccgcggagcgcgcgcggggttggttgccgcgagcgtgggggagcgtggaccgcggcgctgctcagcggtggggctgccttcccccggccctcctccctggtccctggcgagggcactggcggcggcggggccggggtccgcaaggccggagaaggccgccgggcccgggcatggtggtctggggcaacgcggaaggtgagcgacccccgggccggcggcggggtgggggaggggcgggatcggacacgcgtcgcccggaggcgccgcagacccgcccggcagcggccagagcgcggtcggcctgaggtggcgcgggggaggggtgcgtcgccccggccccggcccgcggccgtcctgtcgcggcctgggctgtccacggcgccttcccctgacgctcgcagccgccgggttatgtaatgtgtgacctcccctccccttcccttccgtcatggcgcggccggccccgcgccgccgccagccccatgggccgccccgcgccgacccctggcgcagcggcccttccctccgcgcccggccgcatcccgccggcccggtcagaccgcgccgcaaactccttcctcctgcgccggcgcctcggccggccattcagttccgcgccattcattcacgcgcgcgttcgggcgttcgttccacaagcgtttgtagaatgtcgacccggtcgagccgccgctcccacccgcactccagccacagcgtttttccgcaccccgccttcgacgtccccggtgcatcccagaaccggtcggaatgtccgaaggcggttgttgctcccttgtttttccttgctgcttgtccgttcgctaaatacgctgggcgccgttccccaactgtccttccgagagccccttgcccacttctgtactgttacagtgacgccgctctgggcgcaccgagccgcgctgtgtttcgctgctcttcctacctattctcagtttgtaaagaaataatctcacataacactccttaatgtactcctccgtaagataaattgcagataatatacgtctgctaattctctttatctccacgtcttctcacgccatgtactaagtagaaatggtttcatttaggtgaaaataatgcagactagcacatagcacaacaagggcttgtaactattaaggactttatgtaacagtctgtaattctgtgtatctgtctggtctttccggacttggcactttagtctccgagaataagccatttcctgtttaggtagggtaggaccaaccataaccttggttctttctatggagttctgtatgtagcaaatcagcctgtgggaaccatctatctgtccaccaacctttcacacatattcttgggtttgcccgtgcagggaccagtgctgcgtattgttccctgccttcctgtactggacacttaagagctcacctaaagttcctcttccaggaatcattctccagtatacaaggctctcttccattcaattcttaggctatttgcgccttttcctgtgttgcgtttatctttttagccctgtcttctcttactgtgtaggaccttttgagggtagagtctgtaccaaactcctatcttttgttgtagaaccttaaccgctattttacggtaaaccgtacatatttaattttttttgtaaagatgggaattgctcttttaaaattaatttctatgaggtctcaagtagaacataatttttaaaaaataatgtgcttgaatatataagatcactacatttccaacttcccactcgcaacttcaaaactctgattctacataagagcattaaggaaacgttgtcctcaccagcaacaaactggtcattattcataagaagttgcagtgactacatataatatatatttgaaagcactttctttgatagctgctgtagtggaaagacaggaagttcacagttacatggaggttagatttctggccctacaaattgttagctggtgactggacaagttaagttactagtatctctgattttttctcgtttgtagaatgaagataccatttcccaccttgggtagctgaggattaaatcagttcttaaacgtga

SEQ ID NO: 95492 - DNA, 1144 bp, Homo sapiens
acagagccacgttcacgttcaggagtgggaagcattactggactaggagaatgcagctggaggatatggattttctttgctatttggctaagcaaatactattcatttgagttagaaatggcagatatcatgtatttatttatttggatataggatgagttccccatccttggattttattttgttcaaaggaatgctaaagttacatgatggaacggagaatccttgatttatatagagaccatgaatggaatttttccttacatcagttgctcaggatagcacacctagcatgtgtggcattcttaacaactctttctgtccccctagaattcttcaacgacctggatctgctcatggggccggtcaccctgcacagcagcatggagcacctggtccagtactcccaacagggcctgcactggctgcggaacagcgcccacctgtcatagggacctcaccctggggccagagtgggctctggtctccacagatggctcaacgtttttggacactgtgctactgaaactcccagccacagcatttatcagactgcggtgaacatttcctcagcattgaacaatgatcttttgcagggcatgtgtgtttgtatgtgtgggtatataagaagccgcctgtgtatgtgtgtaagatacacagctcttcagaacacaccttctttgtctagtttccataatcccaggctagacaaagtgatcagaggtttctgactagaggaagtacacacacacacacacacacacacacacaccgtacactcacacacaatcacagacacacactttctattccattccagtgctaaaccgtgacttcttagaaaattcaaccaaaatctcatgggttagttaaccaggtgcaatacagcacaccaaaagcttgactgccagtgaagatggacctgctcttatactgttgattactttcagtattaatatactattccccaattattttttgattggtatgtattaatgggtaattgaataatgaaaataagccaggtatttttgtgccggaagtttactagattgcatgttaccaaataccctgctcttcctctaattcccttcccccatctgactctattatcaactaaatgcattccaggcaaacagatgga

SEQ ID NO: 95493 - DNA, 1115 bp, Homo sapiens
ttcagaaaccatgaaatctttaggtacccaagacaatttggctatatgtgttttatcagtacagagctatctctaaaaaaaaagaactttgttcctaccggtatttcttgggcatggggcttagtggtagaggaagagaactcaagacttctttttttgttgtttttttttgagacggagtctcgctccgtcacccaggctggagtgcagtggcacaatcttggctcaccctaacctccacctcccaggttcaagcgattctgtctcagcctcccaagtagttgggattacaggcgtgtgccaccacacccggccaattttttgtatctttagtagagatggggtttcaccatgtcatccaggctggtctcagactcctgacttcaggtgatccacccacctcagcctcccatagtgctgggattacaggcgtgagtcactgccttcttcctccattcagtagcctttactggactgtttctgcaacccccaagcctttctccccttctgccattagtgttcttatatccagaacatgcattctatagatcacgttctcagaaccacaggatgaagtggaaacaaagtgatcagtccagtagcaccagcttgagaaaggtgtcagtaacattgtgtcaagaaagggaggataagctcccctgttcaggaaggtttcctaattctcctcatgaaaataattgtatttcctgacacaggtaaaagtggcatggtttgcggtgttgtccttacatttacatcttgccattgtagcacctcagagttctgacaggccatttcttgccattttaataacacccgcactaaaaccagaaaaatcagtcaccactccataaagttctttctaaccaaaagaaacatgttgtctctggagaaccaggctgaggctgttttcttgtctctggaaggggaaaactcccatcagcatcacaaagaccgctttctcccttaacagtcctatgaaggcatgattgggttctcagaggggaaatctaactgtgcattgagcaacttccctaactagaggcaaaacttttaaatatctgatgcaagcacctggcttgtgcaacagaacttcctaaaccagaatattcaga

SEQ ID NO: 95494 - DNA, 1109 bp, Homo sapiens
gcagtgccagcatcctggagtggctgactctgaagtgccctcatccatagtcttcactgactctgtgtattaaaaataattacttaatttcttatgcattctcctcaaagcttgggacatattaacacctctggggcttatcagatgacaagctgacatatcggatagcagatgatgaattcatttggtatgcagttgcctatttgtctgatttggatttcaacttccctaagaaaatcatccaatttctgccgcgccgaggaacttgttgttcaaacacattgagctctcatccctgccagttttcacaaaacaggctggctctactgagggcggcatttcacagaggtaggaattacagaaaggagtctgccaggctctccgtgggagaccattcaactctatcccggccacaaaggagaacaaaaagcaaggttgctttaatattcccatgccagaagaaatatgggggtagctcaaaccctgatgctgctgagaaccaagaccgtgtgtttctaggtgggggggggggggtggtgggagggggaagagaagaaaagaaaacattctatttggatcaagtgctcagaatgcttttgttggagagagctctcataatgaagatgcatgcagctaagctctggctttcagatcactcaagccccgtttctgaagagcccatgattcacagttagttccatttatggtgtttaattaaacttttattaggtttgctcatgtgtcatcataaaataccatcactgtgggaaacaatgggaagaattttattacacaaatgaaaaatgaaaactctaggttttccatgttaaaaaaaaaatagaagattagatggaaaatctatttgaacactcagataagatctcattttagtacctttgctgtattatattctataactgtcacaatggtgacaagcaattttacttttcctactgacttgtgtattgctgtcagaagggatgcctttgtgattcgtggcaaggctggacactgggtgacatcccattggtcctgctggctttataatgatctgctctggaagtacagcactagaaatcactcgaaaggagaaaatgggccaatcatca

SEQ ID NO: 95495 - DNA, 1071 bp, Homo sapiens
tcaagttattggaccccaggttaaaaaactcttgctctagagacttagcctggaagagcctcttagttctgatggttttgttgctgttaagtggtgacacaatgcatataaaatgcttagagtacattctgagaaaggtggtctgtgtacctctggaattgtgattactactatcaagttttaccagtgctgtacagcagtccaagagaaggggattgccaatttcaaagaagagctccaaagaaagtttctttggccaacttgaatatatatataaacttgcagtgatgaaaaacaggcaatcatgatatccatgataatatttaatgtcacagttttgttttccatgcactgtaaaaatcataaagtatgtcaaataatagagactgaggaaaaggtctttcttcactcacatttcgagaaacaattataatcaggctgttcgcattatcttcagcatcagcatcttagccatcactagatgagcaacttttgattctcccaaagcacttttgcgtgacacagcctctatgttgttagacacaccgtgcttttggaacagtgcttttcaccagaaatgctatccccacatgtatccatttgcataacattcagaaccttggttttgtcatttgttctagaggtctgtgtttgtaatttctccactgtgaccaccagctaaggaaattgcttttcgaagtgactttagtggcttctttgcggtgataaccaacacgtgcaattaagagatcccaaccccaagaataatgagtaaatctttgttagatggctttaccattttttaactgactctaccaggtgacctctggaagtatcctaaattagtgatgactgagtttatttcaaactaatctgtcttccccaaacaatacttttaagtaatagaggcctaacaatataatatacattgcaaactcagatataagtgaatccctcttcactgatggttgattttggagaatgttacattcaagcacagacagtagttttgaaggtaaaataaggagttaggaatcagaaactgtaacttctactcaccatttttattta

SEQ ID NO: 95496 - DNA, 1036 bp, Homo sapiens
tgtttttgttttgagacagagtcttgctctgttgcccaggctggagtacagtggtatgatctcagttcactgcaacctccacctcctgggttcaaatgattctcatgcctcagcctcccaagtatctggaattataggcataaacctccacacccagctgatttttctatttttagtagagatggggtttcaccatgttggccaggctggtctccaactcctgacctcaggtgatccacccaccccagcctcccaaagtgctgaaattacaggcgtgagccaccacacctggcctcatttcatcttctaaagtactctccctaaaatcctagtgagtcttgctttccaaactcaggtaattcacccccagtctggaaagccacagagtggtctgtgcagctccagagttggtgctcttagctacttcagtagcagccctctgcatcagactatgaagaaatcagtgtcactggagggacacaggtacaatattaccctactctctgacaggggaaggagaagggggaggacacatatgaggtgtcatgtggaggacaggaagcatcgggtgacccaggagtggagaagggaggagaacacagaaggaatggcctgggcagggccaggctgcagggtggacagggagtggcaggcctcccctctgtggctgtgggcatctgagtagaaagtgtctgaagccagctctagacagctgccagtgcaagaactcatgggagggatcttcggttacgcagtgcatccctcaagcatggggtcaagcctcatcttctacggaaaccttaaatagccaactgccccagcgcccacagctcctattccatcagcacctcatgtaattcctggcataggcccagcttacagtctctgcctcctttatttatgtctggtcttaactactgagagcaagaaccacatcttgactattagtagtactttatacaaaatgactgctcaatcatgacttattgaatgcagtaagaccaagaatacaaattatgccactcatttatgctgt

SEQ ID NO: 95497 - DNA, 1019 bp, Homo sapiens
ggagtgcagtggtgtgatcacagctcactgcagcctcgacctcccaggctcaagccatctcagctctccccgtgccctgcccagtgccatggtagccaccatgcctggctaatctttggacttttcgtagagggggggcttcaccatgttgcccaggcaggtctcgaactcctgggctcaagtgatctgcctgccttggcctcccaaagtgctgggattacaggtgttagccaccacactcggcccagcaaagttcttgacaaagtaaagaagccaattacaagaaaatctcagtttgcaaagggacagaattcgtctcacttattcactgcttattgtgtgcctctcgtgttttttcttcttgtgggtcggtgtatttgatgctggttagtagagacaaagaagaaggacaaacaggataaaggtggatctttggtgtggaccctctgcactgcgaaagaagccacatcaccgccaatgtggaaaatatgcaaagtgccgttaggaagaaggaaggatatgtgtgcagcatatgaagtgccttgaatacgattaacttcccttcatgagtagtaaatagtagataactctgatcaaaaaagggattcatgtgatttatcaagctgagcaactgcgcgtctgcagagaagctggaggtcaatcttgaaatctagggcaagaggagcactaggcaattgccaggactaagaagttaatcatacccttggactgcttccatctgtctcagagtgacagcgctgctctcagcgagcaggcatgctttatagcagcagatcaggaattaatattttctgtgaaacctcaagcatcatttgcagtaacttgggttttataaaaatggaacataattttatatgaataaatcacgttcagctagaaatacgagaggctgcaaaaaattatgcttgacttaaaaaaaaagagagaggaacgagcaaaaaagccaacatgaaaacagttgttgaagcgatggcacttggagggcacagatagccatg

SEQ ID NO: 95498 - DNA, 1049 bp, Homo sapiens
aagtatttaaataaagcaaatagggaaataatacacagatgtgaaaaaaatgtatttccacaaacctcttagattggagatcgtggcaaacagtagtatttgtcatccccgaggttacctgctcacatcttgtaagtgttatgggttgagagagagctcttttaggtggagggaaaatgagctaggatctctgccatcaatgttcttttaaggaacttgggaagccaaaaataaaattgtcatgaggcagacggcatactccccaaaaatgactagaatccagggctacttcatgttacagactaggagtgcatggagaggagcttgagaacttttacaaaagagttaacacttaacacaaagggtgagctagacctcagagtgtctgctgtgaacagagggaggagctgatagacagagagccagaaaatcacacaagcatcagttggactcaacattaggaattagaaggattcgtcctctgctgaccccgttcagctctgtgctttcgttattggcatgctcctcaggccctgaggtctgccttcttatcatgatcttatttaacagggtttataagcagcaagtcatatttgcacagagcagtcctcattagagcgactgtacagccccatgtgcccagaacagccaggttttctcgttttgtctctgactccagtctggttagcatcccctttctctctcaaatttgttcttatttggatgataaattatattatcatccctgactgcctgacccctatagagaatgggatgaggtcaaagttgaccgaacaaaatgcttcctaggcagcatttatttctaggaatccgaaaatgcaaaagactcattattgctgaggaaaaaatagagaggagtaagaatttttcctttgtcttgcagatattactaaacgggttgaaaaatactaaatggaagcccacaacataaaaagttaagagacccattaactaggactgaagtggaaaacaatggcataaaagttcagataatgaaacataaaattgcttatagatgtggaaggaaa

SEQ ID NO: 95499 - DNA, 1858 bp, Homo sapiens
ggaaatggggtcagggtgcgtgaagcgactcaccccacatgcatagacaggtggggcagagcctgggccatgccttatcctgccagttctttaccccccagttcgccccaaaagtgactgaaatgactcctacgaatgttcagaggcatgtatcagtgataggcctacaaccggcttttaaaggacactaggtacattttaggggacagcctttggaagctggcttcaatgaggcctttgagcacaagggctcagcgggcttcacactgatgtatggagccccagggtccctcagaagtgggctctcccctgctccctcagagcgtctctgcgtggagagcacgcttttatacagtgcacttctgagtaagatttcttttgaaatgaattaatctgaaaactactataaagaaaaatttagccatgctgaaaagaatacagtgttatcataacaaataacagagtctgaagttctgtttctttttttcacttttaacctcgtgcttccccgctgtctcctcaggatgaatggggggacctgggtgggctggggaatcaccttcacaggcttttcagaaagcgccctcctgcttggttttccccactaggtaggatcttggggacaacatcttttccagctctttgactgatggatggcctaagaagcttcgctcacaactcaagtttatggctttatggctctttttctcatctctctttaccatgaaagcccctggggcaggcacggagacacagcccagcactgggagcttggaaaacactaaacaagtaattgtggaatgcaaactgcccaggggaaaagcccctatgtatttgagagaaaaaaaaaaaaagcatcttcttttttattgctattttcaggtacgtgtgatattttgatacagggattcaatgtgtaatgatcaaatcagggtaactaggatattcgtcacctcaaatatttatcttttcttcctgttgggaacattccaattcttcccttctagctatttcgaaatatacaatacgttattgttaagtattatttccctgctaacacagcatcttctgaaagctgcccgtcttagctgatgactgttgtgagggttaatttttatgatggggctgtctactatttcctaagtgcaccagaggaaaagtgcataagaaggaaagaaaaaaaataggaaatcaaatagacttatttccaaaatgttgctctaataacaacattaaggtgatattttggtgctgaattattctgaatccactaactatctgtacctctttgtacctctttgttccttctttcagaatgctggaagatgaccttaagctaagcagtgatgaagaggagaatgaacaggtaagattctcttttatgtcatcatcctttggaggtgacactggtaacagttacctggtggactgtgccgggtgttaaccaagctgaatggtggcactccaggctgctggtcttttgtctgctaagtgtgagcttctatgcagttgggtcagtatattaaaatagcttgcccataatttcccttaagccttgaattctgtaattttttatgatattgagaccagcaatgggtattacaaggaagctaagatcaggcttccctcagaagtagacagagccttttttttttcttttttatttattcatgtgtgtgtgtgtgtgtgtgtgtgtgtgtgtgtgtgtgtgtgtgtgtgtgtgtgagaagctaactggccttctggagatcaaacatatgaccttaacctcatcagcatgcaacaggcaatccgtaacattaaatattgagaagtcttacacagatattattaacattgagaaggagcaaatgtagag

SEQ ID NO: 95500 - DNA, 1099 bp, Homo sapiens
aaatgcatattaaaaccacaatgagatgagataccagtacatacctaccagaatgtctaaaataatgataacaccaaacactggcaaggatgtggagtaactggctcactaacatattgctggtgaaaatgtaaaatggtatagacactccagaaaataatttggtagttccttttatagctgaaaatggacccagcggttgcactcttgggcatatatcccagagaaataaaaatatattttcacacagcaacttgtacgtgaaggctcatagcagctttatttgcaatagccaagaaccagaaactacctaaaagtccattgaatgctacccagcaataaaaggaatgaacggttaatacatacaacttggatggatctcagggaatttatgctgagtggaaaaaaagccaatttcaaaaggatagatacttcacattccacgtatgtaacctttgtgaaatagcataactatagagacggagaacagatcagtggttacctgtggttagggttggggttgaggggtggctatacagggctggcatgaaagacgtttgtggtgatggtgtggttaaatactttgattgtggtagactgttacgtgtagctacacgtgtgataaaattacatatagctacgtgcacacacatgcacaaatgagtccatgcataactgttgaaatctgaataagctctgtggattgttctaatgtcagtttcctggtttcgacattttactacagttactcatgacactaaccttggcagaggctgggtgaagagtgttcaggacttccctgtacattttgtgacaccttcatgtgaatctataaatatttaaaatttaaagtttttgaaaacatactcatcattctcaaagaagcagctttctatttttgtgtattttcttttagtcttaatctgtctaataaacagcatacctgatgagaatactaacagaatcctccagtgtgccagtgacttcaggcctctagcaggaagtcatgaggtaccgaagagacgttctttcctttttgcttcctgggcattaggaggcccttgctttttctgtctgcacgaccacacctcactttggt

SEQ ID NO: 95501 - DNA, 1104 bp, Homo sapiens
ggacttctttaatataaggatgtgacatgctctgtggagcttttagtacaacttactgggtcaaaaataaactaaaatgaggtaatcaagaacattacatctagacaaaaagcgttcaagaggataggagtggaaatttctcttcttccaggagttgtaaatggatgcctttgttttttttaaaatcccttccattgaacctccaaagtagtgttgccagataaaatataagacgcccagttaaatttgaatttcagataaacagtaattttttacaatatgtatgtcccatgcaatacttgaaaataatttgtagtgtaaatgtgtctcatgcaatatttgggacatacttatgctaaaaatttgtttgttgtttacctgaaattcaaatttaactaggcatcctgtattttcatttgctaattctaacaaccctaccaaacatcatagagactgtagtccagtccaccaaccggactttaaattcttaattcaattcagagaataatacaagataggtgaagaagggagagaaacagaagggggtaaagggagaaagtaccagaaggagaaagaaaataagaatgaattctggcaatctgccaaccaaaataactaaattttgcaagaaagaaatcctaaaactgaggtcataggatggaaaaagtctgcttcacagactctttagcctgaagattggccaaaaaaagaaaaaaaaaaaaaaggcaggcatcctattaacatctaaataccaaagctcttccaggaatggaaagatttggaatgtgaagattcttagctttggaactttgttaaaataccacaacttgtttattaattgcaagggggatttttttttcagcgagatactttggtaattcaatatcaaagaaggctacctaacttcagtttatgttactaagacgcgtttgaaacttcgtggataaccttttgtttgtttgcctcgtgctgaaatgcaaaaaaattatctgatacttgatacgaagaggaatttacctctgtttaaaaatcacacatttctcccatgaagcatgaagatggcttttttaatttaaaaatattaactgacagcttcaagattga

SEQ ID NO: 95502 - DNA, 1027 bp, Homo sapiens
tataaatgtattaaaatcatagaaataattcttaggttttggaaattcttacagacctgaatgctttaagtaaccatattttctttactattccttcatgtagttagtagaatttgttagatggaaaaatcacacggaaatacttagctataattaaagcaaaattagcaagcaagtttgcattgaaatgtggatgttcagttcaattcaacaagtttatatagagcacttactatgtaagatgttccagtctccacaaagataagtaaatatccctctcagaggaaatttatattacttctttaggcgattatgtttagtaaatccaaatgctcttgaaagggattattagaattcctatttggggattatgcctagtaaaactgaatgctcttaaaagagattattaggattcctaagtattgcttttatttcacattggagaaagagcattcaaagagagataaatggttgggtgtagattgaagtacatattcataaaactataacacaaaacagaatgtaagagaaaaagaaataagtgctttggaggagcatgagcagagaactatcctattatattggcatagaagggaaatctgcaaaagcctcaagacacaaatgatgtttgagatgagccttaatggataaaaagagactcagagacatatgaggaagggtattcacacactaaggggatggtgtaagtaaaagcagaggctagtttttcttgtaggtagagtatttgtagagcaataaaaaggcatgaagctgaagactgggaccttattgtagaaggtcttgagtactagggtgaggattctgagggtaaattcaatagattggaaaacaaatactggactgggagtaaagagttatctggccaaacctagaaactgagtgaccttggactaatcagttaatctttttgagctttaacttccttgctgtactatggagatggcaattgttgcgttaaagattgggcataagtgacaaaatgcatggggaagtattttgaaaacta

SEQ ID NO: 95503 - DNA, 1034 bp, Homo sapiens
aaaacttaaaaaagtagaaaaatgttctgtgctcatggataggaagacttaatattgttaagatagattggcagaccgatgacatagatcacattgatattcacatgaaagagcatctagagatgggagtggggagagacaggctaccaagcattgtcccagccagttatggtgggagttgggtggcatcctgctggtgtgcttatgcatgaatacatctattgctttctatgcgtgctgttaatcccctctgtttctgcctgtctgaggcaccttgtgtcatcccttccttgtatcaattgtacattacttcatgttttgaacaaatatttttgagcttcacctagtgccaggtactgtgtaaactgctggggaaagccacagacctgaaggagataagagatgagaaggagaaggaggaggagaccagaggaaggaggaggagaagggtgttccgggcagacagagctccaggcaggatccagaagggatgcgatgtgcaggggtcactctggcttcagtgcttcagagactgctctgccttctggctctcaggcctggaacaaaccaactgaaacctgtctttattgcacagtcagacctggaggagcccagccatatggacatgcacattgcccatttgaactgatagtgctggaactaatttttgcattttgttttttttttttttttttttttttgcttttgctttttttaagtaccccagggtctgcttcagtaatgctgtgcaaactgagcctgcgctcccagggccagggtgtacaggacacagcctgtggcgcatctgctctgtgggaccaccgggagctggtagaaggcagccaacttgtctgtgtgcatgaagacatggcctacaggtagcttgcctggccaagaccagcacttcagagcattttcatagaggcagaaagcaaaggaaccaggtagaaagcctgccagatgttggaggcgaagagctagcaatccttacctgagatatttgaaagagttatgaatgaagagccttgtacata

SEQ ID NO: 95504 - DNA, 1059 bp, Homo sapiens
ttattcatcgagcaaatgtgtttggtgcctctactgtgtgccagcattgtcttctagaccccaaaacgagccagcaaacgttttctggaaaggaccaaatggtcaacattttaggctttgagggccatccagtctctgatgtgacaactcaattatgcttctgtagcacagaagcacccatggataacagcagtgagtgaagtggtgtggctgtgttccagtaaaacatcgtttaaaataatgtggcaggccagtttggcctggcagccattgttttgctgacccagccctaagatatagcaatgaacaaacagagaaggtttcctattctcatgatgtttacatgttagcaaggggagataataaacagataaaccaataaatatataaatggtaggcagtgataagtgctaagaagaaaaataaggcaaggtgagggaatagagaatgactgggctggtgttatttaagatagggcagacggggaagccctctctgctgaagtcgtggttgagcagagatctatcaagtaagggagggagtggcattgctgacatggagaagggtggacaggccaagggaacagtaggtgcaaaggtcctgaggcaggaacctgtttggtttgtttggagaaaatcattgtaactaaagtagagtaagtaaggggagaatgatgagtactgagtcatggagggaaccagggccagatccaagaaccttgggtttcattctccataagataagaagccactggaagtttttcagcagaagactgacatgatctgttttgtgttttaaatgatccctctggctgctatagggagaagaggcttgtcagggaacaagggtggaagcaagagacctcaggaaaagtcaaatgagagatgacagtgttgtatactaaggtgggcagccttggaggtcgcaggtgactagatccaggatacattttgagggttgggctatcaggattcagtaatatatggcatgctcagggtgaaagaaagagagaagtcaagatgagtccagggtttggatctgaacaaatggaagaatgaa

SEQ ID NO: 95505 - DNA, 1005 bp, Homo sapiens
ccctagcctcaggttattttttcatgtacttgtgccactcagaactctgctgaatactcaaggaagacctgcagatattcaagattctctctgtacagcaatctccgctcttgtgtcctgagcagcaaactcaagtcaacttgttctccccagactctcagctcagtgtgttcactgggctttctcatggtttcccctccctgtgctatagcccagaagttcttagtgcagtaagctggggcagtcatacagcttgcctcatcagtttttcatttcctgggaattaagttgttggttgcttgatgtccagtgcttgaaaacctttgcttcatgcatttgttccaaataagaaactttttgagttaaaatctattttcttataaagcaaaacaaatttatgacacaatgtaataaattgaagagttttgtattaagtaatgtatttgttagcacagtgtattcatatgtcagttgcagtgggtgctacagtgggatactaaatatagtttagtgggaagattgcaggtggtttgccaacttgagcctcaccagactttggaaggtttgtttagatcataaaataccaaaaaccttcatactgagatctttacattaaaattctggttttctgaataggttttgattgcaggtgagagtttaagaggaataaatgggtgattaggtgttaagaggcctttgggcttctttagctctgaaggctgctgttaaataagaatatagatactaaacaatcttctaaattgcccctgttcctcatcctttatccaatttttcacaaatattgtttctggattaatttttctaaaacagatttcttgatttttctctcactttctcaaaaacctagtctagaagaggaggcaacatgcaaataaattaatagaatagcatgaggtgcaagccaaatcaggtgcaaagcaccgtgtagacctagaggaagttaatgtttcaaccacctggagggcagaagaggagtttactaga

SEQ ID NO: 95506 - DNA, 1056 bp, Homo sapiens
aatgagcacatttctggccttggattctctattgaaacaatgcagctttatggagactaaaataatgctcattggcttacatgactgaaatattttaatgaaagttctcaacttctctcattgtctgtgttcaggtacgtagctaccactgtccacacaaggccaaggccatcgtacagctgcattcttttattcatacaaagaaaatatgcagacataaagcgtgtgacttattttaactgtgtgcatgaagtgcccacattgccacgttgttctgcgtccaaatggtgactcaacctgtagaaattctttctgtcctttcgttcccttgtctcttgctttgcaagcatggatcagggataagactgaattaatggagggagaatctggtgcctcagctctgcaaggggcatactttatgcactttattgagtttctgaacaacctcacatctgttttcctttcatgaaataggagcaggatctcttcttttggcaacatatgtcaatatgacacatactgtaaaggtgtttgcagtacggggaggataaagagcaccagaccagaaacccacatgcctcggtttgaatatgctgttttctgtccttaagggaaaaaaaaaccaaaaaacctctgtgcctcagtttactcatctgtgattcagagataataatagtttccttacttgtcttgcaaagtagctgagaggttctaaccaaaaggatgaatgtcaaagtgctttgcaaactacagggttggttttggttgttaatattttacatacttatcaccttcctgagagcataaagttctgaaggcaatagatgatcttacataaggtcctgagttgtacccatagaatgaatgacctttcattgctctcaatagataaataattacagccagacacacatgtggtaggcagaaaagcacgtccctcccatgtcctaatccgcagaccatgtgaatatgttaggtaacatggcaagagggaattaaagttgctaatcatccaccttgagttggggaggttatcctggattatctggatgggta

SEQ ID NO: 95507 - DNA, 1028 bp, Homo sapiens
gattgacattcatttaccatggatgaaggattgtcggtttcaacgttgtatttttcattgatgtacagttttaatttgattagaatgagattccctacatttctgtcgggaaatgattttgtagcacccacctaatagtctcaataagtactttaatgatttgagtatctcttatctgaaatgcttgggagtgtaagtgttttagattttggattttggaatatttgcattataccagttgaacatcccaaatctaaaatcctaaatgctacaataaacatttcctttgagcatcatgttggtgctcaaaaactttcagattttggagtatttcagattttggattttgaaatttggaatttggtatgctcaacctgtattgggtatattacttttaaattatattcagtcccttgagttattgctataaaaagccagttatttccagggtccagaaacgagtcagagatggaattctgcatatgtcttcataagaaggcaaaggcatctaaaattataaactttgtttttttacttctgataagaagtcacttctgagtgaatttagagtttataatgacactgtgattacttgaaaatgaaggattggtcatgcatattcaatgtagtaaatacagtaataagttttctaactcattttcttctccgacaatggaagctgcaacatgtgcttgacccaggctagttgtttagctcagagattaaagattgcacacaacttggtaaagtgctgataaaacagcaacaggctgggcaccgtggcatgcacctgtagtcccagctactcgggaggcttaggtggaaagattgcttgaacctaggagttcaaagccagcctgagcaacatagtaagactccatctctaaaaacaaaacaaaataaaaactcagcaatatttcaactcagagctaaaggcagtaatctggaaggagcagtaatccccctcttagaacaggaaaaaaagccaaagaaacagaaaactcctttgggagatctgaaatagcatg

SEQ ID NO: 95508 - DNA, 1080 bp, Homo sapiens
tatttctgcaggagtgtttaagagtgtacatgggatacacaatttctaaatgcttgagggtcttttgagtgcttgaagataaacaaaggcattgtgatttgaaagtagtagtattttagaatgcaagttccacctgaaatgtgtgtgataaagagttaaactattttcaaaaatgaggacttgtgcagcccatctctgcaatgaaataccatttcccactgatttgatcacactctttttccttaagccctgcttctccccatattctgtgcttggcatggtaattagggacttccaccatcagggatgggatgctcctggctattccccgagctacacttacccacagcatagttctgtacatttcttggcagtgtgcggcatgtacatttaaatggtaggatttagggaaatcacatgctagacagtgctgtagaagaggagaatcagctggggttgctagctcttaattgaagtttagttggaggttcaatgaggtgagactgttatgacagatttcaaaatgtaatgataggaaaatgaggtgggttcctcaaagttggagtaaatacggagcaacagctcagcaactcagcatgaaacaacagctacaaaccgtcaaaaaatacagagtaattaaaatgtgcattgtgcagccttccttctcagtgggtacctttccaaggaaagcaataactttattgtgaaaaatataaacacgaatttggagatgtaaattacatgcatattttaatcttgttgataaacatggaaagttttcaaaatgtaaatataatcaaagtaagcacacaactgcagctgaaaccagatttgagaaagacctcaagaaggtaaacgtaccccagatcccccaaccccaaccctacctatctacctacgctttctgtaatttggaaaagataaggtggaattccatcctcctacttctaaggacacaaacccttaccccttattttttaatgtcacagaaggggtagtagatttgactttttctctctacttcccctctcctctcttccccctttggtctacacgtgtagtgttggagattagctagtg

SEQ ID NO: 95509 - DNA, 1034 bp, Homo sapiens
caccacgcccgaccgccagtgcttgattttttatcccgccttgaagccaggacttagagccatgacccagcgtgacccagactcttccagtctgattcagcctcaccagactttcttgtggaggctggtgacacaaagacctggagaatgattggaatcccttccagtgaggagggtgatgatggtggcagtttcttctggtttccaggctgctgttttcctgtagcaccatccagcgtcccttgacagtgatgtgagctcatggttcgctgcagaggcgtcgtcccagaccagctctgcagtgcatggctgggctttttttctgatgatgaggtcttcaagcctatttttgcaggtctcctggagagtctatgggaaacccagtattctctttaaaatgccattcatttcaatttaaatttgccaatgttggctttggctgctttctactgaacaccatgtggagttggttagcatctctcttgaaatgtggaagaactgaaaaagagaggtacatagtgtaactcacagatgattgtaaacctctctgaggtggggagcttaagatgcatgcattccatttccaaccagtctaagactgaaatttcaacttttgccttactctcttcagcaaccatgtgtgaattgtgtccagaaggtagccctgtttatttctggaaagcttgagtattgcgaaagttttccttaactgccaatcgggctgcctagcacaatggctgacacatcgtaggagcttaacatatttgttgaatgaatgattgaactgtagtgtccatcattgcttctcattttatccataataggcttatagaataacttcaatctcttgtccacatcataaccctttaaaatgtaagcctttatgtccttgagttctcacacccccggaataaatgctgtcagtgacttcctgtattcctcttctttgaacaccttcctaatggatgacatctggagcctttggtctgtaaacagggttgtctccttctttgttttacattattaatcaaatt

SEQ ID NO: 95510 - DNA, 1148 bp, Homo sapiens
aggcaaccttcctctttccgcttcttgttttctcctactgcttaccacaaatttgcattttattggatgtctattttttttcaacataggacttaactgttaggtgtttctgcaacatttaatgattactaatcaaggtaagctgactgatagtatcatgtctgtggaactggggagcagtgttgagggtgtgatgtaataatagagtgatttgatttgatgtgttcatccaacatgcatttttttagtgccttcagtacttcttactactctctctccagcacctagaatagcatctggcccacagtgggacttagtaatacttattgcatgaatgaatagtgcacgtttttgtgaattactttgttttggaatggaaaaaaattaacacctagagtctagatagtgtctagtctctatttagcaaccttcatactagtaacaaacaagcagtatatatttttctaaacaaagtagtatattatgctcataaaatagttttatgttttcatttaatcttttcattgcattccaaaaataatcatcctggcttcatgtgttttgtgaacatggtctgaacttctgactatagaatgatggtctttaataaagtgccagtgacagtctcgtcataaaggaggttccctgtctatgctgccatcagttgtaatggctttcaccacccatgggcctcacagcctctttcttcatgcttctaatcactttcagtctcatttctcatagtggtgattccaattgttagcattttcccaagtccccatcacagcaggtggtagacatctgtacctgaaggccccctggcatcccaaatgcatgccccaaactgagctcatcatcttcctcctgcccttcataccgattacatctccccctcaatcccacttctcagtggcttcactgtttgacgagtcattcatccaacccagaaactgagagggcatcttcagcatttccatgctggctaccatgtccagctgattcccatgattgtccttaaggaatgtttcccaagaatggtgggagacaggaatttcccaagaatctgtgtattcctcactgtcctggaaatgttgttaggttagaccttcttatcttcctctctccctcagcgttagtagcctccaccc

SEQ ID NO: 95511 - DNA, 1071 bp, Homo sapiens
tccaaatgaaattgaagggtcactccaaagattaatgactctgagatgttaattcagaagagaatttattcttaaaggctaagatttattctgggccagagattctgagttcagctgggagactaatgaagcgtgtattttattttttagcgtttttaatggtgctgtcagtcatatagcatggggcttattcgcaagaattttaggtctggttaaaagtctctacattcagactgtgagaaccttctttaatgggaatttttttcagaaaacctttagggggtagcttatttcttttatacttgaaaggttttatacatgagagttctgtgtttttatgaagatatcgtattggtgtgaattcatattaattattaacatattgcaaaggttaaaatgcacatatttcacagcaaggcaccatcccttccctgggttgcatgttgtttttcctgcctggggtcaaatataaaacaatttattgatatcctagccagttctcttcctaaactgtggatgaagcttcaattccactttaaaatacatctatcattgttcaacacttcttcagagttaaatatctgtgcagaataataccttgttttcctttgttagaagtaacgttcacttcatcacttaaactgcaccgggccctatcaacacaggacattggcttcttcctcactaattagtgttgttcttacatcataaaccaattgatgtgcccgtcaaaatgtgcattactgggaaattgctagggccatgccttgggcccagactacagtttctttatgtgggcaactgtcatgacgacagccttgagccttgcattgagttcagttctgtcacattaaaaagaaaattctccattaaaaataactgagtaagtaaactggaacaggatggccagtggattatgcaggctttaccatgagctcctgtctgtcatgatatgctctttcatcagccagaccttccaagagagatgccccttctctagaggtgagcctgcattgggcactgctgtgagggatgagtgcttcccaaatgcagcagtcctcatgaaccagg

SEQ ID NO: 95512 - DNA, 1030 bp, Homo sapiens
tctgtagctgagcaagtgacctttgtttcagaaaactgtagtttaaacttgccaagattaggagagttggaagaacttgtgtatatttgtgaatgtggcgtgaaagtaggaagaggtattttttcagaagtaggcatttttgttttcttatctattcagtattttgcattccatttgtgttgccaaaatccagacatgtcaaatccacaggtacttattaagacaatctgtgtgcccagccctgtgacaatggctgtagcagaaatacggcatttgcagtggtcttggtttagaaggtgagattagcataagcagaggtttgagggaagagtgggagcaaggagtggaggacaggaaacaggaaggagactgggctgctggtggggaggaggcaggacaggccctgtgagggcagggcaaagtgggagtcagcgttggccaaagcgagagagccccaggcagtggagcctttgatgtcaggcctgaaggcagtggggactgtcttagaattttatgctgagatgaaaatgtatgactgaaaaattggtctggtggcaggaggtgatcagagtgggtggccgcaagaggcttcctggggaatgggcttcctcagtatccgggtgcagcaggtgggccagaggcgacccatggcagcccccagtgtcaacgtgagcaagtgcaggactgtggacaagactgtgatgccatgcccggggcagagaagatgatggaaaaggagaagttgccccagatccagtggctcacagaagcactcttcctgaggaagagcttgttcttgaagtttgcacccacagcttctcctaggcgatgggcttggagagctgtggtcagcatcaagagctagcctggcagcagggcaaggatgtggctgcgagatggcatcgtggtacccactctctctcggtgcctcagtgtccttgtggaggatctggcctctatgacttgagtgatggtaaagtgagatgatcccatatggcgtttgacgttgtgctgcacacggggtgggtgc

SEQ ID NO: 95513 - DNA, 1018 bp, Homo sapiens
ttggcttgttttcatttgacatatccccatcattcctcattatttctttttccagtatagcaagatgttctagaatcatttcatcattctacaaccccaacctagaatcagccagttttcaagagagccctggttcctttgattgcggacatggtatttagaaaccaagatccggataccacatgtgctcattactacttaagtgttgtgtgttctaggcccgttcattggacagagctagactgtgtatgtatttcatgtgcatatatacatatacatacgtatatctgtccacatctacttcagtattgatcatctattatctgtctaccaatctatctaatagaaactagggttcatattgacatctccaattccagtccagtttcacaggtttattctagtgttcccgcttctgcatttataactcccttctctgactataagaaaacttgttcccactatccacagtatacttacttatttgatcaatatcagaatacacaaaaaagtggattcaaaattgctaacattgtgaaaatcaaggctgctatctagaattcaatatttgtttaaaataattctttatataaagtttcctgttgtatgtaggtacagtaggggctatagctgaataagacactgtctttgtcattaaattacttccttctcttctttcttttcccctctgaactgaaggggtgaaattgaattggttttgtcacagtggttatcagaacacagtaaagggcttgtgagtctaggctctgatggagtgtggggttagtggggaacagtgtgttggggcgcagatggaggtttttcctttctcttgtctattttggtcctacttagtgtgtgtctctgtaaagaggacagcccttcacatgcatctctgaaatctctttaaggacatttctgggttagctattgccgtgtaacaaagtactgcaaaattaagtgacttaaagtagccataacaatttattttgctcatggatatgcaattttggcaggg

SEQ ID NO: 95514 - DNA, 1051 bp, Homo sapiens
taaaaaatattgtaggtaagttgaacttaatatcagttttctaaaaatgaacagaattcacctattcaacataaaataatctgaacagtcatggcttctctgctcttaatggcagctgcctggaggattgggttagttcatagaaggagccatcccgtattcgacaacccattctagaactggcaaactaacacctccagaaatatatagacaagagggcataaaacagatttcacataattaaattcatctgaaatgtgaaaattatatatctagttttaattgatgtgttcaaccgtgggcattgatgtgggaaatatggtaattacacttaagagataaacattaatagttttatgctcatggatcatccataaaagaagaattaggtgccccaaatgtttttcatccatgtcttttatgagggaaaacgttgcagtggagggagatgattctgtactactaccggggggaattaatgattattgtctatattcataaaaatgagacagtaacctaagatgtaccataaagcagtaaaaataatgattagaattggtattaactcctgctttttaaaggaggatagccaggcatttcattcccctgatgaaaatcaacttttctgtggggagatgggggaatatagtggttttgtgcaaaaatggttttgaatgacaaagactcaaagatacccaagtttggtcttcatgcaaaagtttttctactgaattttgttggtgctattcatttgtataacaacctttgaaaatgagattaaaacctatgaaaggtttgcatttggagaggctgcttctactgggttttggtttcaagtaattactagtactcactattcatacttcacttaattaccacttttgtgaggtagcctttaggttagcactgactgtaacagtcattgaatacctatttgcgttaggtctgtctcacctcataaatatttgttgtcagaatgaatgaataaaggaatgcaaagttgttaatgaattaaaggttagagcaattagtattacaaacactgtcggga

SEQ ID NO: 95515 - DNA, 1063 bp, Homo sapiens
gaatactttttcatgtgcttattggccatgtgctatcttcatttgtgaagggtttcttcaaatcttttgcctatcttttatagtgttgttgctaatttttattattgagtaccagagtggtttttatattctggatccaagtcatttgtcagatatatgtattgcaaatattttctctcatttcgtggcttacttgtttattcttttgatggtactctttgatgaacagatatttttaattgtgatgaagtccaatttttctttcacatttattcctttctgtgttacaagaagtgtctctttcattctaataactctttttaaagctttttattttgaaataatttcaaaattataggaagttgcaaagatagtacattgagtgcctacgtacacttccttcagctacgcttgatgttaacattttacatgaccatggtacagttattaaaaccaagaaatgaacattacagtagattaagtaaactacagactttgtttggatttcaacaattttccccataatgtcctgtttcattccaggatccaatctgggatactacattgcatttggttgtgataactcctcagtttcctccaatctgttgtagttcctcagtcttcccttgtcttttatagccttgacacttttgaagactactctaagaattttgtagaataaccatcaatatgtgtttatctgaaattcttttcatgatgagactgcaattgtgagttatagaaagaatgaatgttacagagttggcattctcattgtttctgataacaatttttagctttgatgtttaggtctgtgactgtttcaagttgtatttttatgtgttttcttttgagaaaactttgctgagattttgacttggatggtattgaatctttagatcaatttgggaagaattgacatctgagcactgttgagtcttccaattcatgcatgcatggtatatccctccatttatgtattcactcagtaatgttttagagtttttagtataaaaagctggcttgttttttgttaaatttatccccaagtatgtatttgatg

SEQ ID NO: 95516 - DNA, 1035 bp, Homo sapiens
tccagcctgggtgacagagtgagaccctgcctcaaaaaaaaaaaaaaaattaataaatcatttttggtgtgtatggacacaggaaaattaagttgattaagtagcattttgggttctatatgtcattttaataattcctaaatctgcagcatagcacgtgatagattgacctcatgatgtcggtttttccagatcgatgttgaattcattgcagtaagcaaaggtaaaatgaagtttgagtttataagtaatgtgacagactggagaatggtgctggtaattagaagcaggatttccactccttaaccctcctcctcatgacagccctcttccctactccagacttaaatgaaaagattgagaatacaactattatttggtgaccactaactgcatacaaggtgctatgctaagcaccatggaaagaattctgagaggactagagaggaacttagagcctactacatatatttcagacatgaattgtaagtaggagctataataaagatgctaatcgtaatatgggtagcagggttcatttctttgggaactctaggaaaacagctcaaaggagctgatggacaagtggaaccttgaaggatatttaagatttgtgttggatgaagggagaggatatacattgttgtctttgtgtgtatgttttttatttgttttccaaaataatttaaccccccacaacagggatcatatcttttgggaaattttccgaatcccccagtccagtgtggaacaccgaagtttgttcagtgagacttggaaaggacagggcaggtgagctcaggggaggaatgttacaataaacatgggaatagcttaagttggagaaatgtctgatgcctctttgagggtcatatctagcaggccgattcataggaaggttcactcccagtagactgcattaagtcatctgctcagattctctcttgtccattctatactcagaaagcagagatattccttaaagtgagattttcctatcttttataggtaggtattgatttttttctttacctt

SEQ ID NO: 95517 - DNA, 1062 bp, Homo sapiens
atgtttgctaaatgatgattgcatttaactgtgagcagctttttcagatattaatcaaaatgcctgcaaagactacacagttgcaagggacatcagcttatatcccaacattattggttcctgatccatagttgtgagaccttggttgattccctgatagtacagcaactccctgggaatggaagttcaacttgttggctttagaacaacataagcagtttcattgaacattcactgaatgtctcctctgtgctgagcccatgtcagggactgggtctttaatcatgttcttgtatgcagcatccctgcactctacctgcacatgacttctgaacagcatgctctgcccagacagcctcagtgagggccaggacttgaaccctgtggaagcatgtaaagacatatttccgtggtggcagaaggctgagagttcagcatactgtctgtcttcacttttgagttgttctttcatctgcctaagactcatggcagagcactcatttcacaaactttcactgagtgccgactatgtgccaggcactgtgccatgtgctgaaagtacaaagactttaatatgtagtccttgacctcaaagagctcaagagtaattgacagaaattcctagatcatgatctgtgatgatgagaatcattccttagaagggcttgcatataaacatatttatatacttattttgtaggaaaatatccttagtaagcttgaaaaaataaggattgatcatccatgtcaagcctgacataaattttaataaatcagtgtgagcaaaaggaaaaaaaatgtacaataataataaaataaaaccgtagtcatttatacttcatgctgtagttctaaaataaaaattctcctttggggctggtgtggtagctcacacctgtaatcccagcactttgggagtctgaggcaggaggattgcttgagcccaggagttcgagaccatcctaggcaacatagtaagaccctgtctctacaaaaaaatgtaaaaaattagctgaacatgatgtcgcgcacctgtggtcctagctattcaggtggctgagg

SEQ ID NO: 95518 - DNA, 1088 bp, Homo sapiens
gcctcagcctcccgagtagctgggattacaggcatgtgccaccatgcttggctaattttgtatttttagtagagacggggtttctccatgttggtcaggctggtctcaaactcccaacttcaccttgctgagtttttactttcatttacgcatgccatttcttaaataattgtccaaaatgtattaaactgatgtcaattattctttttttacttctttaaaagttgactttaatctacagtatttccttctagacctgaaagtgtggctcctgtggtgtttctgtgatgtgtgagtcgcacactgctgtgtagtgtttgtgcggtcagagttgttatcatcaaaggctgctgccacttcaagagagtgggtctgagctcaccctggactaatttgacaggtcccttagagttgagattataaaattcttcattcaagtgaactgaggttggggtggtctcaagacacagccatggtgttaccttacccagcacatggccaagaccggcctccggaggctgcatcttgttttctggttcctttctgtgtttcctgttgacaaatgagcacaactggccttatttactgaagtgatacgataaaaagaggaacctaacttagtttacacagatacagttactgaacttttgaaggagtctttcatccatggcagctttcaagctccatctgacactggaaaacaaagtttacgagaacaacaacttgttctagttatagaaatgtaattaggtgagtatgtgctgtgaagatgacctggaaatatcagctttcccttgtagttgtctgtgaggacaaagagcttgtattcaaggaacaagttcaagcttccttgaacttgtattcaaggaagaatccctggcttaatgttttatatattttaaaaacttacataatgccatttacctgctgcgttgagattttcatgaagttatttagtcttaaactttaatttcccttcccatattagtacatctgccccacaatagctatgtagactctgaagcatgaaacagcctctgtataagtctgttttcacgctgctgataaaagacatacctgagaccggg

SEQ ID NO: 95519 - DNA, 1028 bp, Homo sapiens
ctgtttttgctattgcttttaatggcaacgctgcagttacttttgcaccagcctaattctttggctttcctgcagagaaagcagctcacttttcttgacatctccagggagtggcttgagctcaataactgttccatgaatggatgactgttaagtcctgacccatcccacctggggcataaactaaccaaagtaatgagatgggaagggggtccttacatttatttcatcattttgctaatttttgtcacaaatccaactgattctagagtcatgataatccatggttatttaatgtcttaaacctatgaaccgtctacaagattacagagttgaaaaaagcaaagactgggtctgtaaatttcaattctgaaccttaagctggtggttctcggaacttcagtatgtaagtgcttagacaagttactgagttgctcccggatgtgctgtgagagccattgtaagtgtgactttaaaaaaatatgtacatctctcagatctcattagagcctcatagaaatggaacatgtccttgaaaaccatgaattggaaaatgcatacattttgagcttgtgtttggggactagctctctgggtcccagtggtaaacttagcccattaatggctgatgctttaaagaaatataaaagcccctaggctagtctcttcttccctccccccatctgcatagcaggtaccaatcttcatcaaagcttttgaacccaagtctcagattgcctttgatcagaagcctggtttgtcccccagtgcagaaatgtaggaactgtgtgagagaaagagaaagagggagagaaggagggaagaaagaggagagagagaaaaagaaagggaggaggagcaggagagagaagcctgtctcgcctactatagaattttcttctctcctctcaaaacaagttccttacacatttggctgaccgcatggtacacgtggctggtgtcagggttctgtctgaactctgtgattgaggagaccaacctgcaggagccactttgaagatgcttac

SEQ ID NO: 95520 - DNA, 1048 bp, Homo sapiens
tgattagggtaaaacccatcatcaaagcaggccaggtgctgatactcagcacacgaagctgtcaggaagtgatccttcagatttcctggggattcctgcccacatagccccaccaggctgtaacagctcctgtgcctcagatgggggattagctgagactgtgtggctagtgattgctaatctttccgtaccagccaactgagatcctctaattcatacccagctcgtaaatacccaaatctgtttccccaaaggctgtagttcctgagggttagattagccagttagtatgggtgatcttcctcttctgattttagaatacaaataatggagatttttttaaagatttatgtttgaatttatattcttacttcctacctcctcctgcttttattcagtgattcatcatgaaactcccttaactgaggacgagtaaccgggttacttactgggaagaccttttatttgaagttgtattgtttcacgtagacggtctcagttccttcctccatgtcgctggggactctgatgtcttactctcctagctcctttaagtggaatggaaaaaactgaagtgtattcaaattgtgaggggatgcccaggtgatgctcaacaaccacagcttctcttgagggcagaccctgccaaaatagaaaagtggcactagagtattcaggtagataatagctctttgatatggtctatttatggggtcctagaaacactgatggtggagccaaggtctcaggaagttgtcagtcatcatatggaatgtaagattgtcacagtccatcattgggatggcccaccatctctgcacactttggaatgtttcagtccccttcttcctaaattgtacatgctactgtagtgagaatgtgtcttctcagtaaggttcatggtactttgttcttagtacttccttatttcagagaagatccttaaagaaaatacctgctcccctctcccttaaaagagttataaagtgcttatgaaatatttgtagaatggctgaatgagaataatgactataggtaaattgtttgg

SEQ ID NO: 95521 - DNA, 1088 bp, Homo sapiens
ttttataaccttttccttaaatccagggattgtgcattctgaatgttccaggacattcttcccaattataaccaccctctcttaacactctcatgtttgaccagttgtcactagacataccatccttaagcaaagtctgttattctattactgtttttacatcttctctgttaaaaatcaaatgcagggccgggcgcggtggcttatgcctgtaatcccagcactttgggaggccgaggcgggcggatcacaaggtcaggagttcgagaccaccctggtcaatatggtaaaaccccgtctctactaaaaatacaaaaattagctgggcgtggtagcaggcgcctgtagtcccagctactcaggaggctgaggcgggagaatcgcttgaacctgggaggcgtaggttgcagtgagctgacatcgctcactccactccagcctgggcaacagagcgagactccgtcttaaaaaagaaaaaaaaatccttcaattcatttaaattctatggcctttatatgtatagctcctccatatcctcctaaatgtctttgtgagtgaccttttcccttctctctcagcctttcagaccaggacatcactggctcttatccaggttgagcatcccaaatctgaaaatccaaaatccagaatgctccaaaattcaactttctgagcactgacgtggcgctcaaaggaacttctcattggaacattttggacttcaaatttatggatttgggatgctcaaccggtattctataatgcaaatattcaaaaaaaaatccaaaatccaaaatgcttccagtcccagcattttcagatggacctgttcctgtccatcaagaaataggtcctaccctgcttctcttttcctgaacataaatcatcatttcagaatgttatattctgggcttttggacccatgaaaaaaccatagctgtcttgggattagacctgagaggctgagagctgtgcttactgaggtgtcctgagttgacactgcttatgaaaagtgccacagttaaatccaccttgggctggtgtctcagctgaggggggaaaaatgcatgacaatacttactgaagga

SEQ ID NO: 95522 - DNA, 1157 bp, Homo sapiens
atggaagttggatttttcatcttgggtgattcatttcaatttgttgcaaatatttaaatgttccttaaatacagtgtcaatctaaactgaaatgagctcttctgtaggagaggagcttaggtgttctttaagagagtaaagagggagactcaccagggcccttttctctcctgcatcagagaacttagttatgtttatgtgattaactgagttaagtgtgaaaacctttgccccatggtgtcatcaggaaggttaaatgttacccaagtttatcttaattaaacatttgtatttattttctaataaaaagcaaatgaccaggtatgcattaagtaacttctcttggcattctgccagtggatttatggaacaaagatgaaacaggatagtccttccagggccacgcagaaaaagttgatcaagcagaaatcttgtttgtgatattgatttctcacacttcctttctttcttagccataaaataataaaataacaaaataacatttgtattagattaataggatatgtcagaccaagagagagagagcaacagtgcttcctttgagtgtcatgttggtactcaaaaactttcaaattttggagcatttcagattttcggatttggaatgctcaagccatataagagcgagtaatgacctggttggaaaggctgagagaggaaaaaggtaattctataggtgtatacagaggggctgcatgtataaaggccatagaatctctctgtctctgacaagtgtatattatatacatggagagccagagaaagacactaagactcatattaaagaattggttcacataattgtggggactggcaagtcacaaatctgcagggatggccagcaggctagacacccagggaagagttgatgttgcagtcttatccaaaggctgtctgatggcagaattccctcttccctgagggcctcagtctttttctcttaaagcctccaactaattggatgaggcccacccacattacacagagtaatctgctttactcaaagcctactgattttgatgtcaatctcatctaaaaaatgccttcacagaaatgactagactagtatttaccaaatgtctgggtactgtgacctagctaggttgacatataaagctaaccattacatcatatca

SEQ ID NO: 95523 - DNA, 1035 bp, Homo sapiens
aatggttaaatctgtccttattttgaggttgtaagataaaatgatttcatggatatgacaatttagtgaaagagaagaaaaatccctctaaattttcattcagtcatatgatcttcattattagtagtagcaatgaattattgtgatcattcatgcaggaaacaaacatgacccaggctctggtatacagaatacagtgactttatatgcctttcaccagagaatgttcagattcaacccatgtatttttattcttcctctcctagaacctctaccacatattcacccacatacttactcttctttaacttatttttcccttattttttgacaggttaaagtaaaatgaaacaaaaaccagaatcccaaccacacagccagaaatacttggctaaggaaaagagtatagaaacaatccatttaagcttactattatgttacatttaatgcttctgcacaattaattatataattatttgtccaaactgagttgatgcagtggcacatgtacgtaagatttagctaaagtcactttgttagtagtgtgttgttgcctgcctcctgtaaatcaaatagctagtgtcagagattggatgttttagaattcctttgttgtggctagggaaaatagaagagtagagtgatttcagtacctggatatcatttcatggttattgtgtgatgatgtgaaaagacattttattccattatttgatatttgaaatatttataagagttatgagtatttagaacattcatataccaaatggaatccacatatttccctaaagtttatcttttcttctgcctttagagcaagagtccccaacccctgggccacggaccgctactggtcagtggcctgttagtaactgggccgcacagcagaaggtgagtagctggcaagtgagcaaagcttcatctgtgtgaagctccccattgctggcattactgcctgagctcacattagcagcagtattagattcttatagaagcatgaatcctattgtgaactgcacatgcgagggatctaga

SEQ ID NO: 95524 - DNA, 1251 bp, Homo sapiens
tcagggcagctcagaaggagccgcacatcatgggggttggcaagtgtggaggctgggtcctgattagcatatcacagtgctctaggagtcctggaacgccttcctcttccatgtgcactgctgctgacatccaggccattttggaacctgcaaatgtctcttccccaaatgcagcaagccccaggctgaatttggaggacccctgtcctagctagtatgtaagcaagcacaaaggataggacaggagagggaggcaaagaagaaagagcagaggacggagagagcaagcttgacttcttaacgaaaggttgtaatgtgaagcaaagcacttgttagaagagaaagtgtttgggggttgtcataaggagagcagcatttagcatattgttgataaagcatagcatctcagcaggatacctctgagttagtccatatggtgctagtcattttctcagtaaacatagaaaataattgtaaatagtaatattaaatgaagtatcagaatgactacggtactttttttttttaacagttaagaatgtgtgacgttatttatgaccagaaagttcagattgagtctaaaaatcacagtagaggctaacccgtattattattatttaaacacaattaaacatttaaagatgagttctgggggagtaattactcagatgttaacactagtgcccatcaaagaaggatttttaaaagatacattttcacatttcgtttattgtaaaatcttgattgtgctactctattaataccatgaataatcttaagtagcaggtaagcaaataaaatacataattgtattttggcttattctgtgtaagtttacaaatctgtttaccttattcaacaacaaaatatttattgatcaacacactctgtgccagttactgttttagacactggaaatgtaacagtaagcaacacacatacaaatccctgtccttggttattctctttaggttactgttaaaatatctgtggtcctttgcttgggtgcagatgtgattggttgatgcagggggaagccataggctatgctgggtgtagagaggaagctaacacggggttaaaatggggaacatattgtgaacatggatttagcaagagcgggctgtgtttacaagcagatagaaaggggagaaacacatgactgatttttggaggaaaaatgccaataatcgcatatatatatatatatatatatatatgctatacactattttttaaaatgtaagttca

SEQ ID NO: 95525 - DNA, 1307 bp, Homo sapiens
gcatgctaaattatttcagggcagtgaaagccatctcaactcctagttgtaccaaagcagaaatgtcaactaaattatctttaatgaaatcattttcttttttaatcatagagtcaaccaaagtggagaaaaaaaagatttgctttaattgcagccacttggaacacccagcctggggttaaacatcctttcatcttgcatgattgtgacagacagagtaggcatccttaactctgtagatgcttatggtttggggataattgcaattgggttagggaagcaaaatgaagaaaatacatggttgagaggaaaatagaatccacttaagggcaaaagtatgttttaaaaatggaaggaaatgaagtcagttgctgaccaagttgagcaagtgggaggcactaaagcatgaggccagaagaacaggatggcaccaagacaaaggtcatgtaggcatagaggagggactagttcattcttactgaggggagctgggaaggggcttctcagctgagtgggccttgagaggaggatgagggaactcgggacagggcaaagatggatgtgtataggtgcatgtttttgtggtcagggaacacagaatgatctactgttgctgagatgttttggggctttgttctttagaacatggtgagacattaaagcagaatggtatgttgcaggctgtgttgaaagtgagacaatcctgtggctgtgtgagggatggattgtgttataaaagacggcagtcagggacaccagctaggaaactgttgcaagagcgtaggcacacacaggtgaccttgggctaaggcagtggcattggttctggaaagaaagtggctgtgtgagagtcatttcagaagtagaatacaaataacttggtaattaattaaatgtggagggtaaggtgggtgaggtgcctgaaatggcttcaagtttctttgctgtttaaggatatggtggtaccgtataagcaagggtgtgcttttttctctggtgaacaaagggctctacttgttgtgtttgccagtttccatggcgtaaatgccctcaccaaagcccatttcagtctgcccccaggacagtgccactgaatgtggaggtgggaagagatggacacagtcagttcacaagctggtttgagccagctccagcatacccctgtgtctggtaggttatagagaaagatgccaatccagttttgaatggttcaaatttaatgcaacagtggaacgtccataggaaagagtcaggcaggcattggaagcctagaactggcactcaggagaaaggatcaggcaagatgt

SEQ ID NO: 95526 - DNA, 1054 bp, Homo sapiens
cttgctgtcatcattagtatttcataagcaggtatatcctttccaagtaaaattgttcagtctagatagttagataattttgatagattgttgggtttactctgctttgtatgataattcaaaatatctaattctaccccaattcattagggttaaaaatgagaggtcagtgattcattgggtctgggtggattccagcttcaagtcaaccgtgtatccctcacttgcccaatggctgtcaagagaaaagacccagtgagctttggtgaaacacaaaatcaagttgaccttggcctaacagtaagttaatatgattaccagggtatgaatgcattccagttcagcaggcttctaggatggcccacataatcctggttatttcaagtggaaaatcttaatattcccttagtgattgagctacaggtttcaggaagtccattattaactaccactgccttgaattgaaacctgatgatgttttcttcctttcaccatgccacggagctgcactgccatacctttcccagaccatcattcactctggtagagtttgtcacacgtgtcacaatttgggaaggcagtgtgcattctccatgggcaccagtgggtgcactgggagaagggactccaacagatctcattaattagccttttatttctgccatggatgacaaatgtcagcttttgcatttgttttatactcaactgttgaactaaatctccacactcagaagagacccttcactgctgcgggaacagtagtgaaaaatcatttccattttccattggtcagagagacaaaaggttgtcagattgggtagagacaggtttgagataaatgccgcagcaccctggtagtaaaggagagagggttatctgtgcatcactgcagcgattactcatgcttttagtggtgtgcctttcatcactgcaattagcttcttgtctgcgagtgtttggatacagagtctgtggttgtcatgcagtcagtgtcagaatcgctcaacactgtgctcacttttgtgcttgagtacacttattgatgagcacacag

SEQ ID NO: 95527 - DNA, 2017 bp, Homo sapiens
aaaagagataaagaatttaaaaaaatttctaaagatggggagctgtttattctccttttcatggaatctgaatagtcctttctcatggtttatgagacttctccttgaatctaaatattctcagcctcagagccatagctgttctgagctttggatcagccttcttaccccttttcttcaagagcccatctcacaggctgcctctcactaagatgagctagttcttaggcactgatttttcccttgggaaaaaaagcagtggagttcagtataaatctttgctgtaaacccacactgtatataacacactgcagggtctttgcacgatacaagaacaacttagtcccggtcctcatcttttgaggatactagggaggcaagcaaatatatctattaatacaatatgccctatttatatacttccagatcttcaacagactattctattgaagagatcattgcgttgatctcttcagttgaagagcccatgtagtcagtccttccaccacctgcctttgatcctgttagttgctgtcttagtttatgtgggctgctgtaacaaaaataccatacactgagtatgtgtgatgtgtaaacaataaacatttatttctctcattctagaggcagagaagtccaagatcaaggtggtggcagattcgttatctggtgagggcctgcccgcatagataacatcttattgctgtatcctcacgtggtgggagggtaaggcagttctctggggtctcttttataagggcaccattctcaactggctctgcccttatgatctagtcaccttccaaaggcccctcttcttgatatcatcaccttgggggttatgatattcaacatgagaattttgtggggacacagatagtgagattatagtggttgttcatctcttccctgccatgccatgcacacacgtggcaccttgggtttgtctggggggagaatgatgttcccgttatcccgatggtgtccagcttttgtatttgtcatgtcagctgctgggcctgtcttagaagttgctaataacttccactttaatattactcttattgatgcattgggtttttttattgaccaataaataatttaggcattggcaatgttaagaccataacataaaccttttctaagtaatttttccatattgagcttattagcatcttttggtatctgctgggtttttagctttacaacaggcactcacatataaacatgtttatcctatttagatttgtagttcctgggagtcagagttctgtgagcagtcttaacttataaagcatgttcagacatgcttttcagatgattttgtttcattttaaaaggggaaatggcattaacctaataggaattctcctcctgaacctcagaggcagcagatggtacagctctctttgaactttactgcccaggtgaacgttctctgcatttagatcttcaggagttttacagactagtgtggagtggacatgtaaggacaagaggaagaggcaggtttcagctgagctcttctcctccttagagcaggacagtgttgggatgggctgattgtgagtatggagttctttctggaggagctccagcaggagctgggcaaatactgggagctttgactaaggggcatgcattgcagatgaggtttgaccagaggttttccaggatccctgaagaactctgcacttctaagcctgtaaggccacaacaggtgagatgaagggggagttgaacttccagctccttgtgtgtcccctagggttccccttttgggtccacacaaaggctcttgagcccaatctgaaggtctaaggctatggatatctcctccatttctaagttgggacaaggttgtccagcaaaaagaaaagcaaagactggtccaatcttagagacgtttgttttggaagcagagctgggctattagctttcctcaagaaggaaaaaggagtgctacaaagttaaatactgatttttaaaaaaaattggcattcacacaatttctact

SEQ ID NO: 95528 - DNA, 1013 bp, Homo sapiens
ttaagtgttctggcaagaatttcaggcagcaagcagttcctgtgaattaactagatccttgtgatggggttggggggttggtggggtgggcagacttggaccatatagaactggaacagatggtattaatacactattttgtctttagatttgtagatttttaatatgcatctttccatttctattccattatttttacgttcttagagctgtagcatgtttttgatcctataggttacccaaacaaagcaaaaacacatttagatgatctttcaggttagttcttaagcaaccttaatacttggtccaggctgccacagaaggggactatatttatttcctctcaatatgtttcctagcatactaaagtaaggacttcgcataaaactggaaatggaagctgagtgaaagtgatctctttcactgttataattttctactcaggactggatttagaagctcatagattcctttcctgtagagaagtcaatgaactgtttcactggaagcaattgatacctacatatcaatcttggatacattgtgtatttcttcactgtccatattatgttcagctctagccacaattgccttaacacttgaagtttcacattttaaattttaatttacactatgttgtgaaattaaaaaataaaagactaaaacaaatgcaaaaacaaagcttattcttacaatctgggggcaaaacccttctatattttgtttcattttatgtaaaagatctttttgtttttttaaaagagcttttttattttattttttgttttatgtaaaatagcttttctttctcatgcttgaaaaccagagttttataaaaacctttttgaagttgctttttttttccaaaatgaatgaaattaaaactaatgttatttacattaatttttctgctctgctggcacttttcggagctctgtagtacaattgcaaaactctaaaccttctgaaaactgcttccctgacagcattatcctctttcttcttttgattaa

SEQ ID NO: 95529 - DNA, 1037 bp, Homo sapiens
aggatggattttgccgcttgaagaggttgtggctaaaagtggtgagtaaacgctatggttgacactgaaaatcagaaaacacagtgcatgtcctacattattattattattattattattattattattattattattattattatttgagatgaagtctcgctctgtcgcccaggctggagtgcagtgtcatgaccccagctcacggcaagctccgcctcctgggttcacaccattctcctgcttcagcatcctgaatagctgggactataggcacccaccaccacgcctgactaatttttttgtatttttagcagagacggggtttcaccatgttagccaggatggtctcggtctcctgacctcgtgatccgcccacctcggcctcccaaagtgctgggattacaggcgtgagccactgcgcctggcccacctttttattttttttcttcttatgaaagtacaatttctatatagaaaagtaatcctaagtatacaacttgaagaatttttacaaactgcacacacctgtataaccatcactcaggtgaagaaatggagtatgaccagacctgaagaagctctcctgtgccccctccttgtgatggccctacccacccaagggtggccactatcctgacttctaatgatacaattacttttgctcatttttgtgctgtatattattggcctttttgcttagcattttgtttgtggggttcatccatgttgttgtgtgaattttaaattgttctttctcatggtagtggggtggttccattaatttatccttacctctcactttttgctgtaattttatcatttcattagttttatttctctgatctaactccacaccaatttacctttaaaaaggtcaaatgcgattccttttactgcatgtgccatgcagccttttaaaacatagataaatgaggcagcaataaatttagcaaattttatgagtaaaagaaatgggtagcacattttcattattcaaaggaggtcatgttcatggcagtccattgcaatttcga

SEQ ID NO: 95530 - DNA, 1659 bp, Homo sapiens
cttgccattaatctcttccaaacttagttcaacctccatatcattaccagacatagactgccaaataaatatttttctgtagtaaggaaaaggaaaaaataaatcagatcatgttacattcatgctccaatagctccttttgtcctctctttcctagggcagtgttcagtgtcccccatgtgttctacagaacccagtgccgagggatgtcaggagttctgcaaaaatggtgtccaagttaaactgatttctttcctgccacgcttatcagccccctcgagaccaaatatatgttactaatctctgaaaggagattgtaggaggcagcatttcccaaatgtacttggccacaaaatggttttttgtttttgcttttgcaaagcaacccatagaattagtattctgggaaacttatgctagaaaacactaacctagaagagaaaaagctggagttgtgggtccggcatacaggaccctttacatcacctcacccctccagctttaacctcaggatgctgtgccaggtacactatactttagctactcagagcttgactgttgtccccctaacatgctgtgcactttgcaggcctccatgcttttagcgtgaatttctccataccagaaatatgcatctactcaccctgcctgatgaagtcaagctggcactaaatcttctttatcattgcctccaagaaggcttttctactcctcatggaatgagttgctttctatgttccttcatagcacttctccccctgccttcactccctggcttctctgttgtctaccatctatctatcatccttcatccctttgttccttctttccttcctcccatccattcatccatccatcatattatattttcagtcggctcacatagctgcctcttttattgttctgcgtgctcctggagggctggcatgctctcttattcatctttatatccttggcactgagtacagtgcttaacatgcaggtgcttcataaattaatgttgaattaaataaaaaagctttaaaaatcacagagcagttctttttcataacaggttcatagtgttttataagcaagcattatctgaggctggagattgagaaaataatacactttatttcttacattctgtcagagttctgcctggacattaacttcttaaacagcatagaatacatttttaaaacatgggcattggaagagtaggctcacaggtgaaccttcctttggggtagcagatgataggtaggagagtgtacacactgtaagaatgaatgggaatcttaaatcttataatttcattaaggatgcagacctagttttttcaaattgtggctacagaaaaagtgcttgaaaacaaatgcccccagccaggcataaggggaagtccaggtagcattgcttatttcagctaaagttgagaataaatacaattaaatgagctgtggcactgcccttggcccccagctagatctcagactggcattacaggagggtctgtggatggatctaaactaacgttagcttaatgcaccagcccagagtatagggtctgatttctgcagtcattgcagttgagagctgaacactcatctgtggagtgcttcattgtgctaggtacacatcgtctatgactttcgcttataaatgaggacccca

SEQ ID NO: 95531 - DNA, 1098 bp, Homo sapiens
ctctttcttcctcagctcaaaaaaattgacaagctcccaatccttgcaggatgtagaacaaacaatttatggacaaacgtcagttatttaaagatattttaatttcataatataaaaaatttttagttgtatgaaaatgattaagatgttaaattttatgctatgtgtacacacagcataaaatttaccatcttaactatttaaagtgaacaattagatcgtgttcactctgttcacattgttgtgcaaaaaaacttcataattcttgggtttttggttttattcctcacaaaagagacttgtaaatcctgttacatttaatgcaggattgtaagtatgtatactgaagtgtttaaggacttcatactggtcactgaatgcattatattcaattaagtagtggccaacggaaacctcctcgaactcagttgtgagtgggctacttcctcatccttttcctggatgtctcctctgtgagtaaggactgtgcctcactcatgtaaggcccttgataatgtctgttgagtggctgcgtgagctgataagatcattgttgatctagaatacagcttttcttgaccacccttacaagaatacaggctaattcccatgatattctgatgaaacacaactcaattacatcaataaaaaacagctaatattgttagcactcttctatcatagcaattaaaaataaaaagataacgtgggaaagcagcaaaatgcttttctaatacctgataatgatcttactttcaagtgaattatctgattttatttgcatcctcaaatgccttagaaacaagtaaaatgaaagagaatatcatattttgaattaattttcaaccttttttcatagaattaaaaatacaattttgatgaaaattcacagatggacctctcagggtccttttcaaacctgagcccatgattcacgctttctttttttaaaaaaatcattgttgaactagttgcaaatgagactagctataaggctttggtcaattctcttaattgctctggccttcaggtgtatttaattagatcctattctattccaaacatattttgattcctttatactatatactgatgaca

SEQ ID NO: 95532 - DNA, 2338 bp, Homo sapiens
ctgtgacagaatcatggtagaacctcctgatagcatttttatgactgttagatgagttagtacttacagtgcttagcacggtggctggcacatagccctcagaaacaattcacactcataataattcctatagttatttatagtggccctatttgctttgcatttacctgctcatgtgtccaaccccagatgggttgacagctctgaatgtagaaattgaagagaggtggatgaatttcactagattataagttccacaaaaccagggatttttgtttattttgtcccattttcatggtactgcttactgaagcatctctaatggttcctggcacatagtttgtgctcaatagatacttattgggtgagttaattaatttaaggatatggatgaaagaaggtgctccccaccaatcctgggccttcccgtgttggggcctccgtaatccctgccagacctttatgggaagagaggagccaaacacttccaacatataatttatagctgctgttacaaagcgaaatggaaaccgtatttactgatgtatgtaaacacagcacatataaaataaatcatagagctagatgctggcctcagaaacaaacacttaacaggcagtgctctgagtgggacgctgtgttctctgcctctttttccttgttctcctttgtttgattttcatgagcagaagtccttccccgggggtagtgtgtgcgggtgtgctgtgcgtgtgctcccacagatggtcgtgttctgtggccacaagatgatgtgggaataaggagggtgatgaggggaacagagcaatataggagggagcccacatttccagcgtctctgccacatgaactaggttttaatgtacgaaagacctaaaatatgcagagttcttagaaacacccattggccccatggggtgctgtttcccagaatgtctctcagcctttttctctgcatgccatttagtactttaccaatcctgtttctgtcacgattcctcgttcagttattcatgggaatgctgcattgtttcataatttaggtgaacataagccgtgtatgtctcctgagctctgtgtatttgttatctgacagacataaccttcaggaatagcatctgtgtccatataggccttggcatgtttttaatacacactaaacggttgaccccttatgtgtgtaacaaaaggattaacagcagaaaatagaaaaatgtatgcattcagctatttctctctataagccctgacaaaaggtatagacaggccctctgcccacctctcccccattcttggatatctccatcagcgatgaagacctcctccatcccccgagggatgctctatgctctctgtggcatccctgctgaggctcatgctgctacatgctgaaaccccccactttcatgttgaaaccccccagcagaaggggatggtgccctcctggggtgcccttttcatctttgggcaactctgacccttatgctgatgaacaaatcaacccatctataacttaacgcttcttagctttggtcatgcccctgggatttcttaattgctggcgatttcattttcatccatctttgatgactgattcgtacctacgaggtccttactgtgtccctcaggacagtacctcacacagggtcatgccaccctttaccagacagacctgaaagtcagaggagccttcctgtgtcaccatagcctacctaaattcctgttagaattttgatttttaaccttttggcagttgacagtaagtggtacagagagaggaaaaagcagagcaggggaaagagggctggggatgcccatgggggtggagggtgggagctgggtgcagcatcaagagggtggctgggtcactgcactgagacattgagatgtgagcaggagaacagtgaggctgggacgtggtagagttagccaggaagacatggcagggagaaggcacatgccaggtggagtaggatggaaagctggagtgaaggctgagtgggaatgtgcctcctcgcctgggatagcaacaagacagcatgctgcagtggtgtacatgggatgggagaagtggcaggggaggccacgtcttgcaaggcctgccaagcctcagtaaggactgtggctttactgtgagaattgggagccattgaagggtttggagcagaggagtgtcatgatctgacgtaggtatgaaaatgatgggtttggctgttgcactgagaatgagctgtaatgggtcaggggagaagtggaacatggcttggcaggttattgtgctaatctggggggggggtgatagttgctgggaccatggggacagcaaagatggtaagat

SEQ ID NO: 95533 - DNA, 1763 bp, Homo sapiens
ttttgtagagaagatcaagtgacaggtataccgtaactttttttgattacacgtttatgatagattctagaaaatgttcactagaaactaatggaagcaaaatgtaatttctataggcatttacgtttttaaaagtttgtaggagacacacgtaggtaccatcttacaaaactgaattcatcaggctgtttgattcgtcatcatcaaatgactggtagcagcaaataaattccggcatatctttgagcagtggtgactgacttttacaaccaccaggaaccccttcattatttcaatctcaattgacttcttgttaaaatggtttttatctaccaaagaaacttcagatttattaggtaataatttacatgtttgtttattttggaattcagtgagttcataaaactctagttaaaacaaaaaaagatgaatttttgattgccagtaaagccttaagcagataactgtgcagtttttatgaggcttttgggtatgtcattaataacctggacactttcaggatgccctttgaggactcagattggaaagaacatgctgtgtatggtgtctggttagcagagagagagggggatgcctcagacagagactcacgctgagagaaatcagagctttctatgggaagtgttccatttcccctatatgtagtgacattgaactagcgagcctgccctcttcctaactttttgtcctgaatatttcaaaaaggccagtcatgctttgatagagaagagataagaggtgtttgtagaagaaagttaaaaattggtgggtgggttctttttttttttgtgaaggggggtgcagtgtttatcatagttaaaagcactgcatattaggagaaatgttgtaatttgaaccttataacacttgtctgtttaatcagtccactcccacaataaaaacatgactaaatttcacagtcagcagccaagtagtgagttacttctacccttcaaactcagagatctttgttgacagtattccaagagaagattaagacatactctttcgcaggtgcattgttcaatatttataggctattccaataaaatccgcaatcaggccaggcacagtggctcattcctgtaatcccagtactttgggaggctgaggtgggaggattgcttgaggccagagttcaagaccagcctgggcaacatagtgagatcccatctctacaaaaaataaataaaaaaataaaattcacaatcataacatagaagctgaagaattttatcaaccagattttacttttgagggaataaatatttttattttttgaaagaggtaaaacgatttaatgtgacaatttcaaaaatattcatgccaatatttttaaaaataaagatactgctggtatgaaaatgtcctctcaatagtacagacattaacttccagtgaggtagagaagggttttttagggaaatttccaaagaaaataacctgcaaggttattacttgactatggtttttgaggatgttagctacagagcaagacttatcacagtgtgaagaatttgggggctggaagggttaggtaaaaatgacataaaaacaaggagggccatacaaaaatagctgtttggcatcgtataggtacattcctcataagaaaatcagattaataactaggtgcaatgcaatgagagaatttttttttttttttagtgtaagatgtaatctctgcctccaagaaatttacattaactgaataaattagactgcagcacatagcttttaat

SEQ ID NO: 95534 - DNA, 1062 bp, Homo sapiens
agaatgatggccaggtcactgaacccacctgcttctgctgggaaaggaggacagagctcatcttaagggatctgtaagctctttttgattggtagtgttggttctgttgtctacacggaggccagatttctttatccagggagccagaaaaacaagtgcatttccttccttcagtaaacaggtcacttcctcatcactagttgaattagcccctttgttttctccttattagggggaaggaacactttatttcttcctcatttcttccagttgtctggtgcctggccacttcataattgtattttgagagaatagatattaattttcttcaacaaaaggcggagttccttgatgacacaacataattcaatttccgttctctcccctcattgcctgcaccccttcctcctggcacatttttcatagttaggaggagtgatagtgtcaaatatatcagaaggaagaattgattcagtagtcgtttgacgacttgactgattaacagagatcagaagaaggctcataactgtgaaaaccactgcagcatgcagttttaacagctctttagggagctagttaatgaaagaatcactgcagaaacacagccatgcaaaaaggaaaaaaaaaaaaagaacaggagcattcccatataacactcagaagctctgtcatagagaaaatatgctcataatttctatttacacatcactgtaattaccgtctgccttaagattactttcagtcttctcctgtcaaagttgcttaaacagttcctctttcacataccaggaagagaaacctagtactggttggaactggtcctaaggattcttttccccccaaagaatgtaattgttagacaccccagcacactgcctgatgactctggcttttgtctcatccatgttcttgttgtcatcaccatttgtccacgaaccagacttctgcactcacacaagtgttacattgggctttacagtttaatttgtgtgtgtggttgttctctcttctttttcctgatgcagtgtctatgaaccagatagaaatgcattacggaggaaa

SEQ ID NO: 95535 - DNA, 1056 bp, Homo sapiens
tttcttagactccccacaaccctggagacatatcagtagtttggatagttttttaaaaataagaataaaacattttgatgattctagtcaagggatacaattggcttcatatacccttgcctaaaagtctcctccatgggaaatgcagtttgcttggagcgagtgctccaagcaaactgcatttcatcagatttcatcaggctgcatgtggatgagtgcagtgggaaggaggtcatccccccctggctggctgggtctgctgaatcaacctgtgactcagccagagggcaggctgtcctggctccagcacctttctcaccagtagggcagcctagggagagattggagcaggctaatgaatgggtagcacttgataaaaatagtgacatcagtagccctcgctgggcaactttagaatcttatcattttttatttttttattcacttctctatcttccattccacaattctaggttacataggtctgctttgtgtgtgagctgtggaaagagactgatttctatcctttgtcagttgggggctgtaaaaaattataacagctgagactttattccagaattctccttatggttctctctgtctgactgggaaatagcttgccttatttcatttattcctgttttgcctctggggctcatgttaactacttctcactactgggcttgtcagacatcagggtttaagaggtgccaccacttcttggctccaggatagctcctgttctctgggcagagctgagtaaggtactttggacattgctgttccttttacacagtgtgtctttatgacattgttttgatgatcaaactcttatcctaagtttcttgatctttaaaagagttaacctagtcataatattcaccatcagtgtctttctccaaggggcattgtgaggataattaagggacatataggtgaaatgttttgagctcaatggaagagaaaagccatcgggctcatagatgttacttttatttagtttcatgctgttaccgtatgatcaagaatagatgaattttggaaatgatgacagtt

SEQ ID NO: 95536 - DNA, 1023 bp, Homo sapiens
cagtagataagaaatgtgagccatgctggtttttttcatcttaactttttacagcttgggaaaggggactagcaagatgctcctgtctaatcaggttcaataccagcttctcttgtttctcctaacaagcttggcctcatcctaattcttccttttctggagacagaatatctattttcagcctcagaacattgcaagagcagtatgtttgaagactgagttgaaagctgctgagctgctgatttatctgcagatcagctcccgccttaactagttcttcatggaagcccctcgacatcttcctgggagccgttgcgtgggctcagctcgtattctccagctctctttcaaaatactttttacctcccttattagggctggtctaccccaggggtttcatccagggctggggtgggagtgggtgcgcatttaaacaaaggggcttgatgtctgccctaaccggcaggataaccacatttaaagaagactacctgaatgactatttgaggtggaagaaatgggctttgccgtggggagaaatcaggactcttgtaaataacttccccagcatttctaaaaacgacataggttgctggaaagctttgtgtcagtcacaaggattagcggagagcatgttgggcagtttctctgtctgggtaggagaggatgggagacagggaacctggaatgtggcattcttctggcaggtcttctttccgcgggactgttcccttgttggctgttactccacattagtcaatagcagcatccccagaagaggttgtcagcatcagctcctgcatggaaattggtgcatcagtcaagcccatctgcatctgcaggggcagtgtggaaatgtgaagcagggactgctgggagatgagggggtaatgatctgccctttagggtgcttggggatttctctcggtcagacaaaatcctacgtgcactgacgtttactttcctttaagaaagtgtgtttttgcacacttgtgcacagtgctgtgtagtggaccttatagt

SEQ ID NO: 95537 - DNA, 1049 bp, Homo sapiens
ctgttgttttagattaccttagcttgtcttcatcattactgcagagacttcaaagctatgcagagtaaactctcaggatcaatttccccctctccacttcccctcttgtcacatttccccacaccttttaacagaagccctgctcttggggaagtcaggaattagttgcttcactttctaattattacaagtgtgttaaacaaaatcactgataagagcctcacatgttgcaggtgcgcatgctcaagctcgtactggggaaggcggctggaggaaatgtgagcaggtgcagcgccctgtcctgccctgcccctgcaggagtcctcattagtgaatggactgagagtggcctgggcagtgttctatctggacatacagatacattatttttaggctttaaaacagtatgatttggcaaatggacccaccaagttgaatcacaatctctaaacccaggagcatttcctgggttcctgtggagcagttcctctgtctgggtaagggaggactggagacagaccctgcacatagagtggggacaaggagtataggtggtgtgaaagtttgctgttaacacgggactgttatggatccactctaagccagggtagttctagaaggcaggatatggtcagctccaggtaggtcccaagcatactgggtcatggccctgggtcccaagcatactgggtcattgtccttccctaaatccatgttgtggaagggatggcatgggggacgaggtagaagatctagagctacttctgcctttttcttcgtaacttcccaatgtaagttttgtggattttcagaaacacaaatagaaatcttaatcgtattctttatcctattaaatgagttttaatgctgcaattttaaaatgaattgagtgacatggctgctcatccctagattaaggttctttggtaaaacaaatttaattcatacatgaactacaaaatgaacatgaaagcagcacatcagtgagggaaggaaatgaagacttcatacagcaagctcaggtctgttgtctgtttccttctgccccc

SEQ ID NO: 95538 - DNA, 1193 bp, Homo sapiens
gagaagaatccatgaaatcatgtttataaaatgcctggtatgccatttcttggcatatcttagttactcagtaaatggttactgtttttgtagttgatactaaaactgtagctatcactcatttttctcctgtgtggtcccttttatgattcccctatttgaatatgccttgggtcagtccttttctcagaaagttaatgtcattttattttctagctagggtgatttactcaagctatttgagagttgcagtctcctaagttttcagagtgtgttcccaagggaaccatgaagaataatagtttatcttgattccaggaaagacagttgctgagggattcatggaatacacgtttgcatttctttccagagcagctcacaaattatgtttgttataaatgctggttgcttctttgccagagaagaaacttccttggagtattccagatttctagtgaagacaaagatttctttgtcaagatgagaaagactttacgagattgtggggaggtagcattgagtttaaaccagtagcaagagattggtgagaaaacaagatgtgacattctgaaaaggaaggacaaactgcaccaatagagagtcacagataccatgttgctgtggaggggttgagggagttaataacactgatagtaatattggcaatgataattggtcttgagcatttatcatgtgatatgtgtaaatgctatgtgctttaatcatgcatttagtattaaataggcacagagattccagtgagttgagctgagagttaaagagattgggtaacttatcctgtggtcatagaactagtaagtggcaggcctaggatatgaatccagtgtggctagagttttttttttttttttttttttttgagacagagtcttgctctgttgcccaggctggtgtgcagtggcgtgatctcagctcactgcaacctctgcctcccgagttccagtgattctcctgcctcagcctcctgagtagctgggattacaggcgcccgccaccatgcctggctaatttttgtatttttggttgagacagagtttcaccgtgttggccacgctggtctcgaactcctgatctcaggtgatccacccgtcttggcttcccaaagttctgggattacaggtgtgaccatgcctggcccagtgtggccaaagttttcaacagaaatagttttc

SEQ ID NO: 95539 - DNA, 1087 bp, Homo sapiens
ttgcatattagaaatgggatggaggtgagtgcaggcattgaaattatcgctgcatgacgatgtatttttgtatttgcataggccttgtttatcaagatgattgtggtttttgaccctgggaaagcaaatggtgagagatagacttggtttcttctgcaacttgcaatgcataggtaacaggaatttatcacaagctttttgttgaggaaggctaactcacatgtctctctttcttcctacattggacagttgtgttaagttgaaaacacaccatcttaatttagtagcaattcagatattcagtcaagaatattaatatgttaatgagaacttcagaaatttcacttatgcgaaagtaagactttccttgcccattgaagacatggctgtaggcatccatccagattatgtgggaggaggtaggtttagtgtcatattgatactctccccacccgctccagctactctttctcattgagtgaatgctggggagaaaaggagtagaggaggggtaggtgatagtaagaaatagaagggatttctcactgggtctggtcatatgctggctttgtgttttctgggccttgttgcaatttaacatctcttttctttatcattgttgtttatcagttttatgacaatcacctagattgaatttcttttcttttcttttcttttcttttcttttcttttttttttgagacggagttttgttcttgttgcccaggctggagtgcagtggcacgatctcggctcactgcaacctccgcctcccgggttcaagtgattcttctgcctcagcctcccgagtagctgggattacaggtgcatgccaccatgcccggctaagtttgtatttttagtagatatggggtttctccatgttggtcaggatggtcttgaactcctgacctcaggtgatccacccgcctcagcctcccaaagttctggggtttaaggtgtgagccaccgcgcccagcctgaatttcttttcatttaccctgattagtatatctgtggatttatgtcttttaacactcctggaaacatctcagttatcatctccttaaatattccctttcctcct

SEQ ID NO: 95540 - DNA, 1721 bp, Homo sapiens
attttaaatttttttctctattgtatatgatgacatttccagaattaaaagcttttgcatacattctatttcttcttagaaacaggtcatatactgttagaccctggttgacaagaagaaatgtagcattaaattgcagtgtgtttcaagtcaaatgttttaatgccacaacttctgaaatgtagagtaattttaaacaaatatttgagtatctacactgtgctggataagtatttagctacagtattattctgtcacgtccttttatatattacaaaatgttcattcctatcagcaattttaatactgaaaaccagaaacaatatatcctattataagaaaaatctcatttattaaaattaaaaattatcacgcaagttcactagagatggcaatttgcaatacaaaaaaaggctttcgtgaaaaaaatgtcttcagggagtagatcttttaggtgttaaagataattacttcattcaacagatcttggttgagcatctaccatgagctgacacttgtaattatgtgacagaaatgagcgtagagaaatggaagggaagagagaatcttcaggagccatggccagtttggatcagttggaaatgaagctaatgccttcctaaaattatcatgtactgttaagaaaactaagtgttttaatggaaaaaaaattatcatgtatgaaacggtgtgcaaatataactgacgattagaattcaacttataactttctaagagcatgtctgtagaataaactatgaacatcgtataataattcaggagaatcacagtgtgaaaataaatgaaaggctatgattgcatctcagtcatgaacaggaaagttgacctggagcataaacatgactgctccaaaaagtgttgtatcttctaaaaatgctcagatttctacttctaacaattatagcaacgatggtttcacatctgttagtcagacggttttaatctgcaaaaggttaaatgtttgacagttacttgttctcacatgcagattagctgcttggagtttaacctttagatgtgcttacgcaaccacgttttacagtttttttttttataaaaccacccaaacagaaacagtctaataacttgcaactaggaatacagaaatccaggagacacttttttcacttgatacaaattactccaattaccttccctcttcctttctgtctgggagtatcttaacactcaccctaatgtgtagaagcaacttcacaattaaagaactgaagccatttgtagagatataaatgtcaggacaggatgattcttccacttcaataccttgcaggattttaaaggagtgagtgtaactgcgtgatacagaggagaagagacatgggatcttttatctttacctgagaatggggagatatgtatgaattttaaacttttttgagtgaggagtttatatctggagcttctgattattataaaagagcaaaaaatcataggctttctattactgcattcaacttttaaatgcgtgttgatgatacattaattttaaggcattattcacatagataaggcatttgattaaactgattcaagttatatcgtatcaaatttctttctgattttgtgttgcttgaagaacaagacaggattaaaaaacaggcaagaaaataggagatggctaaacattaactctatgtaagccattctgtcctcatttttaatcagtgaatgctcttaag

SEQ ID NO: 95541 - DNA, 1755 bp, Homo sapiens
attcagcattgggtccgtggctgagttacaacaagggaccaggggtggtggtcgttcgcagttttctactcagtctccttctgacttgtgagagattagttcctctgatatgactgtgtttatagtaccctattatacagatcacgtgttcttgttttttgtaatttaacaatttctcatttcattagtctcttattcaggtccgtaaagtcatggatgaagtaaagtgttgcattttgcacattaggttccttatttacaattttaaacttaggtgcaacacaaaattttcacaggcaaagaataaacaggattcctatgaagaggtcatctgaaaagcccttgacagcaacctttagattatagacaacgacaattgttcttttaatttttaacttctgactatgatatatgaacttgcctttatttgagaaagaggttagtgtcttagttatttggtgctctgtgtttcattttatttgaccaaataacacattttgttgaatttcagggtagacagagaaaatgcatggcatatgtattaatttgatgaagctgccctataaagtcccacagcctggacagcctcaacagcaggtgtgtgtcacctggcagtcctgggggctggaaggctgagaggaaggtgttggcaaggctggttccctctgagggtggtgagggagaatcccttcatgcctctccagcttctggtggatgctggtgatctttggcgttctttggcttgtggatgtatcacccgacaccttcatgttttctgggcattctgcctgtgtgcatgcctgtgtccacgtgtccccttttcatgaggacaccagtcacacagggttgtggtgcccaccctactccagagtgacctcatcttaactaggtctgcaacaacctcattttcaaataaagtcacattctgaagcattggagattaggatgtcagcatctgaatattgtggggtctgcagggacacaattcaacctgtaacagcatgttagactacagcatgggaagatcctctgaggctgaagttagggaacctgtcctcaacattgacactcacagcgttggcctttatcttgttctccatcgaaaaaagacattgcagtgaacaatgtctcattccaacaataacttcttcgtattttaatcaacgagtgaactagccaagtcatttaatatggggacagaaataggaaacaaagaactcagttaaggtaaaagggatggcaggaaagagggaaatgaaggtgaaaaggcaaagataaaatacaaacgagaagaaacagcaatgaggttattttggaaactggttgacccaacaggtcagtgtttgtgatatggtggattcctagcattcatggcattaatcctgcacttaatacacatgaggaacaagggtgcagctcttggtgtgactgcagagatgtttccgtttgttgtgagcacctcccttcttggtctgaaatgggcactttctctggggttgcaggctttaccagtaggacaggcagctagctcatggtatagcccggccagcaagcctgccccagcccaactcaggatcagctctccatgggtccagctccaggtgtgcagcatgtgcccttaaaggccaagggttcatttaaagcagtaatccccaacctttttggcaccagggaccggtttcgtggaagacagttgttccatggacgaggaggtgagggtggggatggtttcaggatgaaactgtaccacctcat

SEQ ID NO: 95542 - DNA, 1048 bp, Homo sapiens
gttggaatatgcaaaatatgtgtagtttactaattgaaatattcattttaaaggaaaatttgccaagggaactggcttagggcaggaagaatgcttctgaaggagtgagttgtcgacaatactagcaagagatgagaaatttagagaactggattagaaagccagcaaaattcacccattaactggtgtccaagggcattccttgaacccttctttgtccttttttcttttttttctttccctcttggataaaattagaggcttggcttaaatggcctctagtttatccagccttaaaaactctatgatgctgagtggtttccagataaataaaccatcacttggttagtttctgataatggaacagatacttggtagtggaaatagtagagaaagagaatttgggtattagctagatttcctccctccacttccccaaactcctagattggattagatcaggaaggaggaagtaacagatactgtagtttcccattgctgctataacaaattaccacaaatttagcagcttaaaacagcacacatttattatcttagagtgctgaaaatcagaagtccacagtgggtttcactgggctaacatcaaggtgttggcaggcctgtgctccttctggaggatctaggggagaatctgtttccttgctatttccagcttctagaggagctccacattctgactcacggccccatcctccatcttcaaagccaacaacctcctcactctggccctcacttgtctaaccttcctgctccttcttttgcttagaagggccttagcgactaccttgggcctgatcttattatttttaagattaattttaattgttttattttcgtttgagacagtctcactgtcgcccaggctggagtgcaatggtatgatctcggctcattgcaacctctgtctcctgggttctagcaattctcctgccatggccccctgagtagctgggattacaggtgcctgccaccatgcccggctacgttttgaatttttagtagagacagggtttcactgtgttcgcca

SEQ ID NO: 95543 - DNA, 1037 bp, Homo sapiens
atacatagtgagttaagagcaaggaaaataagatcaggaagttctgtcttcatggccaggcacttgaggaacatcagacgtcaaggaggctgagttactcttctttttgtgtggtgagtctattgacccagaacgcagatataacatctgcggcatcagacctttcttgtaccctgagaaaaataagcttcagaccaaggagcaaacactagtacaggaatctggtgtttgtacaggaatctgggccattaggacaaatttaaattatgtctgcaagtggttatgagctggggaagcgtgagttctgttggggggccacaagaaagtacagttcatcatattgcttcatatttctagattcctaggaaatgtattctagattcatttctgggagctaagcaggaactgtgtataccagttgaattcagcccatgctgattgtgcacctgtggttaaataaggtgcagcaggcaagagagagaagtatgtttagacagcatctgccctcaaggagtttgtaacctagttgagaatcttgaaatctgttttctagtttgctagtttctagttggctttaactaattaattaattttagattcaggatactactgtgtaagtaaaacttaattacatttgacatgatacagttggccctccatatctgcggtttccacatctgtggattcaaccaaacttggattgaaaatattcagcaaaaggccaggcactgtggctcatgcctgtaatcccagcactttgggaggctgaggcaggcgaatcacgaggtcaggagatcaagaccatcctggctaatacggtgaaactccgtctctactaaaaatacaaaaaattagccgggcgtggtggtgagcacctatagtctcagctactcgggaggctgaggcaggagaatggcgtgaacctgggaggcagagcttgcagtgaaccgagatcacgccactgcactccatccagcctaggcaacagagtgagactctgtctcaaaaaaaaaaaaaaaagaaaatattcagcaaag

SEQ ID NO: 95544 - DNA, 1041 bp, Homo sapiens
tatctctgagggctttctgtggtttccttaacatataaacagaaagtcagaacttgttgtattttggtatactagaatttgaaagagtttgatttctacagttttctgaccacagtaaatccagtgttgacatcttgatgcctttgtgggaggttcctttggagcaagatgtaactcagtgtctgcacaagatctgccaagtagccctgccacagcagtgcctggctcagcttactagttaccctcagtcagcgggcacagtcatagaaacccacgagtcacaagtttattgagctccttctatgcataacacaccatgctggcttggggacagtgaaaaagtaatgtggcccctgctctgaagaagcatggagtctgtgtggagagaaaccagtatccatgaaatagctatagagtctggactcttggactgttagatctgtctggaaggaaccttagagatcatctttccagcccacctccctcaatgtacagcagagaaagtgatgcctataactaaatgcttatttctatggtgtagtccagggcttatcaaatttagctgcttcccagaatcagctggggatccagagtgcctggggtagggacccaggtatttattttggagttcataagtcctatagtttgcttattggatttgggaatggtaacaggctgagagtggttttggaatctaggattttgggagctcagtgaaagaccaagaaagagcctcagggaggaaatgatgttgcataaagggcaggtaagattgagggagactggagcctttggggacaggggtgcagttaggtgagcatatggaattgggaactggtgtggccgaggtgatgaggaagatgttttacgtcacgtgactctcttggacagcaaggggctgtaggagattttgtacatttgctttgaaaaagagctgtgagtatatttctgctaaagacattttgatagtcaatttgacttttttttttttagttttaagaaagtatgtaattgcatcacaattaattcttcaattccaaa

SEQ ID NO: 95545 - DNA, 1068 bp, Homo sapiens
taaaactaaaagaggaagctttttaggtgccagtgattatttagtgatggtaacatggatcactgatatttttactttcttttttatatattgattttgtatcctgtgacctcgctgagtgtattcatgagttctaatagttgtgtgtgtattttttaggattttatatatatacacatgattatgtcatctgtgaatagagatagttttgctttttcctttccaatctggttgcttttaatttttttttcttgcccgattggcctggctaggacctccaggagaatgttaaatagtagtggagtgagtagacatctttggtttgtttctcatcttgaaaggaaagctttgtcattcactgttgagtgtgatattatctgttggtttttcatagatgccctttatcaggttaaggaagtttcctgctgttcctagtttgttgagtgtttttaagcacaaaaggatgtgtgatttttgtcaaaggcttttctacatgtattgagatggtcatatgggttttaatctattaatactttaatatactttaatatactttaatctattaatatacttttatatactttaatacattgactgatttttatatgttgaaccaaccttgcattcctggactatgtcacttggttatggtatgtaatccttttatatatcactggatttgttttgctagtattttgttgaatgacttcctttttcagaaacagttgcctattttcttctttgataatgaaagttcatgaacacttgagataaaaataaaggaatatgactttctcaggacatgcccatggaaacacgaaagcattgtttctgcatattctctgaatgatagtcctgtaagtaagaataatcaaatctcaaaagagatttgagtacttgagtactcaagttcagaaacttttatgtaatgattttctgaagaattttaacttgacacctgcttaagaaattctcacataatgtaatttcttatatgacacatttagattttaggtcctgatcttgtgcaagtcattcaattttttttagcttagtcctctaatgagt

SEQ ID NO: 95546 - DNA, 1068 bp, Homo sapiens
tagctggccatcgtggtgcatgcctgtggttccagctacttgggaggctgatgtgggaggattgcttgagcctggaaggtcaaggctgcaatgagccatgattgcaccactgcactccagtctggatggcagagagagaccttgtctcagaaagaaaaaaaaggtaatgttttagagccctaaaatatataataatgtaacgcaatccgtctacagtatagagggcttgaagctgctctttgtaactttcttcctctggatttctaggtgtctgggttgagatgagcatccttttattgagccagacacagaagtgaagagaccacatttctagcccttgatatgtttatattttagcctggtaataagaacagattatttcattagtctaagtagactttttacctgccccaaatcctgtggagtatgtacgggggtaccctactcagcatggtattttagggatgatttcctagagaaagtgacatctgattgcagtcttaaaggaaggataagagttagccaggctgggagcggggtagggatatggcaggtacgataatgtaaggaaaggcaaagaggtgaaaattagcaagttgtgaacaatagcagtgaccagtgcaggtcagtttcaggtccctggcattcaggttgggaatggcaggatgggaggttgggcagtggagctgggagcagctctcagagggccttgcatggctttctaaggagctcaaacattttccagtaggtgatggcctgcatgagggctttaagcaggggagcaaaatggtcacgtttgcatttttttattatttctagaaggcactatagatggatgagtctggtggttgtgagaggccatgtctgaaggtcaggaggtcagtgaggagtgagggctgactagcctgggccggtgaggatggagaggaggagagggagtagagagctgttgggggcatgacacagacagtattcactcattttctgggtagaaggggatgagggtgctttgaggctatctagcttgtgtgatgagatagggaaagtaggaggaagagcaagctgagt

SEQ ID NO: 95547 - DNA, 1030 bp, Homo sapiens
cttcatctgtatttacagctgctccccattgctaacattactgcctgatctccgcctcccgtcagattagcactggcattatattctcacagaagcatgaaccctatagtgaaccgagcatgtgtgggatctaggtttctccttatgagaatctaatgcctgatgatctgtaactgtctcccatcacccccagatgggactctctagttgcaggaaaacaaactcagggctcccactgattctacattatggtgagttgtataattattttattatagattacaatgtaataatagaaatgaagtctacaataaatgtaatgcacttgaaccatcctgaaaccatctctccacccctggtccatggaaaaaaagtcgtctacaaaactggtccctggtgccaaagaggttgaggaccacttctgttgtgggagtagaaatgaggattcaccttaaaggaggatacagctctagcaaccctttgagcaaaatatatgagctgtctgtcatctcgaggaaatagatggcaacatcagaaatgggaagaccacactactccaactcacatctatgtctatgtgcagtaggccctctgttttgatggataatcagatggtctcacgtttttaccatggtgtgccacctgtggccctagctgtgtgactgtctaggatgaagtctgggctcaggttacagtgatgtggataaagtccgttctgcctgagcaccagtgatcatcacgtgcggcggcatattgtagagcccaggacagagtttgacttggagcctgctgagttttttgcagaagcatgtctacgtgcaggagaggacagctcagcgggtaacaccaggactctcttatttgtgttcctttcattgaaggtagttccttccccagaacatggcatagctgcttttgagaaccaatccttgtaagtgacttcctttaatttttttcaataagtagagtttaatctttgaatatgaatggaacacctgagaaaattctttggagtctgagaggaagtagg

SEQ ID NO: 95548 - DNA, 2373 bp, Homo sapiens
caatgttggctgttcccttttgtcttggaatttaattgaggtttctgaattcagctggccccaaccttgctttctgtttggccctgggcagctcatgatttttctcatttcctattctcagtcttggtttaatcacttataaaatgacagcacttagactggcctacctcataaggttgtgatgttaagtaataaaagtgtcaattgctctgaatgccaaatgtagctcttctataccctttgctttcttaaaaatgtctctttttcataaacaaggaagaatacagaaaggccgcataaggtcagattcagcagtccatgcggtgcagcgttctgtccctggcaacaggaccctgggacggttttgagtagaggttggtagcttttcttagtcgtgcatcatagtccagcagacaaatatgctcttacttacggtggtactactcacatatgtagatctattaaccattacataatcttttatgtttcactgagaatgtattgcattaccaaccattacatcgaatgacttcatttggcactgtgggtctcattaaattatgtcaggctaatcataatttagtttcactggaaacaaaatacacagtgtttatatcagagtaagaggacaccacccaatccaaggaactaaatgggttcaatctaaggaaactaccacccgggatatgataggggccttaagtgtttgaaggcatttagctgggaagtgggaatagagttgttctgggttgctcaagggcacgagtaagatcagtgggtgtgagagcatttaacagtgatgtgatgtgggctgtctcaaagggtaacaattacctgactttgtagaaagacattcctgggtaggcagagcggcagcaataggctatctccgagattccttccagcttcaaaattctatgatcattcccctcacagggtagcaggaatcaaagagtgcagaagtcattaattgtattcacttgtgtatttttcctctgcaatttccccactcacctgtggagaaaggcatagagggtacttaaacttcttcacataatttcttcccaggaggctcattgttagcggaggtaaacaaaaatgactgtaatttggagaccactttaacatagcaactccatttagagagttatgtgcttaacttgatactggaaataattttatttttccttttatatgggcaggaaattagtttcgaaaatcccctagaggaccatgatgtgagtctgttggtcttaaatttttcttctcatatctgtactgtttacctgcgttatgaagtgacagaacagaatttcagccagtgttcattgacatgttaattagttacctggcaatttagataggaagaggctttactgtagtggatcaccaccagttctgggaaataatctgtttttgttttaaaatttcaaaatatatttgttttcacgtagaatgcttgtagaagaagaaaagacccagggtgtagaaaatagttttgagagcataggtcagtatgcttagctctcactcggggaatgcttctcaaacttccatgtgcatccaaataatctagaggccttgttaaaatacacattctaatctaatagaaccaggagtccacatttctaactggctcccaagtattagttttggtccacagaccaaactttgacttgtaaggactaaatggacaaaaatttcctttgaaaagaagacctttcaaaatttgcatttccttctccctgttttggggacacctttgtgtaataacagtacagttccataaagcttgacggttgcgtttagatgcagtatttattttatttttgtgagtctttctaatacaattctgatgagtgagggggtggttaattgtattctggtggagatatggtgggaagtaaacataaaaacctaagtaaacacaatttgtaataaataggctaatcactttttatagcctctcagttctcatcattccttcaaagcccgggaccttctgttgtatcgggctcgaatgctgagagtaactgtatagtcttacagacacttttggatttgtggagaatctctcagtaacccctgtggatgcccaggattcagaccaaatgtccccattctctcctagccattctgtctttgggagggctggggttggggggatgggagtgttgggggtggggtcagctatttgcagaattattgcactaccccgtggccatagctgcaaattgcaactttcctagtgtcctacgagaaatcacaactgaagactctacgtggaacccatagtaggtttcagatacttcagttggggaccttgcatccccgctcggccaaccttcttctctctgcgccgttaccggagta

SEQ ID NO: 95549 - DNA, 1490 bp, Homo sapiens
aattcaataagcattcacagaatattagacagaggagaggtaccatcagggcagtgactttcaaatgcttcagaccatgacccccagtaacaaatacacgtttaacactgccacccaccaccccttgaacatgcatacacgtaagtgaaacaagagcatcatgaaataacgcttattactatgtgtgatacacttggatatttcctatcctctttctttctcttttttcttttttttagaatttcccattcataggctgaaacctgcagtttaggaaaccctgctgtacaggatgcaaaggacagtgtgttttttgggaacttaataggagaataagccatacccataaatacctgtaatccaaggctgacactgcctgcttgagggggcatgggcacatcctgttgaaagtaagatattcatggtggggtggcatttgaaatgggtcctggagtagaatttcaggaggaaatggaaaggaggaaaaccacgtggtgggaagactgtgaatagaaacatggagggaataaagtgtggatcttgtttggtgaaggtaggctaacacaggcagggagggatgcagaggcactagcagtttagtctccctaaggatgctgcctagtagtgcccgctgatgcttttgcttgtcttcaaatcaactgccagggggcatgcgcaggccagtgggcggcttcctccaggcctttttagactttacttcatagtgccagaaaatgctacagatccctgatcttgaccttcaggtgcctctaaccctttcctccagctgcagtaaagcaaacattttaaggcctattcctatccttttggtcagtccttatgggtcaaaacagagtacaaagaaagggcagaaggagagtgcacctgtctgagccccaggtgtcctggagctgattggtagacagcagctctgcagagctgcgtgtactcacactggccgaaggtcaccgtgtagttgactgcgtggctctcattggccctcagcatgggcctggaggggcctcggcaggtacgaggaggcaaagccttctcagaagagaggcttccagggctagggctgtgggcagcagtggggaaggggctgctcatcagcctggaggaggcagggggcctcgatgggaagcagtggagtgttgcatccgctgtggaggagctcagccctcgtgtggggtgtgttttggagaaagctgggtggagagactggttagttcagggcgccgagaacttggggactccagctgggctggggccccagaggataccagggaggaggaacccagggagtgtgcaccttaatgtgtggataggtttttaaccaaatgtatctggatgacgatgaagatgagtattgtgtgtggggaaatgattccttcctgtgttccagattctcttttgtgaaaatgtaggagggttttaaaatgctaagaatctattttgggagaatgtccttgttaactacaatgggtcta

SEQ ID NO: 95550 - DNA, 1025 bp, Homo sapiens
actaggacagtttggcttgaccgggagggtttctagttttgcagatgtagaattacattttacaaaagcttatatgtttctgataagttaaagaaaaaccaagcttgagtatgcatttctaatatgtttagacattttctcacagatgaatttttggatgctatgttctcagttttatggtttacgtaaatttttaagtttatggttacttttaagcttatagatggttcaaaataactaatatttgagaactttctgtgtgtccaatattttcatatccattgttttcttatttgaatctcttaatcctggaaagggtaagtaagtggtagtagttccattttatagatgaggaaatagaagctttgaactgttaaatgactttactgaggtcataaaacagatgacagcagactttttaaaactaacatttgctgaacacgtattatttatcagacactgttctgggtacattacatgttttagctcatttaattataaagcaagtactgttattagttccattttaaagataggaaaattgaagatgggaagatagggtaacctgcccagagtcacacatctaaaaatggggcagccatatttcaaccagaaattagcttcaaagcccagtgatctgacttcaaatccggtcagacaattgccattttctagagtacttcaaatatctctcagcttataaggacagctctgaaattaattacaaaacaaaacctcgatggactggaagttaaggtcctactaaaataacaaagagagagagccctaaatggtattaaaattaaaaatttgaaaataaactaccatagttaggaaagtatacctgttaattatgaattattgtattagagcaatatacattttaaagaccattgaaaacttcttcctttgattgatcatagaaaaacttttttgaaggaggaaggaggaggtacagattaatggcaaaagagaatcttaatccctaagaactttttctaattgatggacatcattttccaatt

SEQ ID NO: 95551 - DNA, 1048 bp, Homo sapiens
gaatagtcggcaagagctggctaatgccagggagagaaataattgatttttctctctgtcaaggtttctggcagcccttgtgcttttataaatgtcaggcatggacgaatagccgtccattcattgtgcttcatcaagtgcttgtggatgaggttccaaaatgggacgcttgccaaacattgagtcctcctcaaaaatgacaattctgtgtctggtgggatctgaccttgtgtgaggttagcctgaagtctgaatggagcccatagttggaaaacaacctaagaaaatctcttagaagcaggtgcttggggaatgcagttcactgacagcacaggaccctgcagatggtttacatgtggtttgggtttcacgagaaagaaggattcacttcccagtcagcatctggctctgccagatggtaaaggcgtgctttagtgtgtagacaatatgggggaaccacgtttttatctggaagtggatttcttagaacacaggctaaccaaaactacgcttaggctttgcgtgttgctgtgaagttgtctgtgaaatcgaataatcacaccattgttcagtgcaggagcccaaactagtccttacccaagaagtagtagcctctggatagaactgtgtttaatgtcctgttgtagtcccaggtgttgtaaattgcatgttgtaatcaaacgaatgtcaaaacataagaaagtataccttggatatagaaaaacctgagaacagtatcattcacttgaggatatatatatatatatttacacacaataaagtgagttaaaattgtatatgcattgggatgtcaaacataaaaccaccaagtgcaaagaatgctttgaaagtagaaccttgtctcattgatcagtggttactaagcatttaggaaacagtcatctttttctattgggatttgcattagaaattagccccatcagtaaatttcagtttactatccatttattaatatacaaaaacattaaaaaatctgccatgccatggtaatctatctattccaggaaaatagatcagaatatatgaa

SEQ ID NO: 95552 - DNA, 1045 bp, Homo sapiens
caaattatgggccaggcatggtggctcacacctgtaatcccagcactttgggaggccgaggtgggtggatcacctgaggtcgggagtttgacaccagcctggccaacatggtgaaaccccatctctactaaagatacaaaaattagccgggcgtggtggcacatacctgtaatcccagctactggggaggctgaggcaggagaattgcttgaacccaggaggcagaggttgcagtgagccaagatcatgccattgcacttcagcctgggtgacagagcgagactcgatgtctgaaaaaaaaagaaaaaaaattatgttttacttttctgtttcttaaacatgaatttccttgcatactttcataaaaattattttaaatctcttctaaaaatacctagttatagcagtgagaggattcagcagttgctgaatttattattggagatgatgtagctcgtgtgtgtgtaggaatactcagtggcagtctgtttttcttggtgctttttcaagtcttgttaatcttcttcctgttttcctgagaggagctgtctaaaatatacttatcaaataactaaactctaaatatgattggagggaggaattctttcttattttgtttttatacttattttgtattgtattgtatttatactttatacatatgtatatatacactttaatatatgtaatgacattaagattacttgtttttaaatgcagtcatttttattgatttgtattcctcctgtctttcagctcctgatgataattcattattgctgctgcgggcggagttatatttgaccatgaagaactatgagcaagctctccaagatgccagtgcagcttgtcagaatgaacctctcttgattaaggtatttgtatttgttagctttggagataatcaatgtgaagtttatatgattttcttaaaaacaaaagtaagattattgtgatcaggtacctatagacaaagtatgtttccctcacattactgtagcctacgtttagcaatccacctcacactaaagcaacctaatttaaa

SEQ ID NO: 95553 - DNA, 1061 bp, Homo sapiens
tcaggtagatgtctagattcagaaggcacataatcccgaagcaaatgacaccatgcttagctgggcacaccactctttaggattcatcaaaacccaccacaccagataatgtggatcctcgtagctcatccgctggcttctagagccacagccagagatgatgggatgtggagcacccaaccggggttgcttgtgccgggttagaattctccctcctccatgaatgaaaatgaccttgagactgggcagtggctgagtgggcatttgctttttgtacctctgactctgctgctgaagaaactgtttcaaaatttaaatcagatcatgacatcaccacccctcttttcatgtaaaactctcttcaggggctcccattgcttgcaaagaaaagaccataatagccctggcaggccccatgttgtctggcctgcatctgcctcagcctgtgccccagaactccagccacatgggcctgcgtttagttactcaggggcccattcccttggcctggaaccctgcccttcaccttaggtaactgtgctgtcccagaccactctgcccaaggcacatcccattgtattttctccccacagcaccatgtccctctcacaccatcaagtaccactcctcagatagcttctttccttcgtgtgggcctgttagacgacaagctctgtaaggacaagaactgtgtgtgtttagttagggactcagggtcatatccttggcagctgttttactgcatgaatgaatacactggatactggataatgaataatgagcttgaagtcattatttttaggttattttgtccttaaacttgtatgcacatacacacctactcatgtttgagtgctgtattttgtaaactgtagagatattggacctgagggaagtgggtattttgagagagtactgggctgtagtcttactggttctgattggctcatgtaggatgtgacttgtagaacaagtcccagttttctaaatttttaactaggccgggtgtggtggctcacgcctataatcccagcactttgagagtccaaggcaggtggatc

SEQ ID NO: 95554 - DNA, 1047 bp, Homo sapiens
cttggccaacatggtgaaaccctgtctctattaatgatacaaaaattagctgggtgtggtggcacacgcctgtaatcccagctactcaggaggctgaggcaggagaattgcttgaatctgggaggcggaggttctcagtgagtcaagatcgcaccattgcactccagcctggatgacaagagtgaaactctgtctccaaaaaaaggaaaataagcggggcagggtgaggcggaataggagaagagaggggaggaggatctgagggcttgggtaaaatgttgtcagtcaataaattgggattacaggtgtgagccaccatgcctggcctctcagcttctaatgtagtgtggtgccttaagtaatttttgtttaggtaggctaaggatctggtgttgtgtgcatatctttaggagaaaagagaggggaaaaaagaaaaatacatgttcgttcatctttttaaatttttgctttttgccaatgtaaccaaattcagtgaaaacatatgaagatatgactttggaagagctggaggatcatgaagacgagtttaatgaggaggatgaacgtgctattgaaatgtacaggtaagcgccacccagaggggctgtttgtttttttgttgttgtttgttttgttttggttttttttttggcgtggcaataaaatgtgtgggctgagcatggtgactcatacctgtagtcccaacactttgggaggctgaggcaggcagatcgcttgagctcagaagtttgagaccagcctgtgaaaccccgtctctataaataatacaaaaactagctgggtgtggtggtgaacggctatagttccagctactcaggagccctggaagtggaggttgcagtgagctgagactgtgccactgcactccagcctgtgtgacagagccaaactctgtctcaaaaaataaaatgaaatgtgtgtccttcaaaaaattaattttcagctgaaacatctaggagcgactgcaattaaataatattgtgaattttagcaaactgatcttagatttttgccataagaccaata

SEQ ID NO: 95555 - DNA, 1035 bp, Homo sapiens
ccgggggtctagggggccgggggtccgtctgcctgcggcgcgcgcggggtgcttgtcccaggctgggtcggggccaggagagaccccgcaggcggaggcaggcgaggggaggaggaggagggtgggggtaggagggggaggtggagagggaggagggtggagggaggaggcaggggaggaggcagaggcggaggcggctctccccgccggctctgcgtgcggaagagtttgccgcgcgagcagccggcctctcgcaggagccgagggacccgcgcggctgcggcccaggagcggcggccgcggagcccggagacccgcagccgcggcggcggcggcggcggcggcagcagctagagcagcgcctcccgccgccgcccgggaggagctcgccgcgcccgctcgccgcctcgtctcccagcggcggcgggaggcgcgtctccccggcccagtccgcgcccggccccgcggggccgctccggcccgctccgaggtaaggggccgcgcctaggggcgcgggggacccagggtgggtagtacgtgcgcgcggggtcgcaggactcggtcacctgctcgccagcgtggaggacgcgcgggggcggaggggcgctcaggcgcgaggctgcgcggcaccggggaccccggacgcgggggcgcggagaggtgggttcccctccacagtcaggccgctgggggcttcgcgtcctgcaggaggtagcaatcgctgggccggtgggctccgggcgcgtctcgacgcagaagacagaggactgggcatccgagcctcggaatttgggggtcctcggggtgtccgacagggtggagaaggatcgtgccccagggcaacagctttggggattgcccgtggttgtcttcgagacccatcgcgctaccctccgaaacgtcgggcgtcctggacccccggagagtgcggcgtgcgcgccctgggcccgcggtctctcggagtccctgggtcggaattggttccgggccggattgggtgcggaatcggtgcccccaacccccgtgtgcgcagac

SEQ ID NO: 95556 - DNA, 1056 bp, Homo sapiens
ttattttatttttatactataagttctagggtacatgtgcacaatgcgcaggttagttacatatgtatacatgtgccatgttggtgtgctgcacccattaactcgtcatttacattaggtatttctactaatgctatccctccccctcccccgaccccacaacaggccctggtgtgtgatgttccctgccctgtgtcccaagtgttctcattgttcagttcccacctatgagtgagaacatgcggtgtttggttttctgtccttggatagtttgctcagaatgatggtttctagcttcatccaacccagcagctagtcatggttctccgacatgggctggagtccttttggagtattttcacaaatagtccccgtcagtagaagtcagatctgtctttagtgttgtatagaaacatccatccattattttttcaatctcagaacttgatggcttcaattttccattatccatcatggagggtgaagaccttttagaagcagacagcatcatacgtccacataggtcacgggacaaacagtgctgatcactgcctgttgacaaagtgttgacagtaagggaggggaggaaacattttcttgtagctagagaggttttttgaggaggtgggttggagtgaggacaaggggaagccagtctggctgctacattgacctaccaaatcttgtgtttgggctgggcacagtggctcatgcctgtaatcctagcactttgggaggctgaggcaggtggatcacctgaggtcaggagttcaagaccagcctgggcaacatggtgaaaccgcttctgtactaaaaatacaaaaattagccgggtgtggtgatggctgtaatcccagctactcggaaggctgaggcaggacaatcacttgaacccaggaggcggaggttgcggtggactgagattgcgccattgcactccagcctgggtgacaaagcaagactctgtctcaaaaaataaataaataaaaataaaaataaattgtgtgtttgccacgtcagcacttcagtttgtgttgtctacgaaagacatggcat

SEQ ID NO: 95557 - DNA, 1127 bp, Homo sapiens
cttaaaggatcctattgtttgtctcctatgtcagcatcccctgaagaataaggatcacctggttttcaacggaaccaggagtttattcttcagattggagacacactcccaattctggttaataagctggttttgaggtggaaggaaaggaccctagtgatcatctggtacaacgtggtgcaccttttccaggtaaaaactagaggctcagaaagcaaagaggcctttgctgactcctggagcttgcccggcaccgaacagaccagccgaccccttcctggtggctcagtgcttctctttctctgatgagtcctgaagaggcttcctcacctggagaatcaggggtttctcaggccctgcttccagagaatccataagaatgaggctttctgggctcagccggcgcactctccacccagaggttttgggagggccacgccacaggccaactacccactctgcctgaatcgccttatctctctgtgtgctctccacaatctgctctctgccgtgagtagcataagataaggaaggctgggtgctagaggcagctgggtacagggagaaacaaggacaaggatggacacggaccgtccacttgacttgtgggaaccagctgactctcttaggtgcggacatctgacttttttcagatagactgaacgcacagagctcattcatgcctatgaaggagactaaactgcctacttacttgaccagcttttaatagtgcttctcatgtatgccaggcggggtcagggtcagctgcaggattttctcacccgtactttttaatcccataacattgccatccttggccatccctttatcatttttcttttcttttcttttctttttttttgagatggagtctcactctgttgcccaggctggaggagtgcagtgatgtgatattggctcattgcaacttccacgtcccaggttcgagccattctcctgcctcagcctcccaagtagctgggattacaggcatgcgccaccatgcccagctaattttttattttttattttaatttttgtatttttagtagagaccgggtttcaccatgttggccaggctggtctcaaactcctgacctcaagtgatctgcatgccttggcctccc

SEQ ID NO: 95558 - DNA, 1014 bp, Homo sapiens
tccccgaaaacacactttataaagactgatttcctgctggcaggagagagagctgctgtacatcacaaagcaaggcggcccactagagtggtatggtcagcgacctctgccttgcctgggtgaagtgtctctctctctgtctctgtctctctctcacacgcacacatgcacgcacacacatgccatgcactttctctgtggaagacttcaaagtgtttggtggctgttctgagacctgttcctcctcggctgggctaggggaggggcccactccttttacctgtgtttctttttagaggagaaactgacacaaagtcagatagtcttggggatggaagttgctctcatctgtaagaaaaggaaactgacctaaccagcaggtaatcacttgaaatcacttgtgtcccgtgctggaaacagctccacagcagtgtctatgatggattggaacctacacagctagaggaagaatttgcatccagaaaccacaggagcagatgacccacaagtgtagctattttacttctttcatgttaaattccaaataaaaggatgattatctttgaactgaccccagtccaaagtacaaatgcctggctgagatccaccaaggccagatgttgtcatcagtgactgggtttatgccaggctatcggtgaactgggtcagagatggtgcaggcaaggttgctgggtcagggcaggttcacagcccagtcattcctaaccaagaacatcagcacctgactggagggtgggaatgaggttcctgacctgctgactcatttgcagagtggtgtgtcagagccacacacggtagcagcataaacctgaacttcaggtaaccacacgccatgggatgctgcagatttatgtgcccactgcttgcagctgagaggaccagcatgaatggctctaatttgtcaccatggcacagtcacagatggagaatgctctgtcataaccagcgctcccagtctccataggttcttagcacccttccccatccatgttt

SEQ ID NO: 95559 - DNA, 1018 bp, Homo sapiens
agaacaaaacattctttaaaaatgcagaagaactaaaatatttaaggagccccttgtaggccaatgactatttgaatttacaaatcggcataatgtcttcagtacaaggcagttctgtgaaatggataaactatagattaaccccaaaaagttttgagaagagtacattatgtgtatgtgtatagcacgctgtatttcagtaatggaaatgctgaaaaatatggtacattctgtataacacagtgggttattttccacacgcctaaggtgtttctggaatttttaaaatcccaggtctgtgaagtgttttgcttcacctgggccatgaagaagccacttatgaaggtgtcacaccatcccagtgtttgttcctattgccttcataggtggtaactacctaattccaactgttgacgatggagttcgtcatgtagacattcagggccatggtaccacctgcaagggcaggcaccacagccatagagaaggtgggggatgcacctccctaaagcctcattaagggagatgagaacatccgaagctcccagtccttggaaatcagggtaacatatttccttctgctggcttcttaaattaaactacacagaagtttacacaaaattacatagaagtaacatgtgcttcatttgttaattccaatttctaggtgccattgaatataaaggcttatttgtgtctcttttctagaagtctcagcgcaaacggaaatctgtgacattcagcaagactggaagccttcattcctcagtaatgaagaattcacccagctgatgttggaggtgaaatgcactttcaaaatagcttaaacagttgccagttaaaatgtagctacttgttgcagataagtccctgtacccaaaggaaactactgttcttgatcctgggaagacttgactttgaaacagatacctccctgaggctctctgcctgctgttgcctatgggccatgtcaagaagaatcccaaaattgaatgtggtcacgtgttttcactacagt

SEQ ID NO: 95560 - DNA, 1074 bp, Homo sapiens
tttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataatgccccggcactgaagtcgggacacaatcagctttaaccaatggatgaggggggtggccacaggagatggggagaggagtctgaactaaacccctggcttttgtgcacactgcatacgtttcagaactcctggatggtaaccatctctggagtgcagcgcttgctgcagtggaaatgatcaggaatactgaccgtgtttctcttgcctccgaggttcttgggcacactctatagccatactggacaggaaccaggtgccccgtgtaggcatcgtcggtcggtttgccgtcagagatggcgcatctcgctgcatcccccgagagtacaccggttgctctagccacctgcggcccgcccatctgcgctagctggccttcacgctcttgatcgtctttcctttgtattggagaaggactgggtcagagatctgttggagagagagaataaagagattatttttcattatttttaaatggttgtttttgttttaatttgcacagctacacagaggaaataacttaggcactttctgttttttttaaaaaaataataaggtctcatggcttcatttagagaccacagtaacaacagcagcccaccaatcagagaagctggttgttattaaccaagctacagattcacactttctggcctaaaccctaatgggatgaggcttttcaccccaggccatgctggtggtgattttttagcccctaaataaaacactggactatttcctgtttacttcattgattgcaactacaaaggtggactcaaagcaaagcacaatcatgccagccaacattccagaattctgctgagaactccaagtctgtgaggggagaggttttacaagccagacaggcctgggggactgcagtccccaaggagaccctgccacatgctgg

SEQ ID NO: 95561 - DNA, 1011 bp, Homo sapiens
tagagcaaaggacagcattagaagcaggcatatgagatatgtgaatacagctagtggctgcttggttgaaaggaggcattgacttcagcaacacaattatgtttttattaggaatgtgccataccgaatccgtgtgcggctgtccagaaaacgtaatgaggatgaagattcaccaaataagctatatactttggttacctatgtacctgttaccactttcaaaagtaagttctccatcccataaagccatttaaattcattagaaaaatgtccttacctcttaaaatgtgaattcatctgttaagctaggggtgacacacgtcattgtaccctttttaaattgttggtgtgggaagatgctaaagaatgcaaaactgatccatatctgggatgtaaaaaggttgtggaaaatagaatgcccagacccgtctacaaaaggtttttagagttgaaatatgaaatgtgatgtgggtatggaaattgactgttacttcctttacagatctacagacagtcaatgtggatgagaactaatcgctgatcgtcagatcaaataaagttataaaattgccttcatgtttttgttctttttagttgcaacataatgtacttgtataccctatcctaattatgggatcatttgaagagcttttcccaaattgatggcctgtgctgccttctccccatcccctggggttttaaagtgatttcaaactgcaacctagttttagaaccactgttctgggtagttgggatactgaaggcatattgttaattattctacttgtatgttttgctaattctaagataagcatttttccagaaaccaggatgtagaatccagttgccattgacatcttaacattttaggaaacaactttaaaatgatatactatctatctatctatctgtagcatcttaaaggtaatgaaattaatgtggcagtaggtcttttaagcttctgcctacatccatattgagtatagttgttgtcttctaaaataattaatt

SEQ ID NO: 95562 - DNA, 1005 bp, Homo sapiens
tgcaaaaaaaagccaaatacaattgcacagatagtggactcccttagatcttgaaagtgaacttgattcctgacctctcccattgtcactccaagtgaaaaatgaaagcatggggcttttcttgcttcttggttagtatgagacattgtgttcatctgagagcaaaatcaacactagcatcacagcagaagtgcccatttcagcaaatccggtaaaaattgtaagttggcatcaagggaaccaatggataccttagggcactgacaattctcaatacatagaaatgcttgagggttgtgtcggttcccctggccacagtttgtcaggttgtttagccagatgccccattggtaaggtagactgaaatctcggtttagggctgaccccaagaaacagtctggttcgtgctttggtatggtggactccagtgtgcatagcagctgctgtcttgctacaagttactcagcttaagttcagattgtgattggtggctcatttcaaaagttttgagattgtactgattgatcttggcattttcaagtttggatttcatgtccagtggcttttcaaaaaagttgactaatgactgttcagtcagaagtgaagctaaaatatgttcaagggagacagtccagtccctttctgccgcctctggaaatgcctgggagtcctggggcgtcttcccagtgtctgcaaaaaccgagtcctcaggagaaggagctgaagcccgcagctcctccccacactcctgggagcagcttccagagctgctgcctcgctgccccacctccccgatctgcagcagcagtgtggtgactgtggcgatggcttgatacaaatcattttcttctggatcttcatggaacatactgtacagagttttacagaactggataaattctctctgaaattgaaataagtcttaggtagcagcagaaccagggtggaagtgtcatttttttttttaaacatacctgtgagctttgagaaaacgacacagtattt

SEQ ID NO: 95563 - DNA, 1018 bp, Homo sapiens
acaaaggaaaacaatatgtggtttaatttaaataaattcagtgacagcaaaaaggaaactatgtaggagagaggagcaagggggtgaggaattccactaagcaaattccatacaaaactggaaagcaagagattcccctggagagccagtgggtggtaactgggggacttctgctctaagaggacccgtgaaacagcaaacaggaggaaggaacttggtggtgggggcaaggggcagccacccagcaacacccccactaggagcacttctgtcctctaaaggcagtgagtttggggataattcattggacgaagggaaaagacaaggctgctacaagaagagggatgagggcaaccccggtgcctcccgccactgcagtggtatgcaggggaaagcaacaatgaaaagaggtacgtgccattgggtttcccgaaaaccaggggtctcgatgttgacaacagaggattcctcaacggcgactggctgtctcggtcattttcagtgagtgcttaaaaaaagatgagaggtttaaattaaacaaattttctgccttaccaaaactgacagtaatgtagctttctaggcaactaaaggctaagccagcagctcccagcctgtggactgtagtttttgcagggtccacgaacccaaatgcacaccaagcactgtctggatacccagagaaaataaaatgtcccccacaccaagtgtgccttttcccagaggtatgtggagactgttgtaattaacaacatacacattcatagaaggacactgctaatactgatttggaaaaaatgtatgtagtgaaatcccattttgtaaaactgaaatatatccatgcacacataaagtactctagaaataaatacactaaatctctgggtggtggagtaattggtaatgatgttaaacttttcaggatagtatttctctacaatgagcacatactgctgtacttacacgatttcttttaaaagttgaagaaaagccttagtgaattcaaagcagcatctta

SEQ ID NO: 95564 - DNA, 1126 bp, Homo sapiens
gatctcctgacctcgtgatccacccgcctcagcctcccaaagtgctgggattacaggcgtgagccaccgcaaccggccctacccttactatatttctaaaagcattcttcatgaaaatcagttttgaaataatatctgaaaacttgaagtccactgcataaatgaaatgagtaatcatcatttctgtcatatctctgtcgagattaacgacatacaaaaatctggattatgccacaagggaaatttaaatctaacataaccaaggctaacaaaagcacttgtacataagggatgggcacagcttatgggtcccccgtgcgggtgggagacactctagaacagtcactttcacctcttggtgatctggctcggctcctgcagatcggggtcgaggtcaaagacctcattatccagcagccttcgcagcgtcacgtcggccagctgctccatgaccttaaacacctcatccaggttcaggaacatggagaagtcacgctccttattctgcgtggtgattcggatggtatccgtcagaaagacattggacgttctttctaatttctggatatcaacccacggaaccacaagtttaactgtaagagaaaagggtgaaatacctattatgccatgaaatttgagccaaacttgagtgtgtcagcaagcaactatccaaagctctccttaggccgatgtgtaaatgcctttttaaaaaatcttttaagttcagggatacagggatacacgtgcaggtttgcaatacaggtaaactcatgtcatgcgggtttgctgtacagattatttcatcacccaggtgttaagcctggtacccattagtaattttttctgatcttctccctcctcccaccctccaccctcaaatgggtgcctatgtcagttcttcccctgtatgtgtccatgggttctcatcatttagctcccacttctaagtggaaacatgcggtatttggttttcttgcgtgttaatttgcaaagcataatggcctccagctccatccatgttcctgcaaaggacatgagctcattcttttttatggctgcatagtattccatggtgtacatgtgccacattttctttatccagtctaccaatgatgggcatttaggt

SEQ ID NO: 95565 - DNA, 1032 bp, Homo sapiens
gccacacagcattcaactctgtggctgtagctcaatttactcatccaatcctttattggatacttaattggcctggattttttaatagtttaaaagcatttaaactgttatagtttaatagtgaataccctggctgggcgcggtggctcacacctgtaatcccagcactttgggaggctgaggtgggcagatcacgaggtcaggagatcgcgaccatcctggctaacacggtgaaaccccgactctactaaaaaaaaacaaaaaaattagctgggcctggtggcaggtgcctgtagtcccagctgctcaggtggctgaggcaggagaatggcgtgaacccaggaggcggagcttgcagtgagcggagatcgagccactggactccagcctgggtgactgagcgagactctgtctcaaaaaaaaaaaaaaaaatagtgaatacccattcatgtcaacttttcaggacacttcacaatcccttaagtccatttatttgaaatgtttgttgcctgccacgtaccagacacatgcttgatgtcggagattctgcgctgtgtgtgtgaggggcagtctccctgcacctagcttttcaggacctgggggaaggcagatagcaacatgaataacaggtgcaggtgggcagagggctagggaggcccgagagaaaagcacccttgcagagcacatcctgaggaacggctgcatggaagggatgtgtgtttcttttttttgagacagagtctcactttgttgcccaggctagggtgcggtcatgcgatctcggcttactgcaacctccacctcccgggttcaagcagttctcctgcctcagcctcctgaatagctgggattacacgtgcacgcaccactgtgcctggcaaattttttgatttttagtggagacgggttttcgccatgttggccaggctggccttgaacttctgacctcaggtgatcctcccacctttgcctcccaaagtgctgggattacaggcatgagccactgcacccggtgggatgtgtgttcctaat

SEQ ID NO: 95566 - DNA, 1044 bp, Homo sapiens
cctgtagtctcaattactaggaaggctgaggatcacttgaacccgagttcgaggctgcagtgaggtatgatggtgccactgccctccagcctgagtgatagagggagagcccatttcttaaaaaagagaggctgggtgtggtggctcacgcctgtaatcccaacactttgagaggcccaggcgggtggatcacgaggtcaggagttcaagaccagcctggccaagatggtgaaaccccgtctctactaaaaatacaaaaattagctgggcatgttggtgggtgcctataatcccagctactcgggaggctgaggcaggagaattgcggtgaggaggaggttgtagtgagccgagattatgccactgcactccagcctgggcgacagagtgagattccgtctcaaaggaaaaaaaaaagaaaagagagagagagtgtgtgtcaaatgaatcagctaactgaaaaatacaaagaaggtatctatctccccaaatcccagccacccaaagtaacctctagtttcatgaggtgagcatcagcccagataactttctaagacatttagacacacagggatagttgagaagatggacagaaggactttcataaaaatgcaacttgtgtgtcagtggttttataacaaaagtattacacttgcttgatttcaataaaaggaaataaactgaaatgaaaccaaagaaatgttaaacttcaaataaatgtttctttagtacaagagagattattttctaaaaggttcaagtaaggttaagggaagagatttttgaaagcattaaaaggttagaattgtggcttttgaaaaacaatgtttgaagtctgatagtgttcactggctctccaccctctgagtcaagggtgccagcattcttattctcctccctgctttcccaatctctcatttaaaaaagttttattattagttttacattgtactttccattctgtcatgtaaccttactttattgtttagctcagttctcacttatacattgatttaatgcttttactcaggtatagatttccca

SEQ ID NO: 95567 - DNA, 1042 bp, Homo sapiens
ggagcaaacactatatatctaccacctgtaagtaaaaaaataagagtatatcctatgcctgagagaccccttctgtgttttcctgattacatttccctcccttccttgcaggcaccactaccctggattatgtgttaatactgacttgcttttctttatagttttaacacatttatatgtattcgtaatcaatacatagttcagttttgtgtgtttttgtaactttattacaaaatatacttttattcatgctttatgtatttttctgtcacttgatcaccccaccccctgcattatgtttttctcactttgacccatggtagctgccgtggttcattcattttcatggatgtgtagtaatccattgagtgaatgtattattatttattcattctcctgtccttggatatttgggttgtagttgttttagtagataaagctgctgtgaacattttcctgtagtgttcacacaggtatacatttctctagagaatatttctatgagtgaccttgttgggtgtatccatcaggatgagttaggttatgctgcagtaacaaacaccccgacacataaatttatttctctgtcatgctgtatattcaatgtgggtcagcaaggatctcttctgacggagaactgggacttttgtgaacagccctaatactgggtcatagctatgtgtattttcaacctttctagataattccaaattgtttccaagcagagcatggtggtgcatgcctataatcccatctacttgggaggctgaggcaagtggattgcttgaacctaggagtttaagtccagcctgggcaacatagtgagaccactgtctctaagaaaaaacttcccacagtggtacatccttgctaatgcttgatattgtcagagatgttactttttgccaatctggtaggtatttacatagtatcttagaaccactaagatactatttctcattgttactaatagggatgagaatatttttatgtgttcattaagtatttgtttttccttctgagaaatacttgagtcttttgc

SEQ ID NO: 95568 - DNA, 1029 bp, Homo sapiens
gggcaggactgtttcttgggagaactagttggtcattaagattatttttagttacaacagatgacagaaaaaaaaaacctgcaaaggacttgacattgttacaaccagacagtattttatctgaccagacagtgtggagtctggtttgatgcccaggaataggaatcactagcatatttataaactgtcttagatgtgtttgcattttagtttgttcaaaattaaaatgtaaatttagaaatgtcaagacatcatgggtttgaaggaagaaatttatgaagttggttcaatgcagatagttttgtagctttttgtataaaatgcttatttcatatacatgggaaaaaaaattgactcaacaccctttctctctccctctctctctctttaaaaatctggtgtatttagctacttggtgagttggaaaaagaccccaaacttgtctaccatattggcctcaccccagccaaacttcctgaccttgtggaaaacaaccctttagtcgctatagaaatgttgctgaaattaatgcagtcaagccagatcactgagtatttctctgtcctggtcaatatggacatgtctttacattcaatggaagttgtaaatcggtaagtttctagatttgatcaaatgtgtggggatagatacagattagatggccaggaaagaaaaattgtaacagatttttgtcttgatattattggcgtaagattaactattaaagaaataatgtaagccttagcattcactacatgtaaatttagcatgcgttaataagaactgagggtaggatttcaaacatatttagtgttagtagaagcataaatgaaatttaattgctgaaatttattttatttatttatttttttgagagggagtctcactctgttgcccaggctagagtgcagtggcgtgatctcagctcactgcaacctccacccgctgggttcaagcaattctcctgccttagccgccctagtagctggcattacaggtgtgtgctaccacacccgactaatttttgta

SEQ ID NO: 95569 - DNA, 2279 bp, Homo sapiens
gtaaatgtaagtagagacattttaaacagtgttatttatgagtaagtaggtatggctcttaggttaatttgcccaagtatatttaaaactagggaattggatatgtcagaaaattccaccagatgaccaaagcaaattttgtattttatggttaacagtgtttctcaatgttagcaaatgaaattaatgggccaaattttcttttacgaaacagactaactacagctgttgatctacctcctgaatttattcacctttatatatcaaattgcatctctacttgtgaacagattaaggataaatatatgcaggtaatataaatttttgtaaattttataaatggctgccaggaaaatgagcagactaacatttttttttttcctttttcagaatcggttggtgcgtcttgtgtgtgtgtttctccaatccttgatccgtaacaaaattattaatgtacaggatttgtttatagaagtgcaggcattctgtattgaattcagtaggatacgagaagctgctggtcttttccggttgttgaagacattggatactggggaaacaccttctgagaccaaaatgtcaaaataatacctcatcagaaccatcccatccattcactgttcagctgtactgtgatttagtttttacaccgttaaaaccctgagtggattgcttggtttaatgcatataaacagtactttatctacttaaagcaaagttttgctttcttgaatgactttttctgtgagatgaatttttgataagaactagggaaaacatgtcttttaggtgtcttgctgatgactatccataggaggaatggctatcccaaaaaaagttccgcaaaaaagtagatgagtttcttttttttttaagcactaaagaacaaaatgcatttttcattaatacaggcttctgatgaaccaggaatcctgttttcgtaaagttccaatgttgatgagagtaaattcttaagcatttgtcctagaggtgaaagcagctgaatgtttctgaaccatcaagaggcaaacaaacaggagtttgtttcttgaacctgcttatgcacacagctcttaactcctcatgaggcacacagctcttaactcctgatgaaccaaggatttactcataactttctccttgtcatggaggcttaatagacaacagaataaatgcatttcttgggcctcttataaacttgggaattcttagaaagctgcttctattaccaggctgtaatagctggtatagttttttttttttctcttaagatgttctgttattagtctgagacagccatttttttgttttaaggaaaaatatcagtcagtgctccgggaggtaatttcctgtggggtctgcaccctcctgtctgggtggtggatgtgggtttgagaagtaggagagcagggtggtaccgtgtgggctcttaccctttatgtgattttggacaacagtgccttccattaaagttctttttatcaactgttatctgatgtattttttactttaagaaatcatgagaaattccttttactgaggtattttcaaagcatatttacagggagataatctgttcaacaggaattactctctaacaccttgaaaaagttaaaggaaaccaagcctgtgatttttaagataagtacaagttccagtcttaaagctggagaaagagcagtactaaagatttataataaattgtctataataaattgtttttcttacaaaagaaatgtttaagaatgtttgcttagaggaaataatgaactaagcccatctatcagaggaatgccttcagacaattaaaatgatggcaacagagatttctttttacacctaaaagcgagcatccccgttttgcacgttagcattgggaaaaggacagcttattactgaagtactttaggagtggcagtttcaacaacccagctttaggttctaggacctacaggacctactgattctctggcataataaaacactgaactcagagccaacaccatcactcatgcctgagtgaagctgatctaacagacacttagtccatgaggcacatcacagccttgcccttagagcagcaggcaatattttgccacacctgaggaccattttaaatagtgaaattgccaacaaaaattgcagaaatgcaaaaaacatggtactgtgaagagactatgaaaggacacttgcttgtagtaggagaggaaacggcagggcatcccgtccagcctccgtcaggaacgtgcgggtcaggcagcttggctcattcgctgctc

SEQ ID NO: 95570 - DNA, 1331 bp, Homo sapiens
aaaaaaaaaaaaaaagaaacaaatattacaagagtttttgctgaaagttttaagttgataagatgcagagaattgggggaatgtataataaatcaggtttcattgttatattatttaccacatgaatcaccttcctcctaaccattataggagccatgtgttcacatgtcatgtggaccagtatttaactgtggaaaccgcgggtggcatggagaaggaggcagtgtccgtgactgtgctgctctccgcagccccctgcctgctgtcctgtttcctcggctcctcggtgtctggactggcgttctgggtttcccagcagaaaactaaagggccagagaggtgtaaaaacacacaccacttggcaggtaataatttccccgcatgctatctttttagggatcctgaacacacagcctttcccagaagactgctccctccagctactgaggaatgatgacaagaaaaggccgaattgcagtgtctccatcagcagtttgctctccatgggcacacgatgacaaaatatcctgaagcgaaccactagtctgacctcagtagcaggattggaagcttcatgccatgggagctgtcaagaaaggcatcccaaagagaactgaaatttaaaaataataatagaccttcaggaataggtgattgtccccatatactggggatgaaatacccaatgtaaccaaattccccagtaagatcacttagtttggcaatagtcttttcttttgagcatgttgaagtttatttgctcaatgaaggctgaaattataagtcagtatatatgtattactaagtagaacttgaggtaattatatgttttagtcaaaagcagtttctgtgggcttggtataaaccctactttgtgatttgctaaagcacaggatgttgactcaaaccaaaactagttttgtagttaatatgtgttgtgtttctgtgacttaatagtcaactagaaacgccacctacaacaacccaggtacttaagttttaaaagttttttttaaaacacttgtcaccatattttgaaaaatactaacatttggattactagttataaaagtgtaatttctactgtgtcataatcagccatgcagctggagacttgccctctttgtacagcaaagttgtgaaaaaaagtatttgcactacatttatttaaacattaggaaaaaaagccaacccatgcttttctttgccgagatgtagggctgtattattggctagtgagaagcctgggaacactaggactttgtgtgggctgattgcaggtatcagatccgggattatacaggtactgttggaagtatcttggggatttt

SEQ ID NO: 95571 - DNA, 1018 bp, Homo sapiens
attttctgttagccgggcgcggtggctcatgcctgtaatcccagcattttgggaggctgaggtgggtggatcacctgaggtcaggagttcgagactagcctggccaacatggtgaaacctcatctctactaaaaatgcaaaaagtagctgaatgtggtggcgggtgcctgtaatcccagctacccaggaggctgaggcaggagaatcgcttgaacccgggaggtggagttgcagtgagccaagatggtgccattgcattccagcctgggcaacaagaacaagactccgtctcaaaaaaaatttttttttctgtttaccatcttgaattatctccaagtgagtaagtgtgtttgcatagttgaagctcggaatatgctgccctcttctgatggagtagcttatgttgctctcttgcagaagccggcaggagtgactctcggcatggaggacccatctcctagcacacgtgcccactgaagtggcaccaacagaagtttggcttgaactaaaggacattttattttttttactttagcacataatttgtatatttgaaaataatgtatattattttacctattagattctgatttgatatacaaaggactaagatattttcttcttgaagagacttttcgattagtcctcatatatttatctactaaaatagagtgtttaccatgaacagtgtgttgcttcagactattacaaagacaactggggcaggtactctaatataaaggacaggtggtgtttctaaataattggctgctatggttctgtaaaaaccagttaattctatttttcaaggtttttggcaaagcacatcaatgttagactagttgaagtggaattgtataattcaattcgataattgatctcatgggctttccctggaggaaaggttttttttgttgttttttttttaagaacttgaaacttgtaaactgagatgtctgtagcttttttgcccatctgtagtgtatgtgaagatttcaaaacctgagagcactttttc

SEQ ID NO: 95572 - DNA, 1074 bp, Homo sapiens
cagtgctttgggagtttaaggtgggaggattgctcgagtttgagctatcgaagagtaagtaaccagaaatttgagaacagcctgggcagcatagtgagaccccatctctacaaaaacttcacagattagccaggtatggtggcattctcctgtagtcccagctactcagaatgctgaggcaggagagtggcttgtgaccaagagttcaggctgcagtgagctatgatcctgtcactgtactccagcctgagcctgggtgacagagcaagaccctgtctcttaaaaaaaaaaaaaaaaaaaaaaggaattttattagtagctgtgaaagaaaataaagaaatacataaagtgcagaaaagcataaggaaaaaatgaaaatagtcgtcccccacgtagagatgtcatcttaacactttgataattacctttccagatgtttttctggaaatcgaaaggtgtttaagggtcggtgaatatcacttatgggctgttaggtaacctactttttacttaatatatgaagctctttctatgttgataaatagataattttttacagctacagagtattacattttgaattttctataatttcttgaaactaattaatgagtgtttgtattatcagtagcactttgaaatcattatgtatatatacttatgccttgtctaattgttttctgtcactctgataggtaaaatgtagtgaactgcatgttttttgttttgttttgttttttgtgttttattttggtttttgagacagggtcttgctctgtcaccctggctggagtgtagtgatgagaacacagctcactgcagcctcaaactcctgggcttaaccaatcctgccacctctgcctcccaagtagctgagaccacaggcgtgtgccaccacatctagctaactttttaaatttttttgaagtgatgaagtctcaccatgttgtctagactcattgcattttttaaattacatttttgtcctcttttcacattgttggtcatctttattctttgatgaactgcttattttatccctagcttatttttttatggagatagtaatttttt

SEQ ID NO: 95573 - DNA, 1237 bp, Homo sapiens
aacatcagacctcagaaacttactgtcttgcctttgacttttgaatctttagacagtacacccttttctgtggacctgttgaccccctcctgcagtgtatgctttagttagccatgctgtgccctcttatagtaactagttttctatttccccataactgtagtgagagtcaccctcagtcaaccacacaggctttaaaggtttacagctgtaaccatttcagtgtgtccatgtcacttgttttcattcatttggcaaggatgggtcaaagaaatgacatctaaggtgctagatctgcacttggctctggggagacaaagatgagtaagacacagcccctcccctcatgggctcttgaagatttcactttctggactggtagggggtcagggcacgcatacagacatgacatggccaaagaggcctgtttgaagtgctgcccgtaggagcacagaggaggggtcacgtgccctgctgccaggtagaagttggaaggtggggcaagtgcatttgagagggcagttgagctgggtgttgcattatccatcagacacaccaaagtgttgaggctaatgctgtgtctgtggagtgaacagacagggttggaggttggcaggtagttaagttggcagatatttaggtaaaaaggttggagctaggctgggcaggagtttgggtattgtgatgtcacagccacaggatttgttgcttggtgtgtcaggagtagggatgggagggcgttacgttactggtgaggcaggaggggcaggttctagaacacaggtggagcagggctgtggggggcacagcccagtggagggaggaggggtgcccgtgagtggtgtttttacttgaagcaatggtgagatgctgagccagaaggtcatagtcaacctgcagtaacccctcatctaataagtcactttaccaggagttccatccacttacaacacagctttgactctggtattaatcaaataaagtttctagctgtcccccaaatgttgagacttaatgcagtgatgctgatagtgtccccagccctccactttcactgtcttcctttctttaaagcagcaaatggaaggagggagggaaggtggagacaaactacagctgatcaacaccctgtccatacggaaggagccagagtaactttttcaagaaaataatacagtctgaaggcatctgttcaaaagccttgtttatttctgaaaccctagtgcctcactgtaaa

SEQ ID NO: 95574 - DNA, 1581 bp, Homo sapiens
ttgtaaaaattatttcttaagtactgttttttttatttttttgagacagagtttcgttcttgttgcccagactggagtacaaggggtgtgatcttggctcactacaacctccatcttccgggttcaagcgattctcctgcctcagcctcctgagtagctgggattacaggtgtccaccaacacacccagctaatttttgtatttttagtgtagagcgggtttcaccatgttggctaggctggtctcgaactcctgacctcaggtgatccacccacctcggcctcccaaaatgttgggattacaggcgtgagccaccatgcccggccgcgagtactgttacttttaactccactagcagatttctgtttgtaaaaaagtcttcaaacaacagtaataataccaaacaattaccaagtatgctctgtgcctggcacagttgtatgcacattgcatgtgcccctctaaccctggtgtggggcagagtgtaggaacctagttcagagtcccagccattgagtcgcagagctcgtatctgagtccagcctgtctggctctgaaacccatactatactggtaactccttttcttcatcacttgcagaaaatagatctatcacacaggaggaaaagttagccaactgagacaaatcagcaaaagaagaaaatatgtctgcctttttttttattctgaaagtgataggtgttcattatagaaaaatggagtgtatacaaaactgtgtaagagagtaaataagtgttgcataagcctaccaccgcaagatgatctgttaatatttttgttgttatttccatttgagtcattttatggacttatgtaaggtacttccagtttagtattagtttacttattactactagttgatttatgccacattttttcccaaaaagctttcaaataacttacagaggcacataaaaatgtacaacctagcgtgagagcataaataagccatggtttttgtagagtgaagggaaaatttccctagaagtgccagattctgtttcatatggaagagagaataatgacatgataagtaagtagactagaatgtttatttgacatcagctaacttgtaatgagaggatgagttggtacaatgtcttatttcctttataagttatataaacattgattttaaaaacattaacacatacttaatctttttaggcatatttttcatagaatatgcattgacccatggcttttggatcaccgaacatgtccaatgtgtaaacttgatgtcatcaaagccctaggatattgggtttgttacatttttgtttatattcaatctctgccccagttcttcctgagtgattcagtttcattattgactagaaacaagaggaacaggtgaaatgctcctaatatccttgtagttctctgaagaaattttcctcattattaaaaatgagttattaaggcagtgtaaaaaaatcagtgaaataaatttatgatggtagaataatatgctcagatgtttcccagagagtttgtaattacttacagagtaatgtgttttggcatgctgcaccacagaatgtatgtatgctagttttg

SEQ ID NO: 95575 - DNA, 1067 bp, Homo sapiens
gtagaagggaattcgtcattgttttagtccggatgtagtgagtttaccaagggatatactgtgtaccaagaatgtagtaacactttccttttctttttacagggaattgatgttgatgctgaaaattgtgcagtgtgtattgaaaatttcaaagtaaaggatattattagaattctgccatgcaagtatgttctttttacatattgagatgttaaaaattacttgacaagttttaggtgtctgacaaaatagttatttgttttttatgataatgaagatcttgtaatttgtgatcatctcttctttttagaaaagcagcttggattttaaatataatatcttccctgccctttaagattgctttgcctaggagattcttaggtgacactaagactcgttaagtatctttgtcgtagattgacttttagtcttctaagcaaggctttatcagaatcctaggaattccattatacatttagcagtgcaaaaagtaagctgtgttgggagcaaggaaaatgagggaccagggagaagggcctgaaacagcctaagggaaataggttgaggagggcagtagtctgctgttatttgcaccctgggcttgcgttccttctgaggttgtttaaaatcaatattcctggctgggcactgtggctcacacctgtaatcccagcactttgggaggctgatgcaggtgttcaagactagcctggtcaacatggtgaaaccccgtctctactgaaaatacaaaaattagccgggtgtggtagcgtacacctgtaatcccagctactcaggtagctggggcaggagaattacttgaacccgggaggcacaggttacagtgagccgagattgcaccacctgcactccagcctaggtgacagagtgagactccgtctcaaaaaaaaaaaaaaaaaaaaaaaagtttttctttcctttattctggttatactaagggttttgttttagtagcaggaagttgcttgaaggaaggcagggcatggtggctcatgactgtaatcccagctactcaggaggctgaggcatgagaattgcttgaacct

SEQ ID NO: 95576 - DNA, 1183 bp, Homo sapiens
gcaagcctgtagtcctagcaactcaggaggctgaggcaggagattcacttgaacccaggaggtggaggttgcagtgagccaagatcgcgccactgccctccagcctggcgacagagcgagactccgtctcaaaaaaaaaaaattaattaattaattaataataaaatgtttactgcttccatattgacaggtggtgcacatggctaaatatatttttaaatacagtaattacataagaacagtgtaactgtgttccataaaatgaactgcctaaatttgcagccacatgctgatactgattggtagtccctgagtctctaccccagcatcctgggaaagagaatcctgttggcctatcttgtgtcagatggccactgtggccctggctgccttggttgatgggtgagaccaggtgtgtagatccaggggttagccagagaagtagggagggctgattaccaccaaagaggtccatgacccatagattcttagaagtggaaattttgtcacaagactactttctccccagcactttttgtttctttgtacctttattaagtagttagatgaaaaatggtaacttactctaatttgtcattctttttaatcactagtgaggtaactattttcaaatatttagccatttacattttctcatttgtgagttgtaattccattctttagcaaatgtaaatacgttactttatatgattccagaaaactagtagcttatttatatttattctctttttattataagttttatgtttgaaaaatagtttattttataatatagcagacatttgcatttctacagcacttaaaacatgaatactttttaacaacccgtgaacacttgcttagtatttaaacattttaaactgtacaaaagtgttttcttcagtctacatcatattccattctagagagactagtgttgtctaatttttattttcttgtagactcattcacagtaatggataaacttgcaaaccattattagagactttaaaaattatttcatcattcttgccctgtgtatgataaatgatagtatttactttcattgaaacatataattttaaatgttgttgaaagttcctttttttgttttgttttttgagacggagtctcgctgtgtcaccagggtggagggcagtggcgcgatcttggctcactgcaa

SEQ ID NO: 95577 - DNA, 1026 bp, Homo sapiens
ttgcggcagtatcacttcccccacccccagccttgagattgtaggtgttaaagaaccttttaaatctcagttaatcttctgtctcccactcatctgttcatttattcaacaaggtacctttacatgtatcttagtcaccagccaaactgggctggtcaccatcccaaatatattttgttgtggtctacagtctagaaaccctcttcctttgctttgtaaacttttttgtctcctttgagatgtggctccagtgtgcctggggagatttccctccaccccaagcaaaattgtctccttacttctgtagctctttgttactctgctttcttattgaaaaagtgttagtccaaaatagagtcattctcattcccattttgtagctgcagaagcattctcagtgaccatggatttttccaacctcccaggcagtggataacagtgatttttgcacccaggtctgtctggctgtgaagcctgtgatcctatgaaggcggatggggaagggacgttacctcggagctgggtcttcagactttagaactggctttttcaggtggtgtgtgacattgagcaactccctgggatttctgaacactcagctgtagaatgatagtgtggcctttgcctgcttcaagtgagacataaatgtgaacgtgttcttccccattaccacacaaagaacgtggtatcagtaccagaaattgattcaactgtcatcatagcatagtttagttttctgtgtaaaagcttttaactgaggtgggaacatgagacttcgttgtactattctttctactttgtatgtgcttgaaattttccacaaaagcaagtttacaaaaaagacttctagcttgcaaagtgccatatagttatatcagatataaccatcataattctttctatatacatccttcttaactactagatgtttagaaaatgccttcctcctttgttgtgtccccttgtgatgacatggttggttgtgtgggtgcctcggaaatacagttcttgccaagggaccctttt

SEQ ID NO: 95578 - DNA, 1117 bp, Homo sapiens
gtaggagtgatacacagaactttccagacaatatggtttggacctcatataattccagtatgcacaggtgcttaggaagcataaagaaaagggtttgcttttgttttgttttgttttgtttttgaggcaaggtcttgctctgtcacccaggctggagtgcagtggcatgatcttggctcattgcaacctctgcatcctggactcaagtgatcctctcacctcagcctcccaggtagctgggactacaagtgcacgccaccgtgtctggctaatttttgtattttttgtaaagatggggttttgccatgttggtcaggctgttctcgaactcctcagctcaagtgatctgcctgtcttggcctcccacagtgctgggagtgtaagccaccacacctgtctaaggaaagggatttaatgcaggtattgcaaaagtatcaaagtaagcttgaccaaggtaggtggaaattagtaaacatcaaagcactacaacaaaagcttttacaggatattggccttaaattaacatacatatgtttgttaacaaataggctgatcctttaactgaaatcttagcgtggtcttttaagaatggcactttcattttttaacagttatttactgagtgccaagtactggcaaggcttggagctatatttgggaatctgccagagttgggtggcaggggaggttacaaagaggtataagaaatccctcctattgattagaggtataagaataaaattaaaaaagaaatccctgaactctccaggggaggttacaaagaggtataagaaatccctcctattgataagaggtataagaataaaattaaaaaagaaatccctgaactctccaggggaggttacaaagaggtatgagaaatccctcctattgataagaggtataagaataaaattaaaaaagaaatccctgacctctagagagttcacatgttgagaggggtgtgcagtttgtatttgcagagcaggttaaatagtcttttatgaatggataataaattcttgatgctctgtaatgctacactctcacaaatgatcgaaaaatttagatttgaatttaaaatgtattttggggtcgggcgcagtagctcacacct

SEQ ID NO: 95579 - DNA, 1008 bp, Homo sapiens
tcgagggctgcgcgcccgacacgcgcttcttcgtgcccgagcccggcggccgaggggccgcgccctgggtcgccctggtggctcgtgggggctgcaccttcaaggacaaggtgctggtggcggcgcggaggaacgcctcggccgtcgtcctctacaatgaggagcgctacgggaacatcaccttgcccatgtctcacgcgggtgagcaggccggggcgcgaggacgggagggggacttcgcggcagccgaggctggggtcttcagggttggccctgaaccgcaggccgcgaagcgggcctggcacggctctcaggcctctggctgttggaactttcagggaagccctcgtttgctcggtgcggctccccgatcgctgttgggagggaggtaagtctgcggacaagatgtgatcttcgcctttgatcgatgaggtgaagggagtactaaagacgttaaaatccacagaaggaggcttgtggttctaacaggtgaggaaatctcatgattcctaatcatgggcctcttttccattcaccgcttcccaaagtcggaggggtgagtaggaatccaaactcttcccccagcgcgccccacgatcggttgtcccttcaccaacataaagtgatggctcgttggcactctggtttcttcactttcttgaatcatgtctgaatattctaaactgagtcagaaaacctgcatctgactgagtcagtaagccttgacctgtgctttctgacttgctaaatttagggttataacactggctgtactgccagtcagatttcctgagtcttgagttacgatcaaaattttaaaattactgtattcattcaagaaaagaccttggggccgggcacagtggctcacgcctgtaatcccagcactttgggaggccgaggtgggaggatcgtttgaggccaggagtgtgagaccagcctggccaacatagaccccatatctgcaaaaatttcttaaaatcgcgtggacgtggtggcgcccgcccg

SEQ ID NO: 95580 - DNA, 1022 bp, Homo sapiens
gcgatactgcggagagtccctgccctgtgatgacccattcaaggattctggacacttggatctcctgacatcagagcaaggtctggctgattttgcagagctaatcaaacacttgaaaagaacagtcctaggagctgaaaatcaccctgtcacggccctctagggcccctatggtggcatgcttgcagcctagttcagaatgaaataccctcatatggtagttggagctcttgcaacttctgcccttatctggcagtttaaggatttggtaccttgtggtgtatttatgaagatcgtaactacagattttaagaaaggtggtccatattgttcagagaacctccgtaggtcctgagatgccattaatcgactctcaaatatggacggtagtttgcaatggcttcctgacattcgacatttgaaagactagacctctgaagactgggtgacgtgcagtggtgagctatccttatgcatctaactttttatagcgttttttgtctgaacttcactcgtggaacttgaaggagttttctgataactgttttaaacagtggggtgtgagacagaggccctcctggatcactacggtgtgtggaggcaaaaacatgagttcgcacatggacatcattttcagcaatggcaaactagacccctggtcaggaggtggagtaaccaaggacatcacagacaccttggttgcagttaccatctcagaggggcccaccgtttagatctctgagccaacatgggccttttgttccatgtctgtgctgttagccccctccttggaagttagacacatgaagacatggatcagagatttccaccacagggcgggagaaacttttgatcatttttagtttctccttttatattcacatcacccacattcatgttcactttggttttcttcatgtagttactttcccttgttcctcactcaatttgatggcaccgaggggagacagaagagagggtgatggtggtgacagcagccatcccaggagtgtgatttcctg

SEQ ID NO: 95581 - DNA, 2642 bp, Homo sapiens
gctgccgcgcgaggagcgcggtcggcggcctggtctgcggctgagatacacagagcgacagagacatttattgttatttgttttttggtggcaaaaagggaaaatggcgaacgactcccctgcaaaaagtctggtggacatcgacctctcctccctgcgggtgagtgggcccgcgagcgggcgcgcggggagcgggcagccggcagccggcagccggggccgcgcccaggtcggccgggcgctcgggcgccgccgtgggcagagccgcggggcgcggcggcccctttgtcttcctgtgcgggctggtgcggggcgggcgctaccctctaccgcccccacgccccgagcccgccgcgcgacccccgggcgctgggggaccgcgcggggcgaagcccacctcttttgtcaccgccttttctctccaactgccttgcttgatttattcatttttttggcttcttttaaatgataacccctcccctccttcctctccaggatcctgctgggatttttgagctggtggaagtggttggaaatggcacctatggacaagtctataaggtcggtgtgggcgccttctttgtttcccgtggcatgtggaaacttcttattgggggacgaggagagggtgataaacatgctgctgactggaggccacgccgcttggccaaagttgggagaggggtttctttcgccttgcagtccctctgtttttgcacaccgagtttatattcagactggccttaaaagacctcatttcctggctttgagataaggaaataagctacactcttaggcatgcactttacttcgataaaatggaaaagcattttttaaaaataagacaacctgaattttttctttttttccccaaatccggccttctgagtttgtgtgtaaattgaaatacagtggaggcgggccttgcctctgacgatcctaaaccactgctttggccatcgtgaaaattgtcatcatgtttcagcctccactcagtgcttgccagttgctcaaggtggggagtttggcgttacctgggaatactttataactgtggttgtcatcctttctattgatggatacgtattttggggaagcagggaggagtgtgtgtttgggcaacagcagcaggaagaattacagtgtggggattataaaatctgaattccaggaataacctgtttgacagctgtgtaattgaaacagaaatgacagagagcgaagagaatatagaggatgccctggtttacacccacccaggtctttctcttttttcaaaattttaacacccaccctccaccccagcgataaatgaaactagcaaatctggagactgagtctgcgctgagtagctgacacctgatgtgactaacagtgttcattttatacattgtacagtctagagattatgaaagatgtgtagggaatggaggcgcaggccttgaaaattcagaacggaatgttaaatttttcctgtcttaatttgtttctcaatactgaacgttttctaaaagtttaatctgcactgggggagtgttctgttagagtcggtacaaggttagggaagcagggctctgtggttcaccatgaagaattgtcattgtctcattaaaaatgggtggagttgggggggttggaagccgactgtagaccttttcttaggctagattaagtgtggatcttattgtctcttttctgcgttgtgagtagagtttatctatcacttgaacgcctctccttagcctagacttctagcctgggtagtgtactgtactggactgtggtccgaacttgggtcagtattcttaggtgatctcaagtgtattagcttgtgttttgttggttaactgttcgggccggggccagatttttgaatttgaaagagagccccgttaactcagcttgcccggctcaactgaatttggaaggctttggaaaattttggaaaagattgtgttgcaactcactgagtggttggtaactggctaaaagacattctccccggtctgttgtttgtttaagcaccagtcattttttttctaacccagttttttctcgccaaattaaatggtgattgtagtcttccaagtgaattagccagagcttgtttttgacctggctacacagtagttggattgtttgtgtcttacttggtcagcatggatgttaagggcagagaagtaagctagaaggcgatatagtctttaaaccttaagagaaaggaaagaatgaaaccccagtttgtctttattggttttaagaggtgggagctgtttatggtaagagtttagtcaggttcattgttatttcccctcattgccattttggttccattccccgcaaccttcccgagcttttgaactaggtttgctgagcgctagctacgtttggtaggtatttgggatactggcatgacacagctctctgactacaaagtcggtacagttgagaatttctctaattatgcaaacctagggaattaaatctgtgcaaaagttgcctacagtccagaacaaaatagtgcctgagattttgctcataagcagttacatttttatattattatggaaaatttcaaacataaagactagagagctcagtttatcagcagatgactaatcttttctcatctgtattcttct

SEQ ID NO: 95582 - DNA, 1427 bp, Homo sapiens
tgtggatgtgtgctgggccctgttctgagagttagatacacagtggtaaatgaagccgatgatatatctacccttatggaactcaagaaaaacagggggatggacacaaaatgccagctgtgggatgtcagtcatacattctgtgttgtctgcatctccctgggttccctgcccagcacacttgtgttcagacacaatgaatgcactgacacatggaaacagcacatactgcaatgtgttcattttaagtggctcaacctcatcagcagggcttctctgtgctttaaattacagtaaaaacaaatgaaaagtgaaatgaaaaggtagacatatagaatatcagtctactttttttactcgtagaatcaaaagacattttcccatgtcaaattgctgtaaaagtttttgtttttgttttctttttaaaaaagtataagaaactcaggtgatataaaagtttttatatacttttaatttcagaaatgatcttgctgtggtcagcagaccacactttgaggaacactgaactggcaggattgaatttgtagcagggctcttagtaaactgtgggtggttggtgtgttagtgagctggagaattgaggactgttgtttgtgcctagtatttggttctcccaccctttgaacattggggagctacagcaggtgctgcttacagctttatgctttagtgccaaaacgtctttgacccctgtgctttggaactgtctcagatatggctaaatatgaacaagttatcctattaaatttaaataaatgaaagaaaaaccccacttttacattataactttaaaaaatccttcatatgataaatagggccttaacttaccagttatgaatcgatagttataatcaaatgatactaaagcgctcataccaaaagtcagagtcatcctgttctccagaagcatgttttcagtgcttttagctgctacatctgaaatttattgctatatttgtaaattatgtacttatgtggctagttcatttatcagttttatacatttattgacgtcctctagcagtagttgtagttattgaactagttagttcaatagtagttgaatatttaactcctatacttgctgcctcccttaagtgggcataccataattttgggttaaagtgatagttgtttcttttatcatgactatgtaaataccatttatatgtgagctaaacagtctcatacgattacatttccttttttaaacaacacccctgcccccacatcgcttttagtttttcatttgcttagttttctttgtacctatcatcaccttcctcctcagataccctaaaaggtataacaaatgcctaacaaagtttagtctttatcacattttccaaatgcttaatttaacaccacacgtcagataatttattgttgcaagataacctgttgat

SEQ ID NO: 95583 - DNA, 3206 bp, Homo sapiens
ccagtcttattattagtcattactgtgagtttatttatttatattttgagatggagcctcactctgtcgcccaggctggagtgcagtggcacaatcttggctcactgcagcctccacctcctgggttcaagtgattctcctgcttcagactcccaagtagctgagattacaagtgtgagctaccacgcccagctaatttttgcatttttagtagagatggggtttcgccctgttggcaaggctagtctcgaactcctcacctcaggtgatctgcccgcctcggcctcccaaagtgctgggattacaggcgtgagccactgtgcctggctttaagtcatttttaaaaacaagaatacagtttctttcttatcgctatgaagacaaactattcactatcagcgaggtcactggtagtaggaactaggccaaactagtttttccttctatttttgggaggaattcccttgtataatagccagctatttaccatgtgatgctagactgcagttttcctttatctcaagcagaagctattgtcttgcctggattttgaaaaaacaaagcaaaatatgttatctttggtcagaaggatgtatcccaagttaaataaatgatttgctatgtgttttgggcgaataagtttgctcatttgtttcaagtgtatttttcagagtatttttcttatattttattcttaagtttttttgtgataccttttgttagggccttactgcattcagattacataaaattaagttaagtaatagtttattttttgaaaattcttatactgcagagctttcgttcttacttgctgtgacagtgacagaatactgttgactaccagagcccttctccccctgagtttttctgagactctttatgtgtaattggtgtgtagttttatgacttcaattttgagaggtatgtcaaagactgaatattatctgagttagggctgtgcatcaaggtacttaataatttgttggagatcccggttgaatattgcctgaggttgagtgtgtacatttaagtgacacaattcactgggtgtattcattcacctgctagggcatgactcagattctagggccattccagtttgaacttggcatattagagcatcttagttctctatatgtacacattttctcatttattcttgttgccttccttgattcccagaaaaatctgacaggtgttcagctctttactcttcagtgatttcaaggcttggtttctgtttcttgtttcactgtctacagatattttgagcctactctgctagtcaagatttcctttatttatttatctagtacttaatgtgtttataatatgtgccaggcaccatgcgaggcttgctcactggtgacaatggacaagaaaggcagtcagcttatgcccttgtgtagcgtatagcctaatgtgtaaggcagaaaatgaacacacagttaaagaggatgatattgcagatggggaatagcaggggcctatgggagtgtgtgacatgacagctaagttagagctgataaaacagatacggtggtatgcacagtgaagctttatgatttcaattcagatgctctagatgaggcatagatatatgtggagcagtgaacagtctgctaggagttaaaacccactgagctgatgattcatcatcttggttaatactactttgaataaagataggaggggtgtgttccattgattatggtaattgactgtcttcattcagtttgccttgagccagctgtctctcaggaagccttgcctcctacatctgcactgtttggtgctccttgcatttgaatctcctgtatcagttagaagttagcatcctgaacattctcatatgggtgaaggaggggccttcgtcaggcttcagattgtcttatgagcaatatctggaataatatttggtaaacagctggcctgaagtaggccacattctgccctacattacacatggggagactgctttgttcagctgctggtccccacgacgttagggctgaaagggacctctgtaaaatgggaacaatggtgtacaggtttgtgatattcacatagtttttaataagtttctgtagttccggttatataacaaaataattaaaagataaagtttttttgcttttttttttaagacagagctgcaacctctgcctccagggttcaagcaattctcctgcctcagcctgtcatgtagctgggattacaggcatgcagcaccatgcctggctaatttttgtatttttagtagagatgggttttcaccgtgttgatgaggctggtctccaaatcctgacctcaagtgatctacctgccttggcctcccaaagtgctgggattacaggcgtgagccattgggcctggccttgctctttgataatatggacaaaagagaattttatttttctaatccgattaggtaaaatgatgttgtggtttttttttgatgttgagtgagatatttctaaccattctctaatcatactggaaaatgggactttgtagtcccattagtatgctggctttcaaagtgtgaaattctttttgcattattttgtataagcaagggctttgtcagtcatcaactccaagattgtattagacgtttcattagttttctagttaattagctgaaaatatattcttattgttatatgaaaaaagcaacttaaatgttgaattttaaataggatgcttatttatttttttcttgtctttatactgtttattttcttgctggctctatcagctaaggacttgatctcattggtagtctgtcttgccctttttttttttttttttgctttttaatgattccttttgctgacttattacctataacttctacttaggttgttttataggttgctttaggtttgtagcacatgtttttaacttaccacagtctaccttcaaatgatattataccttactatggtatacctccatttctacccacttggccttatagttttttagtatacatttcacttttatttattatttatttatttttatttttttgagatggagtgtcgctctgtcactcaggctggagtacagtggtgcgatctcggctcactgcaacctctgcctcccgggttcaagtgattctcctgcctcagcctcccgagtagctgggactacaggcgcaggccaccatgcccggcgaattttttgtatttttagta

SEQ ID NO: 95584 - DNA, 2268 bp, Homo sapiens
tgagaattgcttgaactcaggaggcagaggttgcagtgagctgagatcacgccactgcactccagcctggggtgacagagtgagaccttgtctaaaaaaaaaaaaaaaaatgctgggtgcgatggctcaggcctgtaatcccagcactttgggaggctggggcaggtggattgcttgaggtcaggaattcaagactagcctcaccagcatggcgaaaccccgtctctactaaaaatacaaaaattagatgggcatggtgggtgtgcctgtaatcccagctacttgggaggctgaggcaggagaattgctggaacccgggagacggaggtagcagtgagctgaggtcgcgccactgcactccagcctgggtgacagagcgagactccatctcaaaaaaaaaattttctaatttcccatcatctgatcctaccaaaaataacaaatacctagggggtttttcatttcatttacaatctggaacctcatatggccttatgacaagagccaatattttaatatctttgtcttagaacctcactcatacaatagagacaaacctcaaatccaatccagagagcattgcttcaaggaacagtggtgacttaagataggttggaagtctaatggtgctgcggaatgctaaacaatcaagccttttcaggtttagtttaatagttgttattcttatactttcaaaaccattttcatgtaatttttttcaactatttattaaatgttagtaaaagaggaactacctgaacacagattttgtccaagcaacctgtttagaataaattatagggaaggaagttttcgctaaaatgcatttcctgtacttgtgaagaaacttgttgagaaattaactttgagaaagttatgccatctttatgcaacatatttatatagttaagaaacataattttcttacatttcaaaagaggctgtttgacaaaaacggctagaagacccctccctacacagtgagaaataacattctacaattatgttatataactaatcataataattttactttctccaaataactataagcaccttatcttccccgttatcaaaaaaccgtgagaaaatgagccttcctaagaagtttgacactgataccagccaactctaaatcaaaatggaaattaacattcctttctaaatcatgtgcagaattcatttgaacattctgataatttccctataaactctgatacgtaaatgttggggctaggaggaggcttgaagattatcttgttcaaactctctggtaaaagaatgtatctaagatttgttccataggctgcagtccacttcgggaatcatggaactcatcagtcacataaatggaactaagataccttctcatagttaaaaaaaccagcttaagaaattcttgccacccaacttttcttctatgaatctctcaataatttttcactattcagagaatgtggtaaaaataagaggcttcaagacccaaaagaacaaatgtatgggaactccatacctgcattagtctgttagggctgccataacaaaaggtcacaggctgggggcttcagtaatataagtcattttctcatagttctagaggacagaagtccaagattgaggtgttggcagagttggtttttcctgaggctcctttttctaatttgcaaatggccaccttcttagccttgccttttgtgcacccctccctggtgtctgtgtccagatttcttcttacaaggacagcagtcagattggattaaggttcactctaacagccttattttaattcagtcacttcttcaaaaggccttgtttctaagtctcaatcactttctgaggtactggagatgagagtttcaacatgtcagtaatttttgggggatcacggtttcagcccataacaatactgtaaagtttttcttgtactgaagacacagaaaataactttactctaaagtgctaatgatttattaactaacacaggtagaatatcccttatctgaaatgcttgggaccagaagtagttcagatttttttggattttggaatgttcatattatatttcatggtataatatctctaatccaaaagtctgaaatccaaaatgctccagtgaacatttagtttgagagtcatgttgatgctcaaatggtttaaaattttggattagggatactcaacctgaaaattttgaaccttgtttttttaaactaaaaaatacatagggtcttctaatccaggggtccccgacttctgagtttcagacaa

SEQ ID NO: 95585 - DNA, 1301 bp, Homo sapiens
atacagttcgtgttttcatggggtttaaagaaggcagtaaacccatcagatggtggtactatatcagttagcctttgctgggtagcaaaccatgcctgaaacttgctggcttcgtgttgtataagcatcatcatctttgttcatacttttgtaggtcagtaatttggactggggcatactcagtgtggtagtgtggtggctcttctatccatctcttctaggatctctccggaagctgaagtcagctggcagttaactgggggctgcatggtgtgacttgggttggccgactttttaagcaccctggccttttgtttcccatatctcagttttctttttgtctcctttcttccttttgttgttcactaaggaatatttaaaaagtttcgagtattataaaacattcaacttttggggaatgagatggagatataataaatggagataaatatgtacatttaatatcttcattttacaaaagaatctaatcaccattaattacagtgttacagtatgccctgttacagctgagagttagggttttgcatccactaatttgggtagggtgacaatagcaaaatgataaataagtcatgaatttagcctgggcttttggtgctcaaataccttaattcatggatggcaacaccaacactctacctgcttttcttagctcaacaggaaatgagagtagggcttgggcaggaggaagtcatgcatacccagctgtcagcgtgcggccttctcattggttgtttaggagagcaaacgaagcttatctccttccccaaattgttgataatgaaggcgaaaagagatatagctacaggtaaactagattgaatctgctgtttatgtgttggaagatgacgtttgaagatgagttttagttcttagcaccaatacaacaaatgatgggatttgaggtttaagtgcctaagtttaaggctctcatataataactcttaatttctttttgtgtcgggaaaagaacaaactcttgccttgaattaaccagttattttaaaaaatcatagacttctgtcattagaggaaacggcctgaactccattaccaggtgactttttagctttagtgggtggcacatgggactgtctgtggtgtgccatctgcagtgcgcaagccatttgtttctggaaacagtctcacaagcaatgattctggtgagtttagaaatgaatcaggatgtgctaagctcaatgaggactcattagccttggataatgtgattctataaatgaacagaatggagacggtgaagactcaggagtatagagaaa

SEQ ID NO: 95586 - DNA, 1538 bp, Homo sapiens
ggagtggaagggtgggggatggggggtggggtggtggtggggtggatgggttaagggtgggattgagaggcaaaggaggtgctgagaggagcagaagttgccagtcctgaagctttcctttttctctactttcctgtgtcttcctcagagcctctcatactctaatgtgcactcagtcatcttgggagcttgtgaaaatgcagattctgatttcagtgcatctgggaatctgcatttctaatatgcttccccagtgatgctactgtaattccatactttcaatagtaaggagtagtagggcaaagaagttagcatgggaaatgttggtagttcactggaacacagctgctagggtgggttctttggactagggttatgtcttatccatgtggtgtaaagtgtattgggtatctgtacattcaaatcaatgattttgtgaacagattacaactttcagttgggactgtagtctttctgaggctcacaggatgttgatgtaggaagaggtgttagagaatgtgtagctcaaccccttagcttacagagagtgagggactttgtggcctagtcagagctagggttgcagatctggcctcttttatgctcttcatctgtctgggttgggttggaaggcagtgcagtgaagtgctactgtcttcccccctactatttgatgatttggtgacatgacaaggtcataaatggattatgattctcaaattccatttcagtttgtagtacatttcctgaacaaaagtaagtgtttgagacagtgaatgaataaaagggctggtttctgggtgaggtggctcacagagttggtcagaggccgggactgcccctaagccatggcagtaagtttctagtgaaaatagatgacaaccattttggtgttttggagaaggcagcagacccagacagtggcaggcttttaggcaacagctgtgttttgaggccccaggaaagagggggaaagtgggcaggtgtaagtacaatcagggagaaactggggaaagacttttaggcaagctttttggttcttgattatgtggtctctcttgcacctaggaaagcagacagtaaaatgcgtcgtgttggaatagaaaattcaagcgcctgattgtgagaataagagttcaaaaagggggccaggcgtggtggctcacgcctgtaatcccagtgcacttggggaggctgaggtgggtggatcacaaggtcaggagttcaagaccagtctggccaatatggtgaaaccccgtctctactaaaaatacaaaaattagccgggcgtggtggcgggcgcctgtagtcccagctacttgggaggctgaggcaggagaattgcttgtacctgggaggcggaggttgcagtgagctgagatcatgccactgcactccagcctgggcgacaagagtgagactaggtctcaaaaagagttcaaaaaggggagaacagtggatggaaggtagaaagagtttgaagctttaaaatgctgttgagaaagaaacaaggaaaaaaaatgtctggacagagattt

SEQ ID NO: 95587 - DNA, 1078 bp, Homo sapiens
aaaagcaatatactacccaaccccttaacacgctactcaaagatatttcagacaggctctttcttgtcctgcccaatcagctatccctcctttacaaaacgggcaatctcctctttggaaatggtttttcacactgccctagagaaaaaaaaaatgcacctctccaaagccattcagaagtggattttgaattctcaagtctgccttaagggattatctctgtatcaatgtattgtatgatgtattgacaatttctagtatcagtttttattctcttttttaaacctcatagtctactgacatgttctatagtggaaactcaattgtaaaagcttatttgcaaaatgggaatgttttttctctactttcaaataactggaagatctgaattaatgctagtaaaaatcctatgagtagcgctaaatgcaattcagccacagtacagtgctttgaaaggacaaaattttaaatgtggtttttattaatgtgactcataggaaaaatgaagtattaaaaatgttattctctaaagactgacctgatgcaacaaaatgcaaaatatgtgatcaactatgcctaaaccaaaaattcagcaataattcaacttgtttttccaaattaagacctacaagagctagatctagtaattattccccatcaagaaaacagtaacaaaagattacttaacttgaatatctgaattttcagaaagcacaatctaaaaatcaaagaaaaatgataaaaagatcagtgcccgctcataaagggcactcagtaaaagtgttgtattttgttttaacgagtaagatgagagaaacccagagtgtcctctaatcatctgaggcaaaaatatgaaggtccatctggcagtctactatatgctgacagatcttttagccagtcagtccctccacctcactgggtccttggaggtttctccaggaaaaacgagggagatgcatagaggctctctgaagctccttccagaactatcattctatagtccaggacttcaatgtaaaaaccactgaccttagggagttcaaatccagcctggccaacatggtgaaaccctgtc

SEQ ID NO: 95588 - DNA, 1017 bp, Homo sapiens
actgtaactcatgatctttccatcgcagggatgggagaacgagggaaagaaaataaaaatgcagacctttatttacctctttctctcaaatataaaactagctaagaagcaaatttctacagtgaactgaatctgcttcccaaaattgggctatcataaatgaaggtaaaagaaacaaaacgagagaaaaattcacaaaaactttcaaattcacccttcatcagagttgcagggccaaaattggccaattccagtagacagataatgtccaaattcaatggtttaaaagctcaaaggcacatcagaataatccatgaggttacgaaaaccccaatacccaatcctggggttgcagcaaaggcatcaatctttttcttgcctcctcaagtgactgcaaattacagacatggttaggactctctgctttatagtgagactttaaagctccccaagatataccaagatgtaccagagctgagagcctctaccatacttttccttcagatttctctctcctactatcttcctctattgtaaaccaaggtgaggttcaaggcccacaggaaggtctcagcaggcactctgttcatcagctgcagcaggagttagggaatacaactagccaaagaagttgctatcagctgaagatgggcttattgtcttgctggcttttattgggtttaggggatttgcaggggctggctctgctctaaatattatatttgctagggaaagctgaagaaaacacacccttgctttttaacaattcttgaattctcaaccaattaccacctccttctgagcaggtgggtcgaaaggctttagtaaaaacaaaaagcaagggctgggcaccagtgactcatgcctgtaatcccagcactttgggtggccgaggtgggcggatcacgaggtcaggagttcaagaccagcctaaccaataatggtgaaaccctgtctctactaaaaatacaaaaattagccaggcatggtggcgtgagcctgtaaactcagctactc

SEQ ID NO: 95589 - DNA, 1659 bp, Homo sapiens
acagttccacatggctggggaggcctcaggaaacttaaaatcatggcggaaggcaaaggggaagccagacatctccttcacaaggcgtcaggagggaaaatgaatgcaggaggaactgccaaacacttacaaaaccgccagatcttgtgagaactcactcactatcacgagaacagcatgtgggaaacaccctcatgattcagttacctctacctggtctcttccttgaaatttatggggattacaattcaagatgaggttttggatggggacacagccaaaccatatcagcatcttattgaggatgttcccctcctttttgcatataatgcagacatctcactgtataaactaatacgctagtaacatattgtaaatatttgtactaagtgtaggagagagttgctgaagatgtttagatgcatatcttacatggtaagggtaagaaaaataggctttggataagcagagacggtagataaagtaggttctaatttgctttttgcccaacctctggagaactgtgagagtcactgtttgtcttctgttgggtttggcttgagaaagcctctctccttgtgtagcttgtgtgccttgagtggctgagctcctgggccagaatccaggtgagttctcagtaagggtaagtctagagttttcacattaagaagcttagaaatgatcttttgaaggtttgaagtattaactgcttgtttttaagtactttttgttgctagccttgctttgttttctacactttgagagagattgagaagaaaccataaactggtttgatggagttgagtaagctcttgaccctagaattggaggaggagattttaggttaactagtgaaacttcttgtttcggttcgggaaaccctctcacagcatttcatgtcagtcctttgcccttttctcttgcagactcctagggacaggggctcctggccaccattgtttactatatcactcacaattaggaaggtcggctgacattttcttccctgtaacttctgctctagtaaatgatgactagccagatagtgaaaacctcaatcatgtttccctaaggcttcttagctgtagactgagcatctttagttctatgtttgacatgtctttttttctgtcttacatgatacttatggatgtgctttagtttgatgatgacttatttaaaaacggtggtgcttggggatggacccagcattccagccaaccaatcagtgtgcaatgtcctgtgcacttgcttgccaggttctggacactggaacaacctaagatgacaggcaaacaggcaaagctgtgaggttagtgagtggcagtttctcaaggggccaggaggaatttccctcagtagtagtacactggcaggattagttatcttgagccagatcgtgtcatctatttgggcctcaggttccttttatacaaaaggagggatgggtcagtatgggctgtcattcctctttaaaatgttgagtgctttcaaaaggcagccgtttctgaaacctctaatacagggatttaacagaaggtgattgggatttattgggctcctggttccactcaaaggctaatgccagtgttttaggtcttcatttgtcacttggtttggtatttctgccacactttgcacattctgatttctctctta

SEQ ID NO: 95590 - DNA, 1049 bp, Homo sapiens
acaggggcaaatggtcacctacagtaaacttctgactaatcattttcaccaatgctagccctatttatcttcatctctgtactagacagctggaagttgtcagagggccaaaggtctttatttcttggacagtgtttgagcagaagttttcttctgttcaatgcccaatcagggtaccaagtaggggccacctgctttatttttttattagggtttcctggtaagatcatatgaaaaaatctgtaggttttggagtaaacacctcccagaatactctaagtcactcttcttagtcatttgttgggtggccaaggtcaaggcaaaaaggtgggctggggcctgcccatgggaggccgtctttgtcaaaccaaggaattcaggcttcaatctgaagcctcaggatgaagaatttgaagcagaagagggagaccactccagtaatagtagggtgggtcccatggaacagaatatgattgagtcaaggagaccagtttggatgttgttggattaggagctagaaaagaaaatagaaatggaagtagatagaagggtataaatgagttctggctgacaggtcaaattgtgatggggacgcagaagtctcagaatggctttgaatggttgctgacagatactctcaggatgaatgatgtgagtgatacttttccacagggaagaagtctgtttcctacagccttctatttactgatggtgttttccctgttaaactttccagatgcctactagttacaggtgttttattccaccagaagcaaattcacatcaaatattttgaatgttaaaaattgcagagctgctggagctgctgctgcagtcagaattgcttcccacttgtttttacacagtcccctgtgataacctccatcctaactggcccctacatctgatctgctccctaactttcagctgtccaaatcagttcgatctgtccaacagttcccttccttcagtggttgcccattgctgacagtataaagaccaagctctttaatgcgactctaggcccacctaatgcgtggccctcctta

SEQ ID NO: 95591 - DNA, 1363 bp, Homo sapiens
ttggttagtaatggagagggatcacttgcttattgcagcagtgcctggcatgtagctgatccttatgtgttttgagtataataactcgttctattgctgaccctctgtcattcaaaaatgttatattcagtatatttttttctgattgtcctgtacaagtaagcccctttgcagtgtgccctttaggaccctgttctaactttgtaacacccctcactgcttgtgagtaattgttgattcttcctgccagaatgtaagttctgggttgcagagttagtgctcctgacacttggtacctggtggatacttaataacggtttgttgactgaaagaacagtttagacagttgtctattaaatttaaagcagttaaagccctggcagcacaagtgttcatcaatctccttcctccctcattccttcctttctctctttgacaactcatttgtactatcacagtattacatacttgctctgttatgagctgtccatgtacaggaaaaaggggctattgggcaatcggagttttgattatgaaaagttagtcattatgacaaaaccatgaaacacagatgataaaccttctagtaaaatttaatcttttgaaattatttgtcacctgggagagctgccattctgacacttagtgctttttaaaatcagtcaggtgtgtatgtacttctgttggtcagagatggtgagtgggtgtgtggtttctgggagacctgaaaatggggccagagctgtgggttttctgcagctctaacaagctgccacccttattttggtgatgaggcttgtgcccactttttaattttttgattaaattgtgctgattacatggttccaaagaacttagggaatgcacagtattgctccagattacttgtcagttaggatttacctattgtgagatatatatatatatatatatatatatatatatatattttttttttttttttttttttttttgctgttagtcattgttgtctcatttgatggatcagagtgtgagattgggaaatgttacgtattaatatcaggaaaagagacaggcctggagtaggtctggaggtagggctgcttagtgttttattaaccatgctgatgaatgcacacattcaagataatctgttccctttccattctctgccactccttttgaattgctcaaggctgggattctatgtctggaacaggtgactcagatgaaataaagtttgaaaaggaaaaaaaccctgtcaatttctggttactcattatcattcagggtccagattctgccttttctctctactctctcccccctctttctccctcacttaggctcctgtcacctttaactttctcaccacactttt

SEQ ID NO: 95592 - DNA, 1006 bp, Homo sapiens
tgctgtttccagtagaataaaaacttgaagccatgctttttgaccttgatgtctgcagtaactgttcttttcaagcttgctgagaagacagaaagcaatgttgactttcaagggggaaaataaatatttgaagatagggtttagttgtctcagtttgcactgtcagcataagcaaagaccttcccttattcgctttgaaaaaaaaaccttatttttagagtaagggaaggaaacatgtctgttgagaaaaccttgctaaattttgtggaagtgcaaaattctctccttagtcctctccttttctgtagctaacaatagtaacagtgattacagtcagcatttgaatgtgtatgagccagaccctgaactgtttacccttaaaatacctccattagttgttactctcattgctacaaatgatgagactgaggtttagagaggttatttatcacttaaagccataaagagttaaaaagtggatctgagaatcaaattcaactttgatgcttgaggactcttggagcactactgtattataaactttgaaattttgaccctcttttgctgtacatggggaagtgtggagggtagtaggtatttttttttttttttttttttgagacagagtctcgctctgttgcccaggctggagtgcagtggcgtgatcttggctcactgcaagctccgcctcctgggttcacgccattctcctgcctcagcctcccgagtagctgggactacaggcgcccgccaccatgcctggctaatttttttgtatttttagtagagacggggtttcaccgtgttagccaggatggtctcaatctcctgacctcgtgatctgcctgcctcagcctcccaaagtgctgggattacaggcgtgaaccaccgcacccggccagtagtaggtgtttttcttaaggatatcgcagactccatgttaatgaagaggagttccctgcccacttgctaaattagatcaaggacattttactctacccacccc

SEQ ID NO: 95593 - DNA, 1152 bp, Homo sapiens
gtctgaaagagcaaacccatggcttttcagattttaaattctaaagggagaggctttttatcaggcccacgtcctgctctttttgaaagaggttttatttactttaaataaattactaaaattataaatctgtttatattcagttctaacttgtcttcaagttttctgcttgggaagactggtgagactggagcaagatgaactcagttttccccatgaaagattgttagggatgtgtgagcagaaggtaggttaaccacatgttaacataccttggggagtgtggcaaggtggctgccttaattttcagggcaactcagatgcttccgtctatctgacctgagcatgagcagatagatgttgattaatgctcttttgccttgttttttggcttttttggggggtttacatttggtaagcaatatttctaacacagtgaaagtaacaaaacgacagagttctctgtaacagaactgtgaccctagactcaataataaggaagagcgttgatttgaccgttcatttttggatccagtgtttgttaaggccctgactgtcagtaacagccatccttttcagttagtgtgttgtctgttccctattcatgtgacagggccttgttgagcttttcatgggcacttgcctttcactgacaggatgctgttgtcctttatttccattctgccctccccacttcagacatgataacatgtttactagggggaaaatacctctacattttaaaccactcccaggagcagataacactttctttttttcttttttgagatggagtcttgctctgtcacccaggctggagtgcagtggcatgatcttaggtcactgcaacctcttccttccaggttcaagcaattctcctgcctcagcctcctgaatagctgggactacagccacgcaccaccacacctggctaatttttgtatttgtagtagagacagagtttcaccttgttggccaggctggtctcaaactcctgacctcaggtgatccgccctccttggtctcccaaagtgctgtgattacaggtgtgagccaccatgcccagcccagataatactttcaagaagaaaaatgtgataaaggtaggactgcctgttttcttaagttgtttctagcacctctctttactct

SEQ ID NO: 95594 - DNA, 1051 bp, Homo sapiens
ctgcttttgtgtccatattctttttttttgtttgttttgttttttgagatggagtctcactctgttgcccaggctggagtgcagtggtgcgattttggctcagcgcaacctccgcctcctgggttcatgcgatcctcctgcctcagcctcttgagtggctgggattataggcacctgataccaggcccggctaatttttgtatttttaatagagacggggtttcaccatgttggccaggctggtgttgaactcctgacctcaggtggtaggcccgcctaggcctccaaagtgctgggattacatgcgtgagtcaccatgcccggccttgtgtccgtattcttagtcaagaatggtgtatatttcttttaggtttgggaaggggagagtgatgtatctggtccccatagcaggggtaggaattttcaagggtggagtaattaaagactgctttaaaggaacagatattcccaccttctaattagagaagatctgcactgcaagtgaccacaaattaaaacagctcagtggggacagaagattggatgtcatgtcccaacagccttatttatctctttttccttccaaggtttttttccctgcccccccttcttagctttggatagagattagaaaagctctctgaggaaaaaattaaccagcaaacaaacaaaacagatcccaaatatcattttaatactatgtctagtttggtccaagaaataggcttggttaatctttacagcagcctttgaaaatgaatggaaatactaaggaggtaaactgcttatactttttggcacctcttctgcttccagtgaagaaatgctctgtaggtgcttgaggaactggtgtcgtgatgaatgtcaccatcaaaagtgaagggtcgagctctttttttctgataagcaaaatgacttttaatgtctgtagcacattgatgtgctatatcagttgtatacattgtagtctgttttctatatcctcttattcagaggagtagccacaactccagtctctggtgtaaaacagcatgttagtatttcatagaat

SEQ ID NO: 95595 - DNA, 2502 bp, Homo sapiens
ctctgccatgagactgatcctctcctgcttcccagtgctgctttcaagtcccagcttgtggttgggaacacaatagcttaacccctggagtctcaatgtctcatctgtaaaatgggactcagacaaaaggccagagggggtgaaactttaaggtgcctttcttcattcagcacattattgggtacatactgaatactaggcactgctgtttccatgtatttaaaatggaaagaaatgcatggcctctgcctgacctcatggagcagagagagaagacaggcattaagcagacaactcctaaatcagtggttacatgacatgtaagttaaggaactgttaggaggtgctgaaactaaactggctttcatttaaaaccaggtgagttggtaggggctcgactacagacacctgtaggtagggtagactgggcattctatctgccttcaaggtatgaatcttcgctgtggtctggacagtgtgtcccatttacgtatacactggcattgctttcttttatactgttttgtttcagtttggtcccaaaggagccagcacagtgttcatcattcatggggaggtgtcagctgtcattctactgtttccttatcaatgttttacattttggttttgagcattctgatcctcatagagcaggtgacctctgtgtttgtagggtgagccatgtgaacgtcctctggggctggtgggggagagcagtgctttccaaagcttaacggtgtttcagttccctatttgttttttgttatctttttcttctgaacctccctgtttttccagggttgtaaagtggattaaaactaattttatattgaaatggaaacttttataacatgcccaagggtaaatgaagtcacaacaaggtagtgaatgaaagatttcttgaaagttgatgaaaataaagtagcatgggaatcacacttggtcatacagttttaaattcctcaggttgtattcacagtgcaccagcttgtctcttacggagtgcttagtttctcagcagttcatattcttgtatgaagggtggcattatctcaatagaattggttcattcttagctcaggagaaaatgccactgcttatatccatctgcattttctcatatccttattcatatagtgcctagcctattttctgccaatcatagctaagctcaccctgtgtaccagaagtcacatagtactgggaagttccagggtaaaggagggaaagaaagaggatgacattgatggtgcactcagctgggcactgtgctagtgctttcacctatgaggatgaatttgaggtaatgctattcccatttagctgaagaaaaaaccgaaggcttagcaaggttaatttacctgtctgtggtcataaattggaggtactgagttagaatccaagcttattccataaaactgcaccaggagttttactggccgtgtccacattccacatcattattgctactggccactgtccacgtctgtgtatgaaaccgtgtcaggctcaggagacctgtttctgtttctactggtgccaggctccgactgtagggagcattggcagttcacgcagatagtcatggcattcaaggcaaaagcagactgcaggacaatgccagttctgtgtttattgcacagtaaatgatgacagtaacaatagccagcatttattgtgtgttttattcactccaggagttgtggagcatacttgtacatgcaatatctcatttaatctctcaaattaatgctataaagcaggcactgtttttatttccattttttagatgatgaaactgaagcttagaggtatttgtgcagtttgcctgatgtataggtacagagctactaagtagcagagctgtgatttgacttccttgccaagcttaaatgcctccccagatttgcctttgatttaaagagttaatcagtttctacagctcaccctccccacctgcccttttcccttgcctaccccataacatgcattttcaaagaaaatctttgtttgaaatagtttttgaaatgtgcctttggcattttgaacataaacattctcattgtgctgcttgcaggcaagaggctgtggaaatgcattccctggaggatttagcaaaatagggtagatatccatctttttttgttgaggttctggactctgaaaaatcaagtcagtggcattctaagatctcatctagctatgatttatgaaacacagtgagatatggatttcagcaagtatgggaaccacttttagcattttatgaattacctttcagacatttttgtccgcaagtatacagttttttttttttttccttagcccagcaaaaacctttccaggctttagtctggaagacagtctgtttgtctcaaggagtgttcattatagaaactaccaagggattttggtgactgttttggatttaaccagtaatgcacttttaggaaagtacctcagtctttggtggcttgaagagttaaactaccttggtgtaaa

SEQ ID NO: 95596 - DNA, 1067 bp, Homo sapiens
tagtgtgcttcactttctgtgccagactggaaaagtgtgcataacacaaaactaaatgaagtcttttttggcattcacattgcaaagtgtttcatcagtttcatgtaatataaagaattgcttaggtgttatggtaattaacatttctttatcttgccccgcgcctgggcactgtgctaaacctcacacacatgaggatgtcagtcttcatcttcactccttgatatgggtacagatgaggggactgggctctggaagttggtaatgttattcactgcctccctgtctgaacccatgctgctcacttgcttttaggtgtaacccttccttgatttatctgggttgacaaagtcggtttctttgcattgggttttcagaaagtggagtacaccatcttcacattggtgtagggtagtgccttgtaaatgctgctgactgcaagacccccttccttgggcttctctgtgccctagttgaccctcggcacttctccttggacctaatggaccccagcacttcttccttgattgtagcactagaggcaggaattatacctgttctggttttgatgttttcccaactcaagaccctaaatcagtagagactctgaatcaacctttttgcttgacaatgtggtaagaataggaaaagggagggcagcaagggggagggaacaaagacaatgccaacaaagcaaaatccctaagcggatgtgtctgtctgttgaggggcctctcactgagcagacaggaaaataggccgaaggcccagaggcgacctgggttccccaccccgcaattgccttcaatttttttcttgtgagtacacagtagaaaagattttatggatacatagtaggtgtatatatttatgtgttacatgagatgatgttctgatacaggcatgcaatgcgtaatagtcacatcatggaaaatagggtatccatcccctcatgcatttatcctttgtgttagaaacaatccagttatactgttttagttatttaaaatgtacaattaaattattattgactataggcaccctgttgtgctgttaaatactaggtc

SEQ ID NO: 95597 - DNA, 1506 bp, Homo sapiens
ggggacattcaaaccatagcaccctttttgaaagaattactcgtaaactctcatgaccggatttcttctcttgcacccttcattatctgctcatttaaattgtctccacttctctaacatagaggtgatttttactacagtgatagctcctcgaactggaactgagcttgctgtctggtccccccacctgccatctgtcctagaacacagcacacagctgtaaatgactgaacaagcatgcagagcccagatgactgggccctttctttgttggagtcagaatattactgcctgacgtaatattcccggaggctatcccttaattgcaaagactggatagtaattagtgatcataatgatttccctgggccattaagaaaagtaccttttaatgtgctcaagaattcagggtttagaaagatttccatccagattggctccttaaagaaaaaagatgcggtgcataatttattttactttcagttatctgctaacgcagctatgcaaaatgactcatttattggggagtgggtggtggcattaggtaaagtcttaccatattgtctattttgactgtttcattcttaatagaagtctacacattgcctgcaattgaggtataattttctttaaagggagtgttgtttcagataaggtagctgcgacctaagaaaggaataattctatattgattttaaggtctttagggaatggaagcactgtcttattaattggaaagtcccaactgatagcactgacatattcatgtgctttctttgcctgcctgctcatctgcagccctgatcacagaaggaagggagaagtagataagaaatagtagttatgaggatgaaacgtgcacatataggagccctctcacgttaggcttggtttggtgtctggaggcacgtgatgagaacagcagtggatctgtgggctcatgtttccttactcctgctctattaggactccagtctgaagggatgatctagtaccaaccaggagatgtttagaagaccgagatgtttcctgaagtattctgagctgtctcaggttgattacgtgctttcttatcttagatggctcctggagagctgtctgggtaatatgctctcccactttggtaattttggattttttgcagatgctttttgtaaaagaacacctatgagtgaggcctatggttttggggtttgcagtgcccaaccagtcaagctggtctttgccttttttgtggttggatatggaaagagtggtcagtagatttcccagtgctgtactcatgccattcagctcatagtcacataggtttccatatttgctagtaaaaataagaaaattcggaaaggggagtaggttggaattgtcaagttgaactgtgaatggtgtggatgagatattctggggagagaatggacagaccaggtttggcttagctactagttgagtgtccttctagctctctgggatttctttctaatctgtaaaatcaccattttgttgaag

SEQ ID NO: 95598 - DNA, 1037 bp, Homo sapiens
aggtccacagcctggtatagagagccagtctaggtgtgactcttgagcttgttaacctagccccctctgagctttagtttctccatctgtgagttgaggataatgatacttgcattgtgtggggagtaaacaacaatgcatataaaatgcttgttcactaactgccccaagagtagggccaacatggttcctgtgtcctgttcttacagtccaacctcaggactgtaatgctctccggtgtcacaggatatgcttgctggagttgatgctgtgtgtgtgcacccctctgggctatttagggacgaaggcatttgttattcctaacttctgtgtttatttaccttacatagtatcataaacatcataaattttccttctctcctattcttaggctgtatgagtacaaaagttttatgattctggaaaaaggtgaaatttagggagaaagcactatgaatggaaaaagtgctgttgagtcacgtgcactttcttgctaagatgtgaggtggtggcaccatttaatagcaaggctctgtgacggaaggttggaggatgagtggtgaaactttttgatagagtggttggtattagaccatctcttcagattggagtcttgaggtgaaggctctatttttcatttcttgaatttattcactcctcacagttcctcttaatatggatgagacaatggaatttgcctctcaacgaatatatttaatcatcaaatgtgttttaaagggataattggagtttaggtaaagattatgcagcatgaagttacctagcctttagtgatagtagaacatttgagaagataggaacattgccatcttcttctttctttctttctccctctctctctctctctctctctctctctctctctctctctctctctctctctctctctctctctctctctctctctctctctctctctctctctctctctctctctctctctctctcttctttctttctcttctttctttctttctttctttctttcccttttttgagttggagtcttgctctgt

SEQ ID NO: 95599 - DNA, 1010 bp, Homo sapiens
agaaggaaagccaggacagtgcatgtgacattttccctcatcatttggtttctgtcagcgagaaatatgctttagtaatttggaaataaactcactgcagggggtgaataacaggtttgaaggttggttagttgccaaggagatgaactttgtacgcttatgtggaaagtatgagaggatcacttaatactatatcctctgaaattctactctttctccttgggttcaacaaaatcatcatttggttttaggttgtgttggcagtcacaactataggagctatcattaatttaggaaacagggttccagggttgtgcttgaccactgaccatgtgccacacaatgttccttgtgccccatttattgtacacagaagccctatgaagtgggcactactatgatctcacttatatagataggagcctgaggcataccaagcggtgtcttacccaggtacagttactcagtgtcatagttgtaatacagtgtcattttcatagagttgctttgtccaagttgtaacttgagttcctacacagactctcctcagatttaaagtttcaaagttcacaactctttaagtcatgagacacaagagggacaggcttttggaaaatatggggatgttctttctgttttacatctgttgcagaaggaccgtttctcacaaagttgttaagtagatcatgctcagcatatctggatgctctttgctactggcctgagaaatgaccagcagggcattgcaaagagtgggtagagagtaacaagactgacagtaattaaacccagtactcctcatctgggtgaaaggagaatgatatcaagtatgtctggtatctagtgatataaatgggttataggattttagattccaggtgaggcattataatacaactgtaagaaacctgtctccctcatccccccgacttctttatacacttaaaaaaaatcccagaattttaaagaagtgtataaagaagttggtgggaggagggaaataattttaa

SEQ ID NO: 95600 - DNA, 1004 bp, Homo sapiens
agcctggaaaacaagcccttgccaagcctgcatgtcaaagctcctcttagctcctcttgtgcagttgtaggcattggcctggctgggacctgggagcaagtggggagcaggctgaatgagagagattttgcagcatgtgcttctggttccaactccagcaggaggggctattggagcgggttctcttgatgagaacaggactcttcatggttttttttttttttttttttacctccacttagtttcatctcaggagcaaaaaggtgcaaatacttgtttttgggaaaaatcacagattggttctgactctttaggtgaaagtgagaggcagttaccaggtcactagttattcctcaggcccagaaggcaagaattgcagcaggtgtgggaaattgaatggtgtggctgctcttctcccgagctgtcagctgttggcaggctgaatgaatctagctctagagctggctgcagacaatgcaaagatgtgggcccacttcacttgctttacttgattatgtgaatctggaaaacaaaaccagctgagaattacagatttcatcctcgggtgaggtgacaagggactatggaggaaaccaaggggtctggaagtggggaggcatttatttgcaagagatgtcaagttctcttcaaattttgtgtgtgagtacttcagctgtattaagaattgactatccttaggattttgaaaggctctttttagggaaagcatgtcttttatctgattggttttgggaagggtttaaggaacagattaaggatgtgctcaaagtggatggtattaggatagcagatctataatgtggtttgtttttgtttttgttttaaataatgacagaggatttgcagaaaaatgtatagggaggtctcatgtaccgttcattcagttttcctgataaaatcttgcataactatagtacaatattataacttaagtacatgcacaaaacaaagcaaggcaaatgattgcttttaccagtgattgc

SEQ ID NO: 95601 - DNA, 1039 bp, Homo sapiens
cagttcgtgcttactgaatgcatttataccaatggatgggcatgtggttggggcacttgttaaaatctgccaaggaaagtggcatggcaacttactgaccttcatttttttgggtaacagcagatggtaaatttggcagttggtattgttggttggagctggataagttgggcaggttccaacatggtaatatcctttgtgcttgtgaatttgggttggtgaatggcctttcagggtcttcactggagacatttatttgtgtaatttttactgatttaagtttttgtctttatctctgtaagtcaatacacactcttggaggaggaggtacctaccacttgagagactttgtatgtgttttcatgacaacaatacgtttactttttcttttgtgcagaaatttagttccctcattatattcaagataggtgtgtggtagtttatggtcctcctttattctgacaactccgttctttttcctgccaccccatgagagttctagttttaaaacaattgcttcaagttagccagactgactcaggggactccatgcagactttgcatgtgttttgcttcatagccattcagagtacagggagatgatgatcacaagacagggaggactgtgttgttctttagggagtgatgttgtttgactcttcgcagacggaggacatcagcagtgtctcgaggccttcttttcatgtctttcgttcagccactcctgcagcctccagtccacctcctcacagcacgcgtgcgtgtccctgggtacttgcagatagatggagtaaagattaaggaacacaatggcaagttaatgaactgttttaagaccaaaatgacttactacagctttatgaaatgtgtaggtagtagactgccttaaagttctatataaaatgattaatagcaaaaaaaaaaattgctaatgacttagagtatctttctggtgattgtttttaaaaatgtgcatctttgctgtagataattgccatacagtgtgcttatggtgctggatggggtggtgggatgctag

SEQ ID NO: 95602 - DNA, 1904 bp, Homo sapiens
gggtcactgcccttatggcctgaagtctcttctaagcgctttcgtatattttggctaattttagttgttcaggtgggaggataaatcatctgtccttgatactttattttggccaggagccaaagttcccttcattcttttttattgaagacacattttgtcaaatatgtaagcacgagctctggtgcctgtgagtgcatggatgaatccagcatgaagtacagaaacactgttgcttatcacaccctcctttagagctgtactccttgttgccattcctttcttggacctgtttttaaggttttagacaacactctattcaatgtgtattgtattctttctccccttgtgttatgggaagcttcatggagtttgccactgggttagggagaggtatgaatagactgaggcaagattctcctcaagggacctttggcaggtcaggaaagtgaagacagtggatgatgagtgctccacctaccttctccttttgctccgggaatgacttaagtctggaaagagccgatactaagaagttgagggtctggattggtacatcatagtaaacaggaagaaatgaccatgaggctaaggtcagagtggtgccactgacccagttgaaggcagtttaaacagccagcctctagttcttcaggctctcctaggcctccctgcacaactgaccattggtttcagtggcccaagcagggaaactggcagtgaccctcgagcagcaaggaggggagaggaccctcagtccaaggacagaggagatggactgtgtgagttgccggaaagctcattttgaattctttgggggccaaacttttctatcctaaactcttatttttttttttttccaaattaggaaaatagtatatgacaattgtagaaaattgggctataatctagaggtaatatttggtagcatttctcccctcctcctcaatgcattcatttaaactaagtactaatatgaactatttcaagtatattattgaagacacttgtacccatggtattttgtctatagattggggctcgacgaggtcaactgtcaggattcctgggtgttgatgacatgaagctttggaaagatctaatagtttcttttagatcctggaggaaatagtgatcttatttgcatttattgtttgagtaagatcaccatgttcgttatttgtcatgtggtgctttttggtgggggtttgtcagacatgtattttgtcctccttgtgggtcattcaggcaagcatcagtctcccaaagttgttgatgggcaactgatgtagaagaaaatagaatgaactatattcaccatctgaagtcctccccacccccatccatccaggtgaatggtgtcattgtgtagttgtcttctatatcacattatttttagataccagctgagtagtgcagtctcattgaaagattcagcaggtggcactttgtagaagatggaggggatccagagggcgcgctgggggctttgctgtgtgtagtaaaagttctatgttgtgctttccatggagaagagggcgggtccagggcttcaggccattgcatgctgggtttggaatcccagaactagctcattggttcagtagcagaactagaaagaggatgcgttgcgtttttgtttgaaatgtgctgaagacagtgtttttttattgagcaggctgttgttaaatttgtaatttttccgtcagtttttattgagactgattgatcttggggggtgcggattaattttaaggaacatgtaatttcttccttttgatcagatcctatagccttaattttgttctggaatctttcctgtgtagttatattcatctgtgtttagttgactagttagtgaatttaagttgtaatgtgatgtgcctatttgaggccaaaaaata

SEQ ID NO: 95603 - DNA, 1078 bp, Homo sapiens
caaggatgattttccctttcctgcacagtttctcttctttctcactttaactctgctttcccctcattctgtactaactacaaatcttccttaacctgactctttgcaggtagtatgtcatgtatatataacaaggaacagaatgcctacctggctggtgtgcacagcgtcttctccaggtttatatgagagagagaggtggagataacagacttctcagactttgtcattcacaagggcaacttatttttattttccagacttgtgtcactatctgtttccttcattccccaccctgatcttctcacacaaactctgggtttcttcctctgctcatcttatttcaataaaccaagatgctaggagaggagccaagtctgaaaccacattctcagtgatgttttgttactggggcccactggacgtagctgaacctcttttcgggttagtggattctcgctgagcacaccgtcacagactacacctccagcctgcgttcatgtattcagtactttgccttggcttcactagagggtgctgtcgtgcagggttgttagaggtaaacgttttctggacttaaatggaccagatgatctgtatttgcaaaggaaacagattttccaagtgataagttcaaatagtatcagtcattttccttttgtggtcccatttttacagctgaacaaaccgaggctcagagaagtggagtgcattgcccgaggtcacagttagtgggagagctggccgggcagtcccctcgcactatccctgcggctctccgtgtctgcctttacctcctatgcatcacgtcctataatcacacttcaaaggatgagtcctctaaggttcctgttcttggcacaaggataaagtgaatgtatatgtgcctctgctcctggaggatggagaacttgtgttcctttcattattgtatgtagtgtgggggaagtaaagtcattcacatcgttcagtagccacacattttatttttattttttcataaggatgaagaggaagaaatcaaactggagataaatatgctaaagaaatactctcatcacagaaacattgcaacata

SEQ ID NO: 95604 - DNA, 1066 bp, Homo sapiens
agtagaatgtttttgaggtaaaatgaaaaagaatgttagggaatatttgagtcagatatttgataattgggtagtgatgaagagcaaagtggtcctcctgtgcccatgtgcttctgagagagaatgagcacttcagaattgctgcacttgggtgtgccgtagaataccagacactgtcagtcttctggaccaaatatatggagcgaatacactggactatgaaatgagctttcagttatttaggtgcctccaaattattatgaattattgaggagcatcacgtttctaggtctttagaaaagagagggcatggcggttaaactggttttcccaatttctccaagatatgttgctcaccttgtgtcttgtctgccctatagcttgttatggagttctgtggggctgggtccattacagaccttgtgaagaacaccaaagggaacacactcaaagaagactggatcgcttacatctccagagaaatcctgagggtaaggaaagtgggtggctacagtgctccaactcatgatcctgtgcttccgttttcattttcccagccccaagtacttctttgcattacttatatctatatagattattctctttgacagccaagggttctgtatatctagctagctttgataattttaagctacatcatgatttgactctggcaagtatgtaaagaaggtagacttaaataaaaaaagcatttctgaatttactttccatggcatcatgacatacctattggcagctttcctttgagttaaaaggaaatcagagtggaagggaagagaaataatctccaactattgtttttaaaggaattctgtgtttaagcttataaatcaatactaatggtgctgaatgctggttttcaaaatcaccttgaagtctttggcattagctactagagtctgttacaatatttatgaagaaaagttcgaatgtttaatattatttacagccatttgaaaagctggctaatgatcttagagtaagtttctgaactgctattttagcagcttttaaatggttcttttgagtagtaaagccatattga
